United States Patent 6,812,339 (POLYMORPHISMS IN KNOWN GENES ASSOCIATED WITH HUMAN DISEASE, METHODS OF DETECTION AND USES THEREOF) - sequence listing, part 33

SEQ ID NO: 13445 - DNA, 57103 bp, Human
ggacgtagtggcgcatgcctgtagtcccagctactcgggaggctgaggcatgagaatcacttgaatctgggaggcagaggttgcagtgagctgagatcatgccactgcactccagcctggcgacagagtgagacttaggctcaaacaaaacaaaacaaaacaacaacagaaaaacacctttgtaagttctaaaaaggtttatatggtagcccttctgaatggagcctgggcctggtggaacttacagttctcttcctgtcctaaaaggctgagttgtgaccctttccgggtttgaggcatgcttttcagtactcccctctggtcagttttcactgatccttggcagctggtaacggtatgctgtgaggaaacctggggtagacaggctccagacatgcagttagcaagcactgcctatggactggctagtgctgttgggtgcccaagtgtaaaaaggagtattgtgaggttttcctgttcaagcaacgggagagacaagcctagctcctttctgctataggacctttttccccacacatgctgatccttttgctgagactgctatctccgttttggcttcatgccccacctccatggacatccattgcatcttaactcaatgtcccttccctcctgagccccagaccagatcacattccctctattttatgttctctacttttccttcatagcattttagctctttgtaatgacctctttctgtacatcttagtttgattccattcttcccattgactgtaagctccacgtaggcagggaccgtattgcccttgtcctttgaattagcttagtttctgcagagctgtttgaaaatacttgttgaaagagtgaatctcttcaacaagtatagcatctgaagtcctgcttatgagcagaagcaaggcattagcatgtagctagtttctaagtgctgttctgaggcagggcagggtgtttattcacataattaaaacaattgattatattaatttttaaaaaacttttgtgcagtgattttaatcttgttaaaattggccataccaaaatagccaaatcaaagtcatcacaatcaaattcatacttgtctcccctgccgggctttccatcattacttttacttaagtcttacccactgcagaaagccttcccaagccagcccttgccagtgtcagtcaccagagctaacaacatcctgacgcactcacactattgattttaggttgcttttgtgtttccatttgtgctgtctccaaccttctattgtaaggccctgtggggatgctggcctcgtggcctcagaggtaacccatctccctctcccccttcgctgctgccctgtaatgcctgggactatgctcttcctaaaactggattctgataaaatgtgttgagtggccagacagaaaactgaggtgataatcactgttaatttgagaaccaattttgaatcaccaaggttggtagcttattatttgcaaaaataattggattctactgttaaagaatttgtgagaagcaacaaggaaagctgttaaaataatacaaagctctgtgtgtgtgtgtgtgtgtgtgtgtgtgtgtgtgtgtgtgtagacaaggttggggcggggtaattctagaaggaatgagaaattaaagtgcgcgtttttgggtgtcttaaactattgttcacacaatcaggagaggggctgttgatggaaaaagcacacaatcttcatttacattggacaggacactccatatcgggaagcaaaaatccctggcttcctttcttgatgcggtgaagttagtatcctctttgatgtttgcaccctaagatgtctctctgtcctctcgatgtcctaggccatttttttgttttgttttgtttttttccttcttcctctcaaatgctttttcttgcctgcttatggtttgggctgcttccttaatgaaaatgccctcttattttcagatgcaattacctctgccactgatttatttatttatttttgtctttagcgcttctctgaagtagctttggaaagtagagaagaaaatccagtttgcttcttggagaacactggacagctgaataaatgcaggtatgtagatttgcatatttttaaaaaaggaaaatatctggctttaaaaaaattgatgaaaccgtgttcttgaggctgtagggctattggtgctattgcctttaattttttgaaattgatgtatttattcattcccaatgttgagtatgctggttaaaaaaaacctcaaatacaaaagtataggaggtacagagtaaaagttaaacttcccttgtaatctctcctagatgttcaccactattaagaatttattgtacgttcttctagattttaatatgcatgtgcataatcatattatacatgttgtgcatatgcatgatcatactatccatattatgcttttttcattttgcagaatgtcctgtgcatctttctgtgttgattcatatgcagctttatgttatcctttttgacagccacatagtagtcctgcctgttttgtttagtgagtcctctcctactggacattgtcagttggatttttttcttatttcttttttttttttgagtcggactcttgctctgtcaccaggctggagtgcagtggtgtgatctcggctcgcggcaacctccgctttcccaggttcaagcaattctcctgtctcagcctcccgagtaggtgggattacaggcgcatgccaccacgcccagctaatttttctatttttagtggagacaggggtttcaccatgttggtcaggctggtctcaatctcgtgacctcgtgatccgcccgccttggcctcccaaagtgctgggattacaggcatgagccaccacacccagccgattttttcatatttcaaacaatgtgacatcctgtaaatatataattacatgcatttgcctgtttatttccttagagttagagggtgcaacactgtctttggattcttcccctgtcacgtctataaagactctcaaggacaaaggtttatcttacattatgaagcaggcttttagctactctgttttccatcacagtttttcaatgtgggatggggttaggggttcagtgctgggttttcaagtggtcttgcttgttgatctgaatttcaaggttaattatgaactaactgtttcaggctggtttccagaagattctggtcttcagatttatttggaaattaaacagttaaaattgaatacctctcagtttgtagcattgaggcatatctggttaatgtccctcttttcagaatctctcctcaccaggggagctaatagaccaagcaaatgaatttggtgaagagaactgtgactgctgtctgccctgtatgacttttcttgtttgggggagcctccttgggtcattctgcaagcacccattatgtgtaagcctctgtgcttcttacggatatagagaaaaatgactcagttcttatctcaaggaactcacagcatgtgcataagatgcttaaatttcctgtggctagtgcagtgggataagtttaggagcaagaagcgagggccttagggaatgggatggaggttcagagatggcttcctgcaggaggcgatatctgagctgaattctaaagaaagttgaagtttgccatgcaagggataaggtagaaagatattcctatagaggaatcagtgtgagtgaaggcaggagggtgagaagtagcattgggtaggggaggatacagtaacactgacagccttgtgggtttcaagcatgaagcaagaagctcagagtgatagaagataaggtgaggaaggctggccggccagatgatggagcagggctctgtttcagagtctcagaattgctctgtagattaatgggaagcccttggaggatctggtatgtgttatggagaaattactttaggggtttaagtgaaggttggcttggcagacaggaagaaagtagtaggagtgtggggtcagcgaattagtttgtagcccattggtattgggcaagaagaagaaagaatgtgtagggctttccctcatttctttcctcctttctggccttgcccaaggctaagttgctgaggttggttctttggccctaggtgctctccctttggagggtgcttatgtgaattacttacttacgcacttttcaccagggttttctaactgttccaaagtaaggcctcctcctgccctcctggtgctgcgtcaaagtcctgccgctcctcctggggtggtaggaaccaggctccattcattaattgttatggcccttccatgtgacttatgaacatgaattggtcatcattttgtgtgcagtgtctcaggtggggatgtgaagagagataagatacggttcatgccctcaccatgcttgctttttagtgggagatggacatgaaattaaaatgctgattcttgccataagtctgttcaaagcttatgtgattccagtagaaacagcagcagaatttgtaactaataatcagtcctttaacattgttggttccagaatgggctacatttttcaattacaacttgggtgcaaatggagaaaataaattcaggccatgtctaaaattattctgatttttgaaaatatggtctgaccatattttcaaaaatacataattaataaattacaattcattaattagtatgcataattattttccatggtttcatctcttatgagatctgacatgtttggtttccaggaagggaaggggcaggggagaggtacgtatccaataccaacaccaaatgtttctgcttttttaccttcagaacactcccttttgccataagaacttttagcacatagagtgaccacatagtcttgttttccttccacaacagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtgagtactggcagctgcccagggctgggggtttcaccaacacactagttcagaagatctgggggtctctgccccttgtagcgctgctgggcagaaagagttgtggactctggagtcaggttcctccctgcctctgccactgccacttgcacgtgaccttaggccagtgattctaattctgagggtttcgcttttcactttcttcatctgcagagtggcttctttctgctccgtcactaatgaactataagataccaggggatgacgcttgacttctgtggatccaggctcagttctcatttccccacatctgtacaattggaataatatcagcactagatgaggtgctacgtaaaacacctgggactaagtccctgctcagcaagtagcgtatctcaatatcttaataattattcgaaacttctcctaaaaagtttgacccctccttctgctgccgtgactgccctcccatgcgtggtgctgagttgaagtgagaagctgagtgttgctttgtggcttagtcaagttcccaagttgtgaaaaggacgaggctctcaacaacacaagcttttttttctcctttcaagtgagagttgtcttaaagttagcctgttgccctcagaaggtgggaaaccaaagtccctttcatcctttgaacttgaggacattggcagtttttgcttgcctgattttaaatgacaagttaaatcatagaaattaagttaaatcacagatctaatccacttggattgtgatgatggttgtacaactgagtaaatacactagaatctgttgaattgtacacttaaaaattggtgaattttataatatgtaaattatatctcaaagctgttttaaaaaggttctatcaactcgttttatgatgatgaagtagccatttatgatgccgtacagcctgatccctactttacttatcccacctttaaccctcagaacaactctgaggggataggttggttattttaagaattgcttatcttgttagtagtacagcttgtttagaaaacctaccttctttctgatatttgtctttctgcctaaaatcttcacacaccagagtttcaggaaaaggggagaggcttatggtatggggaagagcgtagtaggctcttactgactaaacctgacacagaataaaatgggctgaggtgtatagattattagtgggaaaaatccagtaatattgtcaagttattttgactaggccgcaatgtgtacaaataaccatctttagacagcagctttaagtgtgtttgtaattatcagaacacctagatgtaaatcagtggttctaaagttttttttaaggctttgtttttttgttttctccctttccccttgagatttggtttatattgtttattctcttcgccaagcttcttgccatcagcacagcaggtataaacctcactcagtttgtaagcaaaggtcattgttgcagagtcattgggctgctgttaatgagggaccaaggagctgctgggaaagagatgagaggagagagcctgtgagtctgaggatggacacagtcgctggacctcctataactctgggcttagggtcagccagtttggggtgtcggtttctagcctaccttatagaaaatgagtggtgtctcttctgtaactggctcaacagaatattgcagaaactcatcaatttcagaaatacatactgaatgccacaggttcttgtagctctcactgttactacagaaagtgatgtttgagggcagtattgttttctttcctgtttttcacctctgtggggtaaagttttgtttagttctcattgattcaccccctcagtagctgtgtcttggtttgattctcagctctgcattttactagatgagtaaccttgaatcatactaaatctcaggagaccacagattcttcgtctgcaagatggtcaaaatagtatttacctcattagatattaggaggattaaagggtaatacttttttttaaatttaaaattttaatattttttagagatggggtcttgctctgtcccctagactggagtgcagtggttccatcatagctcactataactgtgacctcctgggctcaaaaggtcctccagtcttagcctcccaagtaactatgactacaggcatgtgccaccatgcctggctcatttttattatttatggaggtcttgatatgttgcccaggctggtgtcgaactcttgacctcaagtgatcctcctgctttagcctcctgaagttttgggattacaggtgtgagccaccaaactcagccaaaaaattatttatttatttatttatttgtttgtttgtttgtttgagacagagtctttctctgtcacctaggagtgcagtggcatgatcttggctcactactacctccacctcccaggttcaagcgattctcctgccttagcctcccgaatagctgggattacaggtgcacaccaccacgcctggctgtggggtttcaccatgttggccaggctggtcttgaactcctgacttcaagcgatctgcctgcctgggcctcccacagtgctgagaatattataggcctgagccactttgcccggccaagataataaatttagagtctgtttgcctgatgcctgacacttagccctcagtaaatgttagtattattgttttactactcagtacttttatataaagagatatgtctttgatctttctgtttatgggtagtaatactgttagaatcagacctgtgttagaattacagacagttccatgattaaaataagttacacttcagatatgtaagtgttggtgcacattcaaatgtggatatgcataaagaaaggctgggtttccagcccagtccacaaaagccactttatgaatgaaaatctatagcatatttgaattatttgtcctaataatactgaatccaaaagccatttgcctatgttcccaaggaaaacttccctttacagtttaactccatattctcggtttataagaaagactataacttctgaagggtaactgttcatattgcttgagaagcatggattgaggtgttcaggagagcactagatagctgccaaggtatctgtagcttcttaactcagtgtctgcgttggagagagtccccgcctgggtgtgctgggccagggagggggccctgtcagtgtcagtctcactgcagatgtccgatttgggaaacaagtgcctattacctcatattctcccaggttttttgtcatttaagtttacctcatcttagtttgaggcctggctgcttatgaaaatatcagtaatagctgattattggcagtcattctccccccaacctgcctatgtttcaggttcataaaattttaatcatgggcgtagaagtgagtgacttcataatctccctggtctttcccatcattctcttattgacggaggcaactggtggagtggagaggcaggggagcactgttgggccagctttgtgaagccatatatcttcttgctagttggttactaaataaaaaatatttgtgataatcatacagagtacttaagaagtatatttattattaatggtaatagattttaatcactgacaaaaatcactttggttattatttattctaatatgcattttgcatactactgccaggaatttgtttgcatgtctgatgtataatcacgagcgtgttagaattgtttaagtgctttctgtaggaaacagatggaagatttccccaactcccagagtgtttccgattagcaaagtgcacatcaggcaggatctgtgaacctctcagataggggtttttttgaagctggatttgataagactctgtgacggatacctgtaatgagaaatatcatcagagttttatttttaaatgatctaaatttggtttgccaggagctacagtgcatatttctggggagtcatagttcttgatgattatgatcaaaacagcctgaccgaacctggtcggaagtctgtttgccctaagaggatatgagtgacccagattctttgtggatgagagagttccttatctttgcatatattgggtttagaaacagatggccaaatgtatccgccttgattttctgatgtgtttttttacttttcctcaggtatctctcctctttgtcacaacctctttgccctgtatgacgagaacaccaagctctggtatgctccaaatcgcaccatcaccgttgatgacaagatgtccctccggctccactaccggatgaggtatgggaagtactgacctggtacctgcctggctccctctgcactgagggacagtggtcagcctggagccctgagtcacttaccaagaagtattgtagtcatttttgtaatttgtaacttttgtatttgcttgatgtgagaaaggacttcttcagtatttggaatacaattcaagatgagtttgatcaccttcctctgccacattttagaaaagaaatcttgataaggcagaggatattttgaatagaattagtgtcctacagcagagtttttcaaatgggtaatcatagttatgaatttaatttagtggattcacagttatgaattcaatttaatttagtgaatttaagaaaaagaaacaggagacgatactatcagcatatatacataacctaagtatattttttaaacttttgagatatatatatatatatatatatatatatatatatagatatatatacacactatatatataaaggtcatgatataaaatatttttcttactaaagttgcaactaaaaagctcgagaaacattgcctgaagtgttaactagaaattctaggttggccttgctctctgggagtggatgttttgactactccttgaggatttttggctgtggagctgtaatttttcttctgatgggcacctgccttttctcccatattgcagactttgagaaatgtcacaggtgacacagacagtcagtacttcaatagctgcagtctcctgagtttgtaaacatatttgttcagtaactagaatggaaaatatgttagttacatacttgctaagcagaagttaatgtgtgtttagcagtggagattataaatagggtggatcctttttgaaaagcaggttaacttacagaggtattaaaacagtagataagctcagatgctaatagaatgcagggatttgctagaaaagccctctgaaatctcggagacttcacagtatcatagctactatttttgggagaatttggtggagttgtcaccattacacaatgactgggatgtttttctcagtggacactgaaccagatctaactttctttgataatcatcctagggctgactttttcctcttctttctatgcttaaccaaagtctcacctggagaggaaagctgtgtgccgtggagatttcaggtcccagctgagccttctggctattggctttgtttttccacatgtaatcttgctttttgtggcctggggattggctgtgtgatcagcattgaaatgggttgttgcagtttgaagtctggaaggggtatgtccctgggttctaattctttccctctaggtttctgtactcagctcagagtctagaatggtagcttttaggattggaaaagaccaaagttacctaattcaactctttcatttttttttcagtggaaaaactaatacccagaaaagggaagagagttaacccaaaaattacatctagtgaattgtctgattagctttacaattgaggcattgtagagctctttgaggcattagtcttggttgtctgagtgcctggctattaaaggctgtctttgcctgttccctctttctgttagctgcctggaagtgcagggttgcttcacttttagcaccttgactctgtacctgacatggtgcttcaacaggatattgctttgttaccacaggccctttgaacttggaaaaaaaaaataccaccctaagctaaaacatttgcctgatgacaaactacaaagattttgaaacctcataatctcaccactaaaggaggcgtaaatgaaaataaatgttggtgatgatttcagtggagtaccagttttactttgggaaatattcttgtatttcaattatcgttttctgtttttagataatgcttttgatagttgttgggtaatcatagttatcctcaggtatctctcctctttgtcacaacctctttgccccgtatgatgagaacaccaagctcttatatatatatcttagcataagacaaccatattctgtattccttttcaaaaaatattttcttgcttttttaaacaattgaatttcacagtccattaaaacattttatagaagcctaaagagagtttgttgtgtataatatctgcatataaacttaaaatatgcagttatctgtacataattttctcaaaaacttgcagtgcgtagctctgattgatgtctatttgtcttttttttctttctcctttcttcctgctttgttcctccacgtcattttgaaaaggaatataggcaggtatcattctacatttattgatgtcatttttaattttttttccattggcatgctatagtatctggaatttttgtgtaccaggtttgatgagcacctttataattaattttaaaaaggtgtgtggaatgtctgtcttcagtgtgtcttcaagcttggtcttatgggtgatagggagggtactgattctggtagtcatggatttaaaattttgttaatatttttgacatcttattaaggagaaagctgccggccttattttaggctccctcatcttctgtttacctttagcctttgttccagtggagaagctacacattatgtttggtctcctcagcctgatgctgtctgagtatctgacctaaaggcttccaagacaaagatggtcccacagggctctcagcagcctggaagaatatcgttgttcagaccagattgaagattgtgttctgcccagagggagtttgttgggccctcatctctaccagatccaaggactgtttctcacagagactcagtaggatgtggaagaagaaggccgtggctccgttggctcagggaacatctgccttttcccctcctgccacctcccctggcagtggagggtgacctgtctctctccttggcacctcatcagagattcttctctcttggacaacaccctccatcctcggaacccttttctttccttatctcgggaaaccttccatattgtacctacttctcattctcttattactgccttcctccgccatcaaacagcatttacccctcctgttggccattctgtcagaacccctctttgaacctctgtagctggttcactccttccttcctgcttgtcccagggagaggatcgtggctaagttctcctgggcacgtgttctgttctacccttgaagagcagtgccaggcctgggtacagcatgagtggcagcctccctgccagctgatagccctagctttccactgtcaccagcggagggtaagggaacagtccagcagcttcagaggcctgacgtggctcatgctgcccgtggctctgcagatgtgtgattctttctgtgtgtgagagagacaccaaagcccacagtcaaattctcagtcactttcgtaaattacaaggaagatgggctgtatagaatcattgaagattataaaaatgttggtttttacctttaaagtaacttctttgtttatcctttccatgttaattgctactccctgagtttattcatcttttgtttatctatcaagcatgtgttcagtagctgttaggtaccaggcactgggattcagtggtgagcaggacagctgcagcctttgcttccgtgcacagctcacggcattgctcgaatgatgccacaggcatctgcttctctctgccgcttccgtttctatcttccatggggcttccctcccaggagagcgtgcctcatatgtgcctggctttcgttctttgctctgcctgctttgcatggtccaggctctgtagcctggcatttaattattctgttccagcttcccttccttggtgctttttcccctcctgccacctcccctggcaatggagggcgacctgtctcctcggcacctcgccagagactgtcatatgtccaaggacaacttatcctttaagcacagtgcctagagcacacacttgttaggggcccataaaatgtctaatttcacttaaaatcagaaaacatagttgagaaatataacttgtaatattttttatggaggaagggaaaagtgtttagggcctatggaagtcacagtgtagtcctgcttgtgatacgtgccccattgtgtgttgctggatagttgctgctggacctgaccggttgctcccagagacaggaactcacagagtacgagaaacatgcctgagagccctccacatctcaggccctaactcagggcctggcttgtcttaggctctgcaaacatagcacagtgacagttgttgaagtgtagcagcagctttttgcagggaaagagggagttgtatttattgcttctccatgacatggttcttttctcattagttcatgggcaagtcaagggaaagagacctaggtagcagctgagtctgtagcctacagatggcctgggctggcttggctcagtcacttcccttagtcacttccacacattccagaaattgtgtttttcttacaggtgacagaggaagttatatatggaaggtagggttaggggcaccaaccccctgtgcaattgacaatccatgcataactttgaccctccaaaacatagctaataataatagcccactgttgactggaagccttaccaataacataaacagactagtaacctgtatatatcttatgtattcatgatgtacctttttctgaaattaaaaaaaaaaaatttctgtgctacacagttcgtcagttttttcaaactgttgcaaatctccaaaaaaattttcaatatacttattgaaaaaaaaatctgtgtatgaatggacttctgtggttcaaacccatgctgttcaagggtcaactgtagtagttaagagaacaggcttttgtagttttaggtcacctagcctcttggaatctcagttttcctcatctgtaaaatgaatgaaaccttccttgtagagttgctgtgaagattaaataacataatatatataaagtgcttgttaactcgtttcatgatgcctgtagtggtgtttgggtagctctcttttaaaatcctattcatcatgtaagatacaccatcagttgaatagcagcaatctgggaagtaggaaacactgccacgtaagctgtatatcttgattgcgtgatgaaactaagttgcaggaatgttaaaatgtcaatcaaattggtcttggattcgaggtagaatgggcttagcagtgtggctgatggtaagcgtgcagggagctgtggtcagcatggagttccagtcagcaggtgtttccctattctggaagcatagtgagaagtcagaggagctgtctttgtgatcttcgggaagtcactttagctccctgagtcatagaggaggtgctgatgggacacttctcacgcagcgctagtaagaaggaaagagatggtgaggggctacaaggggcagggttgtctgcctgcttctcagggcacttcagcctccggcactgaccactgttggtgagccaggacgccctgcccacatctgggtcccctttgccacaattggcattcattttcctgccttccaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcaggtaggaagtttgggcccaggagaagctggagtttgtgggatgggagaggcattgtagagctcagaccccctgctgcagctgaacttggtggtgctagagtgctttaaggcctgttctgggtaagttcttgccacacctggacttgccccaagtgaggagaaaaaaggcagcatttcagctttccaagaggctggttatccagcttgtgggctttggggcttcctttctttcctattcctttccttttccccacctcctaccattttatttttcatccgtattaatagccttatgtgcagaggtcagagggaagctctgcttgttagaagatgtaattcaacagggctgaagaaggcacttctcagcagccgtagtaatgtctggggaggaaggagatggccactctgtcactggtggtaggatagaaagattagacgctagaaaaaaaacaaaagagaaggtagaatcacctgaaattacatttactctgagattgctaagatttttagtagtatgcttcctgattttaacatgcaaatttagatactgtatagattttgaaaatattttatggttcattttgttttgtaaactgcttttttattcatctgattttttttattgtttgtccttcaaatgtcaattaaaatattgatcttcgttgttttaatgactttgtaacaattcatttattcaacaaatattgactggatgtctgcgtactatttgcctcaggcacttgtacctgctaagatgctggagatgctggagtgaacaagacagacatggcctctgcatgcatcagatgtacatcaagttagaaaacaagcaaataaaatgatacatagataatacgtaagaaattatggaaagtactgtgaaagcagaagcttgcaatagagaatatggacaggggggtttgaatgggaagacctaatttaaatcatatgatcagagaaggtctctctaaggaggtaacatttataatgaatcctgaagaataaaaaggaatctgcaattctaagagaggggtgggggactatttcttccatgtagagtgtctcagcagcagcactactgaccttttggcccagatgattctttgctgtgatggcctgccctatgcattgtagggtatttaccagcatccctgcctccacccagtagatgccagtagcactctctccttagcagtgatgaccaaaaatgtcttcaatattgccgactctcctctcagcctcagttgaaaagatctgatgtagagggaacagaatgggggaaggccctgagggccagtagagctgcaaggagagaccatgtggctgcagaccagaggagggtgatggggaacgaggctggagaggcaggtgggggcagattgcatacacagagccttgtaggagctggcaaggggttatgctttaaccctgagtgtggtgggaagccatttggaaggcttcattttatgtatgtttcaagtcgatgattcttgttacacgtggaaagcagattgtgctgggtccaagagtacactcgaaacatacaagctgagagtctgcagcaatgatcctgggagagaaaatgctggtttggcctagtgtagcaacagtggcagtggagcaaaatgagtagatctgctgttcatcttgaagatagaattgataggatttgctgttgagttggatgtggaagctgagagaatttgaggaatcaaagatgatgactgggtttctgttttgggtgatgtcggatggataatggagtcattccccacacagggaaggtcttgggggaagagggtggggaaggggcagaaatcaggagtcctttttcggagatgcctgtgaaacatacaagtggagatttcaagtaggaaattgagtaatgaggctggagtccagaggaaaagccgtcatttatttaacttagtcacccgttcctggacattttctgtttttctcgttttcccttttatgctattactttatagtctgttgtgaacaactgcatacgtaggtggtcctgtacacgttctgtttattattaccttagagtataccattatgtgtgagatcacacacgtatcagtatatctgtgtcagagttatgtcccactgtagggctttagttactaattgtccattatctccattccatctatgccttagaactgccatagagacaacagagaaaggggacagtgcacagccccaggcagatactgtgtggaaaaaaagaaaatgaactggccatttttagatggtctttttggattcagcttcccagttttgtgtatccatagctgagatttattctttacctttcccgggagcagaggtgtaaaggaagagtgtgccatacttgaagaataagcatggcgttagattgaccttttggaggctcaggaataagtgacttgaggtagctgtacagtgaatgtttacaaaaaaaccacaggccaacaggacagtttcaggttttcctttgctcttcacacattactggcatagatcattgttcctcagaagtttttggaatgtcagtgacctttcctcacctgagagaaacaagatatcccatggtgaaaagaagagaaacgggagcagtgggagccctccatccaaaaaccattaatctgaagttcttcagggaaagagagcatctcacatatgcaggaacacttctcccaggctttgtgcctgccctgctccaagctggagaaaggcttaagagttcacactttagtgttctatgtactttaagtcatttgatgaaaaccgaatgtggctgtagcacggcattgaacagtggtcctggccaggtctagatttaatcccagcctaccacttgctaagccctgggcccccagggtactcaattcttctacttgacttggggttttataactgcctgacgttagatactcctagtcatttattcttttctttctccttagagtggaatctccaggagatcaggaacgtggtttagtttattgctgtttccctagcacctagaataacatctagcccataattagttctcaataattaccaaatgaaggagtgactgaataggggctgtttactgttttgtgccttagattcctcatctgttggagatgacgatgttaacatccacgttgtaaggtgttatgaggactaaataaaggagccaagcactgtgtggcagcactgaggcagggtttaatcagtgggagccggcactggaattatcgttttcactctgtacaaagctgggctgggcactgctggttagccttgttttagtttttgtgtttaaagttcccgttagttcttagaatgctgtgcacctccatcagtgggggggtatattttggtgacacatttcactatgggaaactcgaacggtagatgtgggaaaatgtacatgtggtgatgatgcactgcggaacgttcccctttccctagagctacaccagaatggagggagagccccatcaactctgtacacccagctcctagacaaggccatctaagcatgtttgtggaattcatgcatgatcagacctcagcccagtgtcaccttcccttgctctggcgcagtccaggcctagtacacagtgtttgtcagcgtcacttctatggcgaagggacttcgtatgtctgtactgttccccagtgcctggcatagtgctcagtcaatgttttgttaaatgaatgagcgggggagaacatctcctgagccccttcacacccaactctgtttaaaagagctctgatgctagagaaactgccaatctgattcgtctcgttgctgtgctgcgtttctaggcggcccctccctgtgtagtagccttcttgtcaagatcaaaaacgggtgggctctcatggtttctcccccttgctcctagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcaggtaaagcttcccactggctgaagaattgattgtgaggatggtggtgtttctacatgttcttacacatttcagcttaattactgccagggtttggctgacctttgctctctatgaaacccagatcttccttagaatgtttactacatacacgtagcctaattataattgtgtcttgattttggatgttggctgctaatctcagaaatttgtgcttgggtgaaatttctgagctgaggatgccaataaaattagtggcccccaggccttctccgtcccctccttgcccatggtggacactgtcgtctatcactgcattttttccttttgttttggacccatcttaaaaatccttctcagtacagttctgtaagcagctactaccatcccaagcctgaactctgaacacgttacagtagttcactacagagctgttaattctaatgtgagaattgatcaactactattaaatatctcaagaaaattgcatttacttaaaaatatcgtttgagatcaagtctctgtgaaggaatatttaagttctgtccatctatgacatccaatagttttttttcaccagtgggctattaggatggtcataaatgaagacagtctcattttgaagaagggatttcgtagctgcattgtttgtgataggcggcgtgcgtcttctcattaggttgctgcttgtttctccttgcgcttgaccagagtctagagcagatcacagcttgctcctcagtgatgcagggattgagtcgatactgctcaactgctgctttctcttttttctgtggccttcactttgggtacttcctctttattttttcataagctaaattgaaaaatgacagttcttctctaattctgttatattacattaatctaaaagaaaaataacatttgttgaggatgaatcccaaacttcacaattttctactgttctgaagccactccatgcggcagggatgacccggggccaggtgctgtctcagtcctgggagtaacaagcagatcagtctccgcatttggcccccagtggacttgttctttgtttcaggggtactcaacgttcttcttaacattgactcccgttctagcagtatatcagcttgtttagattctgtttgttgtagatagtcgcccactagcacctggataggtaactaatctttcagcttacctgttgatcttttaaataatatatctgattcatattcacatggcaaacactaagtcttttgtattaattagctttagtatgtctttctctctctctctctcactctctctctctctctcttttttgtgggggtgcttggggggacggagttttgctgttgttgcccaggctgaagtacaatggcatgatcttggctcaccgcaactttggcctcccaggttcaagcgattctcctgcctcagcctcctgagtagctgggattacaggcatgtgccaccatacctggctacttttatatttttagtacagatggggtttctccatgttggtcaagctggtctctcactcccgacctcagatgatccgcccgcctcggcctcccaaagtgctgggattacaggcgtgagccaccgcccccagcctttctttctcatttttaaaataaaaaatgtgatctgtttagaaaagttataaatcagacatgcaaatagaacatacaaagcatttctcatcacacaaaatgacaattgctcctaacaccttgcagaccattttctaactgatgctcaatcctagtaacagtgtgtagatgtgagtactaatgtgcacaagaatggtgaagctagcaagcaaaaatgtagatgccctgccttggtgacccagaaaattgggcaatacttgtagcaattcccatttcagtgaaatctgtggagcatgtgctttgcttttctttcccagtttctattcacctgcatctccttatgatggtcatcttcagtgctaactccatctaacgtcctctgggaatagatctccctttcccatttggcaacatgtggattcatggacttagatttgtttctaaactattttctcctaacctgtacatgaaaaggagatgtacttttctactgtcttttagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgtaagtggctgttggcagtcgatcaaagagaacattcccgtgtcacatagcgtatgctgtttatccttctggagtcatctgtctgcatgtccatcactcccataggctgagtttatttaggagaccatgtatcattcatattttatttcatccctgtagcacaaggtctaaataagtatttattgagttatgtagagaaatataacaacatgtataatacgtagtagtataataataatagcagatagttcctgagtgtttaccatgtgccaagtacttttctaagtattttataagtattaactcatttatttctaaaaataaaaaaacctttgagggaagtattgctattatctccattttacggatgaatacaaagaggcacagagaagttaagaaatttgcccaaggtcataactaataagcatttgtgccaagaattgaacttaggcctctggctccgtgaaattgactaattgattttgctttatgggagcttctttatgagatatttattggatgaagaaatagagcagagtggcttaagagcatgggttttagacccacgtcgacggggttcagatcctagcttcatgacttatatggccttaggagagttatttcacctttatcagcagctaaaaattactcatctgttaaatggaggtacctactgtctaactcataaggttgtgaagaaactaaacggcatttagcacaaagcctggcaatacaataaatgttgaataaattattatagccgttacaattattattactgtaattaataatattaaagtaaatgtgggtgggtgcagtggctcacacctgtaaccccagcactttgggaggctgaggcaggcagatcacttgagccgaggagtttgagcctagcctgggcaacatggtgaaaccctatctttacaaaatataccaaaattagcaggatgtggtggcacgtgcctgtggtcctagctacttgggaggctgagttgggaggatcgcctgagcctgggaggtcaaggctacagtgagccatgaccttgccactgtgctccagcctgggtgacagcaagacactgtctcaaaaaattaaataaatgaataaaatatgagactcattttctcctcctgttttattctcatgctaaaacaataatgcttgatacttactgagggttttctgtataataggtattatactatgttagttagcacttgtctaatctcagagaaccctgtgaagatgtaagctatttcatgaataaggaaaatgaggctcaaagagatgatgtaactagttaagtaattggcagaggcaggaacttaacctagatctctggtctccagggctcatgcgacacaaaatattttcacttgtgcagatatatattattcagtgtgtagattatttcaagcatgaaattcgtgtcttctctggaaaatcccgacttgagtactgttacaaagtcaagacgattggtgataggagaaagctcatgttcagctcagtggtaactgggaagagtatgttatctgtttgtgtcagagcatgtgtagtagtctggaagtgaggagacctgaatgtagatgcatgtctagtgagcagtgatttccctttctgagtttccgtgcacattgcgtattatatagtttagacagtgtgctcattaaggtctcttccagatatgaaagcccaggattccctgatacaacccagttctttggtcctaaccctgcaggtgccaactcccccaatcctgcaagtccagaagagctggctttctcttccttggacctaggccctgcataggtttcccagcagcactgaccttttaccaatagaaaatgaagaaagcaacttaaccctgtcccttttatgtatcttatcaggttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggtaagtttgtcccagaagctcttaagtctggatctggtgatgagagggagaattgctgagttccgttctgcagcacatgattttcagagttcctgtcctaaagagaaaacaggattttcttattgaagccaaaaagttcctattaccaaggcattctcagtgttttaaagttacaccgatacattccagtgcctttctttggtctcagaaatgtgaatctgccttaggatttgcttccctcccaaatacacctcagcatcaatatttaattcacaaagctagtggatttgaaggaaaagaaaaccagcgaatgtcagtgtttcctcccaagggttctggcacggcctctctgctgagctgaagtgcaaagcaggaagccccacgttgccctcaggcgagcctcggccacagtggcagtcatcgatatggtgtcaggcacaccccagtgactctcggacagaggaaagggtgtttaatctcacttcctcttttttggtatcacttgaggacataatctaaacaagcaggaagtgggaactctgccaaaataaacctgtttgtgtcaggggaagtcacagccaacaacatgcagagagagcggctggtgagacagctagcactcttaaggtgagtggagccaacaccaggaaaggccacattctgccaaaatgtggcagatactgtgtcacaatgataacgctcagtgctgaggaagagcctggtgatacggtttagggcagacagtcactctcttgtattcagaataacttgtctttctgatataaccttttggaaaacagtttggtaacctgttaaaagccttgaaaatatttatatatccctctgttcaggaatctagagaatgaatctatcttccagaaacaatgtgagaggcaggttatggtttatgaataagaatattcattccagtagtaattaaagtgtcaaaattctgaaaataacttaaatatacaataataggagaataggaaaataaatcacaatttgcctgagaagcagaatattagaaaatcaggttgctgaattttttaatgacctggaaaaaaggtcaggggaaaaagcaggatataaaactttacctatagaatgggaccagttttgttcaaaatatcaataggtatgcatgtatatacacatgctcttagaaaaataaatattaacagctacttatttatggtggcattatgagtggttttaattttcttattctcccctccttttttttaaacaaaaaacttacattaattttattagaaaaatatagtaaaaacaaagtgaagggggagaagtagaagagctcagatggatgttaatggaaagatgcgaaatggagggagaaaagaagaaatgctgttgatggagcacatcctggatatcaggccccgtgttatatgctgcatcctggatattaggccccgtgtcatatgctgcatcctggatattaggccccgtgttatatgctgcatcctggatattaggccccgtgtcatatgctgcatcctggattttaggccccgtgtcatatgctgcatcctggatattaggccccctgtcatatgctgcatcctggatattaggccccgtgtcatatgctgcatcctggatattaggccccgtgttatatgctgcatcctgggtattaggccccgtgttatatgctgcatcgtgggtattaggccctgtgttatatgctgcatcctgggtattaggccccctgttatatgctgcatcctggatattaggccccgtgtcacatgctgcatcctggatattaggccccgtgttatatgctgtgcctgtatcttggtctgtcttagtccttgtaagaaccttaggggactgagcatcagctctacttgaaatgaggaatctgagactaatcaagaggcatgggatcttgcacagggtcactcagtgagaaagtggcaggcacttgcccagctctgtctggttcctgcctgtgcattttgcctgtgttgctttggcttctaaggcgttatcatcccccagagaccccgaagggagtgagggagaggctgacatgtccatgatctggctcttcaacgtggtgtatgcctggtgcacattttatgagcctgccccatcctgtcctgtcctggttgacacagtcaagtctagcaccaacacaagttggtgcacccatcatctaagtcagagctcaccctggccacatgggccaatgactctatgccaagccacagtgctgtggagggagcaggaggagggcaggaagaaagaaatacttgattcctccattagtttgtttttctttaccacgctagcccttactgtgtgtcaggtacttcctattctgagcacttcacaaataccacctattttaattttcatgtcaaccctatgggtgagtatgataaggggaaactgaggcacgaagaggttaagtaacctgtccaaggtcacagagctgttaggttaaagcatttgaaattgccaatatttgaccattttgacctataaaaatgatgattccatatgcataaccctactagcaggtggagaggctgcgatttgaacccagagcagctggctctagagcctgagctgagggttgaccactgctccatgctgccagtttagaatctcatgccctcgttgtcccctcccagccatgggattcccaagccctttaatcaggcagtgctttgaagaaaccctgataccagcatgttgtcaagtcagaccttcatgtatcacttctctctacatctccttggcatccctcatttctgtttagactcctgttctcaggaaatgtaagtgcagatgtggtcttacttatcatgtggctgggtgaggggctgcccaggccagcctgccccttgttcagagcatcttgaatttgctcttcagggatatccgcaggtgggtgcctggtcacacccgcaaggcagtgtgctcagtgtggtttcttttttctgaagtgccattcctatggtgaccctgccctctccaggcctccttcctcatagccccaggcatgcttccttcggcattacagctgcactaggcccctgacctccctcctgccgagtggcttgtctcccctgctcctttttcccttcactgtcctctcatttctgccacctgcctctcctttctacagggctatgaaagagtcattttgcccttttttgaagcctcagatgctttttaatgtttttttgtgagtcaaagctccaaatcatggcttttgcataccttcccttgccaggaaatgttcttgattgacctgatagttcctgtcaaatgggcagtctcttcagggatcaatgatcaggacaaaagtaccccaaatctacaacacaggtgtctttcagaacaccttccttgatggaaatcccctccctcctcttctccacaggtgcctttgcctcttcccactctgagtaagacactctgctctctccaactctcagagctccctaggcttaatctagcaaactcttcactgggcctgggattattcctagattaaaatccgggagtttcaccttctagagcaagtctgctatgagatgaaccacactgcctctgtttcttttctcctaagcaggaataatgccgatttagccattcaccgttgagtgccaagatcacggtgcatgctttgccccttcccacctccacttttgtgcctctgccaccttgattcaggcttcctcttctcccatctggacccaggggacagcttctctgcatgtctccctgcctgccacagcctcccccaccgcgtcacccccaacacacacacacatacacacacacacacacacacacacacacacacacacacggacccaggggacagcttctctgcatgtctccctgcctgccacagcctcccccaccgcgtcacccccaacacacacacacacacacacacacacacacacacacagagtcatctgatagtttgagataatagatgggaaaatgtgttgaacagtgaaagtcctatataaatgcaagggggatcgggcacagtggctcacggctgtaatcccagcactttgggaggccaaggtgggagatcactcgaggtcaggagttcaagaccagcctggccaacatggtgaaaccccgtatctactaaaaatacaaaaattagccaggtgtgatggcaggtgcctgtaatcccagctacttgggaggctgaggcagaagaatcgcttggacccaggaggcggaggttgcagtgagccgagatctcaccactgcactccagcctgggcgacagagtgaaactccatctcaaataaataaataaataaataaataaataaataaataaataaataaataaatgcatgcaaggggtatatttagtattgatgaaaaggttttccctttggggttcccattgggttataaaaatcttctcactgtgcacctccctacagagtcagccacttaagctgatagagacatgatgtaaccatgggaatttcttctctctcaacaggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctggttggtcctagaaccttatcagttgcctttggtgtgcagagagcccgtgttttagtgatggggcatgtcatcattgtttaggtcaggccagttgaccatgctgcctggtacttgttggctgtcctcctttcctccctgctgtccaagctctggtcaggccttcctgtaatctcctaccatcctctttgcagcagcccctcaatgctgcttctttacttggatctctcttcatagtttaaccccctcacctctccatagctgatcaagaagtactacactttctgatttcttgctgtgtcaaacaatgtgggcaattcaagaaacactgaacacagctgagcgtgctgccatgtgcctgtagtttcagctccttgagaggctgaggtgggaggatcacttgagcccaggagttcaattctagcctgggcaacatagcaatatcccatctctaaaatatataaaagaagaaaaagaaagatcagatgatgatctcagcatcagacagtgtaataaatggaattgtcagtcagcttgtcccaaggtgccaggtgaacagtggggaccgtgagggtaatacagccttaaggccagaaggggctgtgtgggatgccttgtcccacctgcatctcagaactggcagcctgtgctgaagtacctctggtgatgggcaatgtgtgaggcagcccatggattggagctctgactgtgagagatgtgcatacctttctgatatggagctgtagttggcttctctgtaacttctgcctactcacttgaattctgccttttgagacaacagggattcttttgactttctcttacatatgacagcccttcaggcaaaggaaaacagccagctgctgtgtttcttctgagcctctcttttcagaccacagaatatctggggaagcatctcttctgccacctttcacatgatgtgcttctcaccttcttccctcttccggctgccttgtggacaggtagcttagtagtcacatggccctggccttgagaggctcacagactcatagggaaacagacacacaaagaatggcagagcaaggggttgagcatttgaaaagcgtcttctgccaatgtcccagccatggttgtgcttcagggcccaggcactcgctcttcccttggcccagaatgcccttcctccagaatctgcacagcctccacttccttcaggtgctagtcagatatcaccttatccgtgaagtcttccttgaccaccttatatacaatcatacctctttcccttctccatcccatacatgttggccactgcactctaccttattttccttcagtggcagttgttacctcctgagatactatgtttatttacataacataacatttgttcctggtctgactaccctcacctcccagaatatgagcttcccaaaggctggggctgcattgctcactgctttcttagcacacacagggtctgacacattgtaggccctcagtgagtatttgttgaatgaatggatatttcatgtttgatgggatgctgacattccttgcctaaagagcctgctcagagtaggtggcattcaaatctgattaaaccaaagaatcaatgatggcttgccaggccttaaagcacggaaagggtacctagatgagaggtcagcacatgcaaaggcatggcgcagttagaaagtacacaatgtccctgtctctctaaaacacacgaaccatggcggccctctctcaccagcacttagcaagcagcactcacctcatgcagggatgtattcagtcagtattcactgctctctacatgccaggactcactggtcctggggatacaaagaaatgtaagacaggcctgttcctactaacatctgtccagtcctcactgatgtattctctcagtgtgagcccatggtgatacaacaataaacaacatggcctccagttcccacccccatgaggtttgtgcttccactgggctggctaggggtggaggggaggcgtggcagatgctcatcaccagcctccagagaggctcttctgtcttgagctggagatgatgtctgtagggaatgcggggacaagcagggctcattgccttgggcaggagtctgagtcctcttctcaaccttggagactccatcggtcctgaggccactcggtatttccgctacgctcatggatggcatcagaggggactttaggatcccaggcagggcagatagtgtgatggggctgttaagacttgaggcagctcaggagagtggatagcccagaggttcaaagtcctgtttggtgtgagctctttctccctttgcctacttctccctctagtacagaatacgccatcaataaattgcggcaagaaggaagcgaggaggggatgtacgtgctgaggtggagctgcaccgactttgacaacatcctcatgaccgtcacctgctttgagaagtctgaggtcagtcaggacactggcttggaccaggccatacagccatgaggtgtccagtgtagcctggttcaggagctgctgcagacagaaccacccttggcagggtggaactgaaaagcctgggtctctgagaagatccctgggaggtcaggcaagggcccctgctctcaaaaggagactgctccccagtagccagacccctgcatcctccccctgtagggcccttcttccttcatgggacccatggtgggggtccaccatggctctggaagacagaacatgaccagaaaaccaattcacacccaacacttggaaagtatagtgtcattatttagagtggtttatttagactcagtgccaccatcatctcagacccagagctatgcctgtctacagcattcactggtacaaaccagcgcccaaatgccacttcatccacatggcctaacacagttttttccaaatggtagcttcagacactttaacaaattgccaccccatcttagaacaatgaatagagatgtcttttagtgattgaagcgtagctgaagctggggatgatgtgagatacattctgagggctaagatattcaccagaattactgactttgcctcactagaccacaaatgcctttgttattcatgtaattaaaaaaactacaaagtggaatattttcaaagacagtgagttttacaaaacactttacatcagtacactttaatcagtactggttaggctccacatgcatggggagacctgggacacggaggggcctttggcacggagggtagacgcaggaaggacaagcttattggcgaacccctggggctggactcagtcaagagtgggaggaggaaacggcagaaggaaccagcgctgccaagtgtcctgggtgatgcaatgcaggaacaccaccacctgcccaggctcttgctgaacagctgggcctcggggctccgtggctcagagcctgtcaggttcattgccttcccagaatgcttgccgtctattcatcagtcattggaggaagtttaatgtgtttacgatggaggggtgcatgagacagcccagcctcctcctgaagtggaattggcctgtgcagtaccaagagtgtccgtgactccctaacaatgtcacatcacccggggaaaacagcagtcatagaaatgattacttccaccgcacactgtggcccaccagaccctgtgccaagcgttgtacctacttgtgcttttttaagccttgtaatagccatattaggtaggtgatattatcccattgtacagatgaagtaactgagattttgaatatcatctcctagtttacagcttatgtaagtctttctggccctcattgtttaccactaaaatagtttagtttgtacaaaaagagcccatgagggaaaactgcttatacctcctatctggcaccacagtgtcccaaacctgggtcagacactgaacaccagctcccagtgtggttttcctcaagtggagacatggcctggaagggctcagtttgaggctgttccttgagaagttgtgccatcataattattacctcatatataatatctgctggactttataaagggcttactaagtttttcaatacaccatgttagataattgtagcaacaatcctatgaggttggattttcatgaactttatcttacaggtgaaaaaccaagtgacgcttttgtagaaatagctactgtgtctgctgtagtattaactcccttttatcaatgccttctcctggaccttgttttattatttagttagttgttggttggattatttattgataataaactttatttttgaataattttagatttacagaaatgttacagagatggtgcaaaattactcttcatgcagcttcccctaatgttaatatcttacatacccatgcctgaccccattttaaacatgtaatttctggtcatttcccgaatagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgaggttcgtctccctgtgccagagccaggctgtatcccatcagtaatgtgctgagacccagatcgaccaaaacacgctgactgacttaaacaaagtggaccctccccacagtttctaggtgttttttattgagtttaattacacttctgtgcccaactcacatccaatcccttgagtgtgagcattttctgtagaagaggcatatacctttctcagcatctcattaggctgcagaaagaggcatgctcagcattagtaagcagaaaatcacttctttcttccttaagataaaatgccttgaggagtctcctgtcactggtttatttatctgagagatattcctggcacatcttttgtgggccaagaactatatcagatgcaaagaatcagaaatgcataaggtccagtccctgctctctgggggtttcccagcctaatgctgatgttacaggtaaatgaggccactgcagtttgtgatgggtgttttaactaacatagatatcataccctggagtcaaacagaaagggatggtcaaaatccctgagttccgtggcacagggggctgcctggaggaggcagctcttgaactgagtgtgggaggatgagtgggaggttgccagtgcggtcagggcatctcggcacgtgcaaacagaggcatgggcgggggctgccatgaaggtgaaggtggaaggaaggtgaaggtggaagggaggggcaggtgaggctgagcttagggtgtgggggccttgagtgctatgccatggagctgggtctttatcctgcaggctgtaggggccagggaggatcagggagtgaaatggatccaagggggagccactcagctgtttcttgttaagcctcttgaatggcgtcactgatgttctgcaggtggatttgtctcttagaatgtgaggactggaaagacacgtagaggtcacacagtcaactgtctcattttatagatgagaaaattgaggcccagaagagcgaagtgggtctcatcaaaggtcagcgtcaaagaggggcttgagtgccaggcctaacctgagtgccctagctcttgagaacggtttattttgctgctcctcacctcaagatgctgcccttcatgcgtcaggttcttcccttagaaggaggaaggcctcaaagaaggagcagcacgattgccactgaggccccatgagtgtcagaggaagaccctctgaggagtctttatctgggacacatcttgttcttccaagcgaacgtgtccataaaccctcacaccaccaggagtgggcagaggaagcagcaccaggatagaaagggacctgggttcttgatgtttgaatcagtttttggtctcagcaaggggcttgtcactgaacttggtgaaagaggagggacttgtgttcttgatcagataggggttcctgccaggctcagagaataactgcagcctttgttttcatgcttgaggattttccgcaaaggtaaaaacacatctgccacttggctgtgagacctcagagtaagttcaaaccttaaagcccaacagccctatttattcacagcaacacactggaacgaaccccagttgaggctcctgaaactcagtgctgaatgtgtttcctgttgcctttcccacctgactgtgaactcttaagacaggacctgagtctcactcaccactctatgggctcgtggggaggacagtgcccagcacggagtcagcgtgaataatgcctgtcaagtgaaccaggtagcaggagctgctggatggtgggtgcctactgtggcccagtcagtttatgtacctacctcatttatttcatctacacagtagctttttgtagatattacaaaggtgatgaaattgagacttgagatggtaagtgacttgctcaaggccatgtagctagtagtatcggtagtaggtagaacagtagtaataattaataagaacggctgctatcatgtgagcagggcttacagtttgccaggcgttgtttggagatctttcatgttttaagtcatttagtcctcaaaataacccagaatatgttgttatcccaattatacatgcccaagatcacttaggtagaggatgagtggggatttgaactcacgttgtctgactccaagtccagtgattccttctgtaccactgcccccaccctgcccaggtcacactgtctttggaaaggtgcagccatcagcctaggactttagagcaggcaccaattctcctgaccttgggagagtaagaataaggcctgtgtgtgaggcctccttacataggtcccccaaagctctctctcttccctttgccatgtgcaaattagagaagtggggaaatcgtgaaaattagacatgagaatattgtgttgggttcttcagctcctctgctctcctaaccacggggttttgatagccagaccctgatctgggtttctcacttgaaaatgcaactaagaaactcttcatgggataaataaaaagcaaagtgaaaaagcaggaggccattcagagtgggcgtgacggctcagcaggtcccacatctctagtcctgtgtcctgtgtccagctccactacccatctcccactccagaaccctgatgatacaggaaggatgatgacagtgactaagatgtaatgccagtcataatcacggcggcaaccagtcagggagcgttttactacataccgggcactgaaggcagccgttcccttgcgtcatcccattcttccacacggtaacctatgaaggacacaactgtggcccccatttttctagtgaggaaacaccttcatggaggcactgtggcttcccccattcacattgttaaccctggtgccatgttccctgaagtgcccatgcaaagaatagtccataaatggcttcggttccatccgcctctcatttcccaagtggctctgctgcctggcctcttgcctgtggacaccagccacggggccccttcttgatgccttttctcctgagttgagttgagcctgagttgcctctgaatcggattttccccaggtaacagagtggagtcaggaaaatggtatggagggagcagcctctggaaaaagagtgcccaggttgtgagaacaaggggagcctctccctgagccctgtttctggcacccacatttgttctcccgattagggccaggtatgttgtgggaagggtagagacgagagcatctctgacttcagtgtgaatcctaagattacgaactgcctggccttgggccaattacttaatctctcagaatctctgttttctcatctataaaatggggataagaatactgtgtattccacaggattgtcataaggacaaaggagttaatgtgtataatgctcatagaacaccggctggcatggagaaaacagtcggaatatgtgagcttaaaaaattagaaaggaaaagaatgccctgtcctgagggatagcagggattagagacgtggccctgtgcagggacccggcgctcagcagccattgtctcccagcggtgtgtgtggtggcctccatgggttgtgcctggctgttctacagatgttcttttaggaacttccttctgttacagtccaggaatcaggactggaatggctacattttctcccctaacttgttattgtcttctagtgcaggaaagaggaagtgaagggaaatgcatgttcgttgtcattttgctaatattcctgcttcagttaataaaattgatgaaaacatacaagtcttcagagattcccagaatactttccctgctagtcagaatctggaaggtcctttcttgccttatgataacctcgttccttgcagtagctccatagcgggaaaggtgatttctatggattgtagatttcctggcctcgaggattttgtaatgtgttgggtttgctgtttgaatcagtagaatctgggggatagtctacttaaacctgcatattgagggggcatttggtaagcgcctctccatgtcaggcactgctggtaccacgagcttcagacagggcactgttatgggtctcctgccctgatcttctggctcaaaaccagcgtttgttcacctcctcctctggttcccatcatgccctgggcccgggtactgcttcttccttccatagctctcatcctttagaaagacgccagtcattcattcactcatttaacaaataataattgagtgcctactatgtaccgggctgtggaggtggagaagaaaataagatagacagtctctgacttctttcagtttccagtcttacattttaaattttaatttcattagggaaactgtttctgacctttcttaccagaacagatcttgccatgccaaccttggagcaccacacacctgttctttagaggagctgaacaaattgtagctttccatttaattgtttatttgggagttttggctctgtcgttaccctctgagctcctggagggtaggagccatatgcctattgaataagcacttgtcgaatgactgaagcagcaagcgcccgcacaccggtcccatggccccggctcagcagacgttggctgtctgagagctcggatcttgggtgctgtgctcagactcccccaatctcttccacagaaatctccaacctgctggtggctactaagaaagcccaggagtggcagcccgtctaccccatgagccagctgagtttcgatcggatcctcaagaaggatctggtgcaggtgagtcacggctgcagggtgtgggccagctgtggtcctgcctccccacgatggagcagcttggggatctgggggaaggaaggctgtgtttggggaaatcttagtagaaaaagaacagggagactttcctttgatggcaaaagccgtacaaccattgcctccatcctcttcacccttgctgatgctcctcagagacatgttttgaggtaagtggtttggtcaggctttgtggggttacctagaacagcagggaccttctgtggtgagctgaaggggtggcagggcaggaggtggctctccacaggggagcatggccatcacacctcgctgcctgcagcaggctgtgtgatggagcacctccagagttcagtcctgcactttctgatgatgcttccagaaggagcagagctcaggaggagagaacacagggagggaacaagaggacatgcacactctgggcctgaaggagaactatcttgagaaacagatcccagtctttggaggcctttttgcccagaatctacaggctgagcggggagcccaggatctccccaggggctgccctggagctgttgctggtggtgtgaggcccagggaaagcccactttctgttctgccgccgctccccagccctgttgcatagggccacgcgttggggtatcagggagatggtgcggcagccttggagagaagcaagcacggggccactcaccacctcgggagatggcagcgccttggaggtgttggagggtgaggcggaagctgcctgctgtgaaggagcctggggagagtggcactcgggggtttgttactttacctttttcagtgagtccccgagattgttggatggggcttgagggagtggaaatccacagctaaactgcctcacttccctcgtggtacatttcttcaccaaaggcccatcattgttctctattcctctcgtggtgtgagagctgtgtcctgagattacagtcaccagagccacagtttcatagcctcttttctgtgtagaacttgacatagtctgtggggcctgcctcttttcccttgcctcgagcctccaagcaggtaaccaccatcctccatgccttccacatccacttagccaacagagatcaagcattacacgtgcgaggcacgattgctgcttcagcaggctcctgtctattttgagggggtaatcacattagcaagagtcaagttccaaagtagggaagtacagcaggatgtggacctaatcttgagaggacggagatagcttcctgggggaagcggtatcaaagcagagtcccagaccaggcacagcggctcacacagtggctcacacctgtcgtcccagcgctttgagaggccaaggcgggaggatcgcttgagcctaggagttcaagaccagcctgggcaacacaatgagatcccatctctactaaaaatacaaatgaaaaaatgagctgcgtgtagtggtaagcagctgtagtcccagctactcaggaggctgagttggaaggattgcataaggccaggagtttgaggttgcagtgagctatgattgtgctgctgcactcccgccaggtgttagagcgagaccctgtctggggaaaaaaaaaaatcagggtctcctcctggaggatgaactcaagtagctaggcaaggtggagggaacagcatcagaggaggatgaagtgggccatatgggcctttgtgggtccctgcagaatcctgacagcatggtgtcatgacttggccacgggaagagcaattattctgaaagcatatggcttttacgggatgttctgggaatacagcttcccataaccttgatggatcacttcatgacagatgcagctttaatgaatagccaaagaccttgccaggatacagcagacagggtggatgcatcgccattcggctctgacagataacaaatggtggcatttgtgcaaattaatatacctgattaacaatggtgtatgttcctatgggggataagactgattccctaggtatcagcgacagtcccttttctgcatttccagggggtcctcaaataatagaataatggatcttcagtttacaagttttgtggtgctaatgtcaacaacttgacattgcctaagtttcgtgaatcccatttcgatttccaaatattaagaattttaaaagcagaattattgcaacttgaactggaagggtcctcagaaatagatcatggtatggctagggctttgcacggatcatctcattcagtcctcctgccactcatctgggggtattgttccctttcacatgtcaggaaatccaggacacatcaccccaggctccaccttcatcttcacattgccatctcctctgtgaggttgccagggcaaatgcaggtgtactttgcaccactaattttaaatcctaacgtgcatgcacacacatgagcacacacactggataaatggatgggaaacagatggttccagtgtgagaaactgtgcctacctgtgccagagggcttcagataacacatggatccaccagatgggtttctacgcacccccccgtgtgcctgagtctgtaccaggagcctccatccctgtttcctggtttgattcttaccacagccctatgaggtcagtaccattattacctccatttgcagaaagtgggcagagattgcccccatgtcacatggccagcgggtagtagagctgggatttgcaagcctcttcacagggtagcacagcctgtgagtagaggagctgcctgggggctcctctcttgagtcttctctggaggcctggggtgggacccatgtggctggctgttgatggccctgtttgcagtgtcctgacatgttaggactgtgttttggccaaaggctgttcctaggggtagaaagcaaggagccgtttagggagtaggaggactgtctcctggggcccagcaaatgtcaccactgtgtttggccaaatagcttgttgttttctctggaggcctggggaccacgagctggggcagggagccctcttgcctttgccccatcccattgatagtccatgttcccattgaggacccattcccagacggtccatcacttcagggcacagagaggtcacccagccttctgcttcttccctcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggcaagtgtcttcctctgaactcctcccctcccctctcccgtttctggagccagtggaacacaatgggttgagaagaacccttgcccttcttgtggcccagtggttttcaaacttgccttttactcagaatttttttctccacatatgatcttagtggaccctgcatgtagagtaagtgaggtgggttgaacagctcctcacactcagcctgtgccctcccttccacccccaacccccacctttcctaaggacaggtccaggtggccgtgctgtggagccctaggactctggccaaatggttcaaagttcctgatacagtccatggctctcaccacacagtctggaaaacgaaagcccagaggagtaaaaggactcacccaggattctacagactattagagtgacacagtcaaatcttgagcagagatcggctgccttcatttcccctttgttccagcatagtgctaaatatgggtatttcccagagctgaaaggaagagagagaggtgggcatgagtatccagtgggaaaattcttagccagcttctcccaccagccctgctctgcatcctgttaggttttctaaataaacctcacatccctgccaggttggcccagagaacaaggcttggcagtgcctctggacagccaaggccagaggattgatgttcagggcctggggtggcgacagtggtgagctttcctgggtccactggctttcccctcaacagagcccctggggagcagccccctggaggctggcctgagacattcctatgtcctgctcgcccacaggccttcttcgaggcagccagcatgatgagacaggtctcccacaaacacatcgtgtacctctatggcgtctgtgtccgcgacgtggagagtaagtgtgttctctttcaaaggggtgggtggcctggctggggagcttgggtgctgtggagatggtggaggctcttcccaccctcacgttgcccaggcttcttgcctttctttttgcagttgaggagattgagggactgagcaggtcatttgcttaagttaatagtggaggtggaactaaaaccaattgcttttcattcatttgtgtaatgttttcttgtcaacgctggccaagaaccctacactgtgctagacctgggaggctgaggtgagtgaaatgaggtcaaggccacaagagtcaggcccaaggagctctgggcaggtgagcgaggtgagcgcaccccacaagcagcaagacgctggctcctcgaatggactggcttccattttaaccacaggcaggcttggccctttcttggttgtcaagccactgagccggtgggcccttgggctgctgctgcacactgagatggaggggtggccttggcctctgagttcctgacatgtaagtttggaagaagagcgattttttttttaaccccaagtgacttcttccctgtggaatccaacaatgtgagctgttccgtgtactcacacaggagtcctgttgagagggaagttttgccgtgtgagcggcctgacctctgcatcacagtgtgttgtagaacagcagcagtggtggcggttgttcccagagcccttgttctctgtgtcaggccctccgccaaggctttccaggccttgtgacatttagccgccatctgttattacagatgagggaattgaggctcagagaagtgtcacttgctcagtgccaccgtttagaagaagagcttggggttgaacttggcctttccagctctgaagcccctgcaccattgcaccccccaaggatatctgtgtactctgaggccgagtagtgtccactgaagtggactgtcgtaaggggatgaaggagaggaccgtgccacagaccaggttccagacatggctatttttatgcctacagatatcatggtggaagagtttgtggaagggggtcctctggatctcttcatgcaccggaaaagcgatgtccttaccacaccatggaaattcaaagttgccaaacagctggccagtgccctgagctacttggtgagaatgtcctgatgtccataatggtcccaccagaaaccagagtgtcctgggaggggtggcaggaaggaggtgctagccaagcagctagaggggcctgtccttgggttccatggggccagggctctgtggttgaacaaaggtgtgcctggtgcttactgaagatggtcgtttggggccgttccctgtgctcacatgagttctgtttagtgggaaatgttagcacgtcagagggccgacttgcatactgcagcatatggatggcaaggctgaaagcagtgcagtacgtgttgagtgaatgagtgaactgccagcatctagtagctgacgtgtggagtgctcaccatgggtcagctgttcaggcgtttcacagattctaatcagtatcatgctcacgaagcccaatgagatacgtgccactatttagccacattcagtgatgagggagctggagccaaggggcacctgtgatgtgcctaagtcacacagatgattggcagcagggccaggctgtccagatctggctgtagctgggggtaggaagagatgacctgagggaccagggttggaaatagaatgcgggaaggagcagcttggctaaacttgacctttttactctgcaggaggataaagacctggtccatggaaatgtgtgtactaaaaacctcctcctggcccgtgagggcatcgacagtgagtgtggcccattcatcaagctcagtgaccccggcatccccattacggtgctgtctaggcaaggtgtgtctcccctctcttccctctggccccaccccgagtcaggggcaagtcagcagagagaagggctgggctggggttggtctccttttagagagtcattttttttttgtattttagtagagacggggtttcaccatgttggccaggatggtcttctcttaagtccttgaacgagcccccgttcgtcctcctgccctgggtgatggcccccaccctgggatgttttgctgatcctaaggccagggcttcagaagcctggcttcacacgaccctcctggggagcttggaggcagggacccatctgctggctgtgacccagactgatgtatcagaagtgctggtggtggcttggagggctgcacgcctgcaggccccccgcacagggcctatgtggccatgggccatgtttgggcacactgcttgaagtagttccttcattggctcactgttctggctgcagtgacagtaattgaatccctaggagatcccagaaactgctccatcagtgtgtctgttgtcttccagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgaggtgagcaggtgtttcccggggcgtgaggcaagtgagggctttcaggtgctcgtgggcttcccaggagttgtcggaagcctggcactgtgggaagagatgggcatgggtttgaatctcttcacgggcctactgggtgtgtgacctcacaaatgtaactgaacttccgtgagcctcagtttcatcatctataaaatggggataatcagtaactacttgtagggttgttgtgaagattaaataatgcatatagagtgacaggcatgcagtacaagctcgatagatgttatagtattatttatctgagattttaagtgcctgttattcagcattaccacacaaatacatatggagttcctattgtgtatcaagcatcaagcttgggaaaagctggaggttcactataaaataagatacaggccttgccttcccttgagggccttagggtatggtagggagttaggctaaaataacaacggtaagaattccagaaagaatacctgaaagtgtcaccctaagagccctgcaaattaggtaggatggtgtcattaccctcatttgacagatcaggtaactgagactcaggtagccccacttacctgggttcctcagctagaatgcaaaacaggcgaggtgtggacctcctccaaatctacctgtggaaaaagtggagactctaactccaaaggggtaaagtagtaaaaatcacaatgaaagaccattgtcccttcatctcagtgactgcaattggaatgtgctcctgttgtttagagggggcaggcatcagtttcggctgtgagagcctggtttcagtgctgtgtcgggagcctgggtagtttggtgtgcctggccttgagtgtctggagtggggaaaggaataacagtgatcaggtgggaaaggccatttgggttcagatttttaaagtccctgattccaggctgcagaacctacattttactgggggtggcatgggacaaggaaggatttgggtggaggagggaggggcttggaggtcggccttgggatgttcttctggatgcagtagctgggatggacagaggagagacctggagggagacaggggccccgagtctctcagcaatgggagccccatgtccggaaatggcagcggaagtccagagtgcagggtgggagatattgaagaggtagaacctttatgacttgccagttaatgatggtgcaggacttgggaaaggatcttaaacccgcagggaaaccatcagatctacagatctgctatttggaattttcagcctaggcttttgggaaattcatatttatttttaacttccttggatccttggaaatgaaacaacataccctttgtcatcagtcagtatttattgagcacgtgctgcgtaccctgggctgaacagcatacagggtggtgtaaggaaggacccgtgtctttaataaaataggggtctctctccacctaagtccccttgggttagatggcttttctgcaggctgcactgacgcagggatgtgtgagtgacactcaaggacaagagcaattctcagctccttaattccagtcctccctcctccctgtcctctggggcctgcccaccccaccccaccccagggcccacggggaccagagaggaacttagtacccttggagtccagctatgaagtagaaactggaatgcagtggtttcacttcatcttccaaaagtagcataagttcttgtttctaaaatttaaagtaataaacagttgaagaacatttttaaaatgaaactattaaaaaaagaaaatagcaatcactgcattcttgtcatccctgaccactgttaacactttggcattttgtcttccagcctgtttgtatctctcttttttaaacaaaattggggccatgctagatagagttatataaaattctgagttttttcatttaatactgagaatgctttcctgtgagattaaatcataatttttacaaatttaatgtaagagttaattgttttgtttaatttacttgactaattttatatttggcatttaagttttcaaatttccagtgttctgtctaattctgcaggaaacatccttgtacataaatatttgttcatatctgatttatttctgagtcattcagtcattgaagttaatgcatcagagggtttgaagaatctgaagatttttgtacatgttgcccaattgtattccagaaaggctgcatgcctttacttgaatgaagctttttgggactgggctatagtgcccagtctccttgaatttggactattcagtattaggactgtgatttccccttgcaagaataaggcagcagtaacaaacacttatgaaatctacctgtaagtggagatgttgagaatcgaatgaggaattggcaattccacctgacctggggctgagaagtttgtaggtggttcctttggtttcttccatgtgcccctcttgtttacagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagagtaagacctgccatgtgctgctttaacccagcttggggagaaacaggagcctgggtggcaatccctggcaatcgactgcctttcactctgttttcttttctcttctgttagatccagatattgtttcagaaaaaaaaccagcaactgaagtggaccccacacattttgaaaagcgcttcctaaagaggatccgtgacttgggagaggtaagttacacccgtgctgcttgctgctgatggcagagccctccgccatccacagcgccactctctgcacgtacagctgctctccattctttttcattctggggccaggtccatgagcgaaagcaccttactgcatttgggggccactttcatcacaagggattgtgtctttctccatgtgacacacggcacggacggaatgcacgtccctgcctgcatgcacgactgtgtatgcacacgggactctgggcagctcccttgagagacttgagttttctctacaggacagaagagaatggaaagagggagagatgggggagtaggtatagatatggtggaataggaaaatccttgcctctgactttcccgggcatatatatcctgtaagcttctctctttttcttttgcccccgagagacagggtctcgctctgtgtcccaggctggagtgagtggtgtgatcatagctcactgcagcctcaacttcccaggctcaagcaatcttcctgcctcagcctcctgagtagctggaactacaggcacacgcccccatgctggctaatattttttattttttattgtagaaatggggtcttgctatgttgactaggctgctctcagactcctggcctcaagcaaggaggcctcccaaagtgctgggattataggcataagccaccatacccagccctgtaaggctctttagagcagggataggtttattgcacagaatcccaaaatagagtgtcagcgtttctttggaccttaaatgggagtttccaaacagttaattgtgactagagaagctactgagatttgtgtctttatacagattttctgtagtctggttaatgaaacagacttgatacatctccaggatctgctgtgtgccagccactgtgccaggcattgtcagaagcatggcatccttagttccccccaccgtccccgaggccagtttctgtatgcagcgagtgcatcaggagccagctccgatttggggacttggccaccactgtcgctgtcaggtggcttggctggaacctgatctcacgtcttctaaagactcctcatgcatttgctcttttcagccatgctgtggggcctgtcctgtaacgtgagcccagggcttttagagaacggcagttgtcctgcaggcccagaaataaccttcatttcctgtggtcatagaaattgggattgatgagttggttcatcgtcacctgctactttgtcttggctcagtaactgaggggacagtttgtgaggccaagagagcgagggggctgtagtgagcaagtacagtccaggtgagaggcttctgcctgcaaggccagacagcgagaacccctggccctcaggggaacggctgtgaggagcaagacttctgtgtgttccgtggcctacgatggggcttccctgataacagcacatgcatctttccctccagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggtatgttatgcaaggctggggtccggtttaaagatttggtgactgtctagggtcataaaggccagtgcaaaacaggcactccgtggccttacctgggcgtctgacatgctagctggtggttcccacacactctcaaggcttccaagtcatatgtcaaatccctcagcagctgcagggctccaggaggccacccaggcccctccatccaggggctggttccagcactgtctctccacgtcacttgcacttatgccttatgaaactgattcctactctacctccacccacttcctgttctgatccaatactagccagggtatttcattttctagttgtctaaatcaaagtggcaagtaatatttactaataattgtatcttatttgcaagccagcatctactcatggtagtgaaattgacagctgatgataatttttttttttttttttttttttttgagacggagtctcgctctgtggcccaggcgggagtgcagtggcgcaatctcggctcactgcaagctccgcctcccgggttcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcccgataatttttgaaaacagtcatttgcctgtggtttacagagcactctgactgttatctcagtgagtgcttatgcctgtgaggtaggtacaccattgttaccatctccattcactgctgaggatcttgaggcataagaggtcaagtaacatgcctgtaatgaaggggcgaagctggcgtcacctcagggcctctgtctcatatcctgtgcccttgcctctcccatggttccctcatttggcagcctcagactgatggatgttttttctaaacaggaggaaatggtattaagctcatcatggaatttctgccttcgggaagccttaaggaatatcttccaaagaataagaacaaaataaacctcaaacagcagctaaaatatgccgttcagatttgtaaggtaaaaaataaagacatcatgttacagattaagacatcaggcactctgtcctgggtaattggtttgtaatttgactctaagtgggtaagtttatgataattatactgtttgtttttctctgcattatttagatgaaaagttagcttctactaagaaagtaaacggatttaaatatggttattttaatgtgtatttatttgaatcagtttgttcttaatattcttgcataaaagtcagaaccaaaaaaattgtcagtgatatgtgaatgaaatgacatttctattttttctgatgaagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtaactgaatcaaaccactaggttttatcaatgcttcatagagtttacactgttttaataggccctttctggctatattaatgtgtctcattcctctggcctgactcaaggttagagaaggtttagaacatttggaattgattgatatttatcttcaagaaacacacctttcagcctgtttcattgaaagcagcctatataaatgactgagcttcatatgacaccgtcttccaaggaatgaaagaaatctaaccaccagctcaacattcctagctttccaggagagggcattcatctgatgcagttcttaaaactgtgagcaggtggagagaatctagttcctttcttaaacacattcctgcagagggaggctgtaggacagagtgggcattgcagattcagggaactcctggacagagcagagcaaaacctacgggagacctggctgtctcatgaatcaccagaggttcccaggttagaaggccacacactggctacaaccatgtctcagccaggaacactgtccaggggagaggctgcttacatctctaccgcaccctgccacgtaaccacataacgacataaccaatcagcactcccctaggtgcatcctacatggacacaaacatagacctctcccacttatggagcctaaacttactcattcattcatttaagaaaatgcatcaaggtcctgctttgtgccagtactggagatatggtgaacaagtaggccgagtttagagtttaacaggctaggcagccaacggcatggagcaggaaacatacagaagggttcgggcttggttttctggaagtcgtgagtattcagaagaaacctgaaagattcatgcgggtttagacagacggttgctagacagcatgcgtgactaggaagaatgagacaagagcagtcgatttcccaggaactgaacctcagtgaggtcagatcatggaataggaggtttgcaggaggaagcttgagtcatggagctgggacttcatctcaagaacaatgggatgctgctggagagtttaaggagggagactttgttttaaaaagaccaccactgaatgaagggaacaagattggagccagggagtctggagccagggagtctggagccagggagtctgatttggctgcttcaacagctcaggccagagctagtgacagcatgaattaggacagggactgggagagtgacagtagggtttgagagaagtgagtaggttcaaggagtatataaggagattgggtgcggtggaatgccttcatttttggcttgggcaagtgggtgtcattcagcaaagtaggcaatgctggaagaggattggacagcgatgccacattgtgcagtgaggccactgctgtctcatttagagcctgcaggcaaatcagacctggggctcatcattacacggccacctcctcccataccctgagagcatgttctcagtgaaatgaagagcacagacttggcgtgttattttagggcagatacgtgctaccgagagcctgtaaaggataccgtactataggtcagatgtgcaccatagcagcgtatacatggtatgtgtaaaatatataatacacagtcagatgctgtattaaattataagaaaaaccgaagaggtgatttttcagttatcctgtaatgtcggatggagtgtgcctcccaggaaatgaagttttgtgttctgcttcctttcaaggtatgctccagaatgtttaatgcaatctaaattttatattgcctctgacgtctggtcttttggagtcactctgcatgagctgctgacttactgtgattcagattctagtcccatggctgtaagtcctacttttctcttcatttgaatccagtacccatttaaaatgtgtccatccctctgcttggttaacttttgtttttaaatggaatccaatgaatgtattataatgtaaaatgtcactttcccattaacttggtttgctacttgacagttatttgtgaatctctcaagtcttgctttcacaacgagcccggagttctataggatgaccttgactctcaaggatcttatctgtgtagagatgaagggcagttttatgggaaaatgagcaagttaagtggggtagcactgggtagggaccagccttgtctgtgcctccttcattcctaaatcagatcattttcttgggaacagactccttgaccagcacaagcacaaggagtggttggtagagtctaagacactggttagagacagatcattgaaagctaataaggattttggatttttatttaaagttactaaggagaaaagcctttttattgctacttaaatttccagttgattgtagaaatttcaccttaatctgtttggcatttatgtaaatacttgcaaagttaaacgttttgtttgattttattttatatagttgttcctgaaaatgataggcccaacccatggccagatgacagtcacaagacttgtgaatacgttaaaagaaggaaaacgcctgccgtgcccacctaactgtccagatgaggtatctatgggccacgtcacagtaataacactccatttctattatgttttcgcagcttgagttgtccagcaatgggtagaggggagagcgaggaaatgatgcagtgaagtccttgtaaaatagttttctgaagctgaatttcacataagataactgagaaatcgcctttggggctagatgatagccaccagttaggttcagagcaaggattccctccaaaagccagcccctctttatccacttgcttgccccagagggacaggttttggtgtagccttagtgtgacaaatacatataattgcattttttgtgtgtaagtttatcccacttattagcatttataattcagttttctaagtgaattgagcctttaatactaaactcttgagactgtgtaagacacactgaacagtatgagtcagagagtgaggcagccagtctggaaagttcaagtctgaactgagattctgcttcaccctctaactggtttacaggaatgacctggattttattgcagccagtcaacccttgagcttctcaaatgttaaaatattatttatgaactagagttgtatcccattttctgtgttttaaactattcaaatactcttgtttttctagtctttaaggaaaagtcattgcatttccaaaattattttcttactcttgatatttctgttattttttaaagttcccagatctaacatttttactgttgttacttctttctttttacaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagactttacatgcatatgccttttaatattaagatttcattttcaaagcatttcaaacaatttgcttacatagaaaaataacagtatagttttggggggaggaaggggtgggttacggtccttactactaacaaacaaacaaacaccacttgatttgcacttcttcactgttgtgcccagtgattgataacggggcacaggccagtatggatggcatgtccactgtgctgtagtccagacacctttgtttgtttgttttagttccttcaacctcttcctgctttgactgactgactttttgcagctctgttgcaaaattcaccatctttcctttcttctgtttgtttgtttgtttgtactatagtggaggtgtgactaagcattgaagaggctgaatgcaacaggaaaatgggaaagagaagtgcagggcctgaaaaacccattagtcatctgctatatcactgaatgatgcctaattcttatcagttacttataggtagtatacttagaaattaccttaaactttctagctgtcagtcattttccaacagaagctagtatatgcaataaattagaccaagtgaaattctttacaaagcatacaacatatgtaccaattctagacttcataattaaaacaggatatccacatcatagttaaaaataacaagtccccaaagtgacgagatatttaatgatctgatttcaaaaagccccggattgagatcccaaattccctatcaattaattacagtcttataacataaacaaacttagaaatttctagatggcaaaaggtttctcatgcatttaataccaaggtcttcaagaaatggtgatgtcaaaagtcatcatagtccataaagataaaacttctttcacaagtaaattgggttaaataactgatttttcaccctaacacactatcaaaaagagagagagagaaagcagagagtgaggtatagcttattagctcaaaatggttataaatactgtgactccttaagactccatcagaaagtgcagtattgactgctttactatactatattgtggaaatagggcatttagtgatcaaaataggccccattctagtcattagatcattactagtctacgctatgaaatgagcacagaaacccatgttcctttccacttacaagtctgtctaaaggctaaaggtctgtctttaggtgaattgaaaggaatagttgctattagaattagtgctattagatcagggatcagcaaactatatataaatggccagatacttgaaattttaggccatatggtctttgtaggccatacagtctctgttgaagctaatcagttctgcccttgtagcgtaagagtgccacagacaacacgtaaatgaatgagcatggcaacgtcccaataaaagtttatttatggacactgaaatctgaatttcatataaatttcatgtcataagttttcttttttcctccaaccatttaaaaatgtaaacattagtcttagcttgcaggcagcacaaaagcgggtggtagaccaaatgtggacccagggtgtagtttgccaaacccttttattagatcaccaaagttacttttcttaaaataccttctatttttcacagaaggtataaatggtaaacaacatcttaaagcatcggtagtagtggataccttggacatcactgtcactctcttaccgggtttaattttgcatggctggtgtgggcgtaattgagtgtgcatgtagagcatctttataatattaccatcagcacatttggtacttgcacccttgtagttctaggaaaagtcctaaaaatctataaatgcaattacttctagggaaagtaaattgaaatgcacattggcttataagaaactcattcttctaaggctcaggaaacaacactgtttcccatttattgcttcaaacttcttttatatatggtgtcagaattattcccagtcctaaatcaaggaatattggaacattgttagtttctccaatgg

SEQ ID NO: 13446 - DNA, 23781 bp, Human
  misc_feature (1)...(23781): n = A,T,C or G
cgcctcagcctcccaaagtgatgggattacaggcatgagccaccacaccctgcctgttctacctttctttacccccaggtcacctgcctccagaggtaataaagggttggtaagataaacacaatcaattctgaaaaacaaagccaaactcaaggcttgcatcccccaagtaaaggagaagatgaagggcagctttatctacctatccatatctctcatatttctgcactgtattgcaatgcttattagtcctttttggagtaaatgagaatagacatatcctttaattcttacaaatttcattgttgacccaatctcaaaccaagaccagactgtggtgtggcctggcccaagtactctacatttttctggaaatgggctaaagctatttgggactggaatttgaatgactgggtactcagagtatggttgagaaggtagatgtgggtttggggctggcaagtccacttaatccctcagacttcttgtcccatggggaagaggaccagagtggaactctctaaagtgatgatgtgggctgctttgcctacggagtagccattctttattcctttattttcttaataatcttactttcactttgaaaaaataaaaataaagtgatggtctggaagcagaagcccgccttgctcagatagcaagacaatattgagaaaatctcaaagaaaactaggaaacaccaagtaagggataagaaagcaacttaaaaatgctggaggtctactggatgataagacaatgagtattgtgggactccaagaccctgggtcaccgcaggattcttagtttctctatacttcagaaaggagcaagcaatttttagttgctactcaatacaacaaccctacgtagtgggcattttaataccattttaatggataaacaatcttatggttcaaaaagtaaaagatgtaacgaaatctacttcttactgcggtacaattatcatccccatttcacacgaggagaaactgaggtaaatgaatggtaaaccaacttgcttgggcacaagtgagaggtagcagaactgggcttgttattgacacacagaaatgttaccatctgataattaaacctttctttttctaaacaaaactgcaagtgcctacaaatggggctgtttaataaaaggcctcacttatcaggtgggctcagtcggtgaccctcctcatcctccagcctcttggggaggccaggtgtttgcgctccccagcacctatacaaagccagctttcattttttcgtttcttttttttttttttttttttttttgagacagagtctccctctgtcccgcaggctggagtgcagtggcgatctcgggtcactgcaacctccgcctcctgggttcaagggattctgctgcctcagcctcctgagtagctgagactacaggcgcctgccaccacgcccggccaatttttctattggtagtagagatggggttttaccatgttggccaggatagtcttgatctcctgacctcgtgatccacctgccttggcctcccaaatgctgggattacaggcgcgagccactgcgcgcggccaaagccagctttcttttgcaggggctgagacctggcaccaagaggaaacccaacaaaagacgaggggcccgggcccggcagccgctgaagtttgtaggcccggagcgtgtggcaccatctgctcttgcgaccagtgccctaggatagagcttcagcgcgaccagtccaaaggagagtggcggagcctcctcggcctttccaagaggaaacagctcaggcccccaggccacgaaaccttgtcactcgctggaagcgcgagccaagccccgcccccgcgagccgcctcttccgctcgcgctggggtggggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggtgagggcgcggatccgggagggcgggagcgcgagtcggacaaagggaggagagagccaaaggggcttccttttttccgcctagaaaatggctgagccggacgtgtggttcacagccgtcatttcctctctgtccgctccagagcctcagcactcagatttggaggaaaacctgtagctggcgaggaagccaggagtgtccccacccccactctcttttctctgtttacccccatgttacctgtctcacggacacattgtacacggagacatccttttgacagtttaaaagaagtgcataaaaccgcgtacacatcgacaagctgcagacactcttactcccatcggctctcagacaaaacgcagttggacgttaactgacttatgcccattccttagtctataagcatttccccagcactttcctgcaatccgtcctggtctagaaactcacagaaaagaacagcttttcgctgctggagtaagtcacttaaccactctgagactcaggagataacacagttatgaggaatattgtggaatcatgtgactcacagagccctttgtgaactggcacagctaaacagaaacgtggaaacaaagtattacatataaaacagttgtaaggtgaccttcaaggagtccatgatactgtgtattttctgtacgttgagggcttcaggaatgcgtacacaattatgtccgtgtttaaatatgagtacattcatgtgcaatcacttaacatttatggacctttcagctatattatttcactcactctggtgagaactcttgagtaggttgggaagatggtgtttgcccatttcacacatgagggaaataagtcactttcacagtgtacctatatggaagagctacaatacaacatagttctaagcctcctactccagtcacagttccgctaagtcatgcaatatcctaccagggacaggtagatgactcattgtttaagatagacacaaatagtcctgacgaggtagctgagtggttgaagccacaggctgctaagatagacacagattgccaaaggagtggcttgtttgcccctgcgccctgagtctcttgtgggtggcagtgtggcctaaggacaagcgccaactggagacttggcatcaggtgtgtggactccatgtgtgataagaagtaccatgctgatgctaaggtctacctaattttgaactgcccatctgttttgcttttctcaggagcaaatccagaaccagctcgaccatttaaaaagagtgaaagatttaaagaagagacgtcgggcccagggggaacaggcacgagctgaactcttggtaagggttgttggaattcacagttggttctgctggtgctctcctcttctgtagagctgatgttacttcccttaaacttgtccagcatgtcacccagaacttgtaggtagaggtggatcaaccgcacatggcagtgggaactcacccggagaactaagattcccttacttttggggaaagcatggagaagccaagtttggaacccttggaaatcagacctgtcagtttactttaacctgctaactgcgtagaccagggttgatccttggcaaagctgagataggtaaaattattggatacagttagcttgcgttggtaccattctgcagacaattgctaatagtggatttgtgtaatccccactgttgcttctctttggcttattctcctttcttaacaatgccttaattctgaattttttactctgccctcttcctccagtctcaaggccttaacaagtggctgatgtgttaatttatattaggggtatatgggaatttttttttttttttttaagacagggtctcactgtcatccaggctggagtgcaatggtgaggttttggctcgctgcaacctctgcctcccagttcaagcgattctcccacctcagcctcccaggtagctgaggctacaggcgtacgccaacagactcagctaatttttgtatttttagtagagatggtgtttctccatgttggttaggctggtctcgaactcccgacctcaggtgatccgcccacctcagcctcccaaagtgctgggattacagacgtgagccaccgcgcccagcctggctccttgtttagaacaaaagtttataatagagtcctgttggtggtgggggttgggtgaagaacgaaggacagtaaattatggcaaacaaatgagcgccaagagggaatcgtggggagagcacctctccccctcctacccaaagctagagacagcagttggtgaacacccgtgaaggacagacagcgggtatggattacatatgaagggcccagggaaattgggcaaggaagctgttattggttgttccatcctccatagggcacatatctgaccctgtcactttcctgtgtgacaatcttccatgcttcccagttgggatagagtccttacccccagcctcccaggccaggcatgacaaggccttaccttttctggtcccttccctcaacactcatgtgctccagccagatagcaccatttgctttctctccccactcttttgcctgtgccatttcttctgcctggaaaggcttcccgctcattgcctatgtggtgaattcttgttcatcacatgaacattgtgtgaaattgcttctgtgaagatggtaccagtttctttcattgcaggctgtcaccctatctttaattacccatccatgactatgtatatcatatgaacctgactcacttctctgagttgcttgagaacagggactatgtcttaataatcactggggtaattcagttcctgggcattatatatccagtcagtaaagactggaaataatgagttagcactgtgcttgttttaatccataatgaggtcttgggctacatggtcacaggagaactatgaaggccctagaaatgagccgtttttctctttactgcctttccctgtcgtctgcatagagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggtaaggcttgcagagccctgctagagcagcacccactgaaaatatcgtcccttctcctttgccaagtagtatccaggaccccctgtcttctttttaactctgcaggaatagcaagagcttgccaaactctatattgtgcaccttggaaggaaactgtgtaaactagaagttctggttcacacaacttgaattagtcaattgcgttgtctcatagaaatggcaaaaagaagacctggtgcttgtgcctacacagcactgacaagtggtctgattacaggcaaggctctcaacctttttgggcctcagtgacctcatttgttcagtaatgaggggcttagaccacatgtcattcaaagactctcctcactccagtatcctgtagttttaatgtattactatagccacaaaacaatgagcacttgagcaggagtggttaggttacctgagcagtcctgtgatttaaccttggtagagcaggtgataaagctgcagcagacctaccccggcaagactacaggaaatgagctaatgcctgtctgtcgtttgctcattcagtgcgtattaattatttgctttgtgtcaggcactattctaggcactgggattaagtgccaaataagctttcctgaattatattttagtgtggcgatcagatagttcttataggtatttgataaaagccattaaaaatggatgatggcgggccaggtgcagtggctcacacctgtaatcccagcactttggggggccgaggcgggtggatcacaaggtctaggacttcaagactagcctggccaagatggggaaaccccgtctctactaaaaatacaaaaattagccaggcatggcggtgtgcctgtagtcccagctacgcgggaggctgaggcaaggaattgcccaaaaccaggaggaagtggttgcagtgagccaagatcgcgccactgtactccagcctgggcaacagagcgagactctgtctcaaaaaaataaataaataataaaaaataaaaataaaaatggatgatggcatagggcaagggtcagcaaattatggtccatcccctgtttttgtatgtcctgggcaataagtatggtttttacattttaattttaatttaatattatttatttattttgagattgagtcttgctctgttgcccaggctggagtgcagtggtgcgatcttggctcactgcaacctccgcctcctgggttcaagcgattctcctgcctcaacctcctgagtagctgagattacaggcgcacaccaccatggctggctaatttttgtatttttagtagagacggggtttcaccatattggtcaggctggtctcaaactcctgacctcgtgatctgccctcctcggcctcccaaagtgttgggattacaagtgtgagccacagcgtcaggccagtttacatttttaaatggtaaaaatcagaaaaatgtatttctttctttctttttttctttttttatttttgagacgaagcaagaagggagtggacagcatagtaatgcagttgaggtcaaataatatcaaagctgatacccatttgattcaataacatgaccatcattggtgatcttaggtagaactatcacaatggaataattggggcaggagccacattagggggagttgagtagtgactaggtcaggtgaatggagactacacaagtagatgactatttcaagtacaactgttaaggggttgtaataaaatacttagagacgagacaggattatggagttttatatgaaagggttggttaaagaaactagaagttagacatattttcaaaatacgtatggaaaggagtatatgttgtaaggtttctaggtgagggagaacactgaagccacaagaaaccatatactggccgggcacggtggctcatgcctgtaatcccagcactttgggaggccgaggtgggcagatcacctgaggtcgggagattgagaccagcctgaccaacatggagaaaccccatctctattaaaaatacaaaattagccgggtgtggtggcacatgcttgtaatcccagctactcaggaggctgaggcaggagaatcgcttgaaccagtgagacgatggttgcagtgagccgagattgcgccattgcattccagcctgggcaatgagcgaaaccctgtctccaaaaaaaaaaaaaagaaaggaagaaagaaaccatgtactgatcagcaatgtgcggttcctgagaaggcaggtggaaatgagaactaaagtacatatgccaggaattagtgtcagagagtcttctgttgtatgggaagaaatgattgtttcagagtatgggaaagacagttggtttgcgagaactagtaggagtatttggtcagtgaacatctatttatagtgtaaccattctgccctgttgtgtaactttcttttttttttttttttaagacatactcttgctctgttgcccaggctggagtgcagtggtgcaatcttggctcactgcaacatccccctctcaagttcaagcaattctcctgcctcagcctcccaagtagctgggattacaggcgtgtgccaccacgcccagctaatttttgtattttttatagagacggagtttcaccatgttggccaggctggtcctgaactcctgacctcaggtgatccttctgcctcggcctcccaaagtgctgggattacaggtgcgagccaccgtgcccagcccctgtcgtgtaactttcttatcagctttgctttctcaaatcttgactgctctggcgtgggcactgagtaagcagatggtcagtctcatccaggattggggttttgcaagatggacttgagtgtttttttttccttagtttttattgttgttgtttgagacagggtctcactctgaaacccaggccggagtgcagtgacatgatcatggctcaccgcagccttgacctcccaggctcagatgatcctcccacctcagcctcccaagtagctgggactacaggcgtaaaccaccatgcttggctaatttgtgtaatttttgtagagatggagttttgccatgttgcctcggctggtcttgaactcctgggctcaagcaatccatccgcctcagcctcccaaagtgctaggattacaggtgtgagccaccacatccagccttccagccttcttcatttttttaattgtaaaatatacgtaacctaaatttcaccattttaaagtgtaaaactctggcacaaagtagcatttagtaaatccacagtgttgtaaattatcaaccactgtctggatctaaaacacttttaccacccaaaaggaaacctcacactattaagcaatcactcctcatttccttctacccctaactcctggctctatggattagtctattctagatattagatataattgaaatcatacagtacgtagcctttttcttcacttagcatacttttttttttttttgaggcagagtttcactcttgttgcccaggctggagtgtaacggcacgatctccgctcaccgcaacctccgcctgccaggttcaagcgattctcctgcctcagccttccgagtagttggtattacaggcatgcgccaccacccctggctaattttgtatttttagtagagacggggtttccccatgttggtcaggctagtctcaaactcctgacttcaggtgatccacccacctcagcctcccaaagtattgggattacaggtgtgagccaccacgcccggcctatcacttagcatatttttttaaagattcattcatattgtaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattagccaggcgtggtggcgcatgcctgtaatcccagctactcaggaggctgaggcaggacaatcacttgaacctgggaggcagaggttgtagtgagccgagatcgtgccattgcactccagcctacgcaatagaatgagactccatctcaaaaaatatatatatgaaaaaatatatatttcagtacatatatatatgtttcagtatttctctttatggctgaataacattccattgtatggatatataatatgttttgtttattcatcagtcgatgggcattttggttgtttgcaccttttggctattgtcaatagtgctgctgtgaacattgaacacaaaaagtagaaaatggttcacaaatttgtgtgttatccttgtgcaggagccatgctaatctgtgcatggttcccatttgaggatatctgctgctgaagcaagcaccataattaaggctttaaaacctttttttaaattttttttagacaaagtctcactctgttgcccaggctggagtgcagtggcacaatctcagctcactgcagcttccacctcctgagtgagtctcctgcctcagcctcccgagtagctgggattacaggcacacaccaccacacctagctaatttttgtatttttggtagagatggggtttcaccatgttggccaggctggtcttcaactcctgacctcaggtgatccgcctaccttggcctcccaaagtgctggtataatagacgtgagctactgcgcctggtctaaagcttcttttttttttttttttttttttttaagaatatttttttaaacagatggagcatgaaactgaaggtggatgatgaggaaaggagagaaagaaagaagtcatggactcagtaagggaggaggggctccatgaatatcaaaaagtgtttatgttggaagtcactggaaaagcaggataaatattacttaatggggcaatactggaggcattcccattgaggtcagaaacaggccggatgcccagtatcatttatctctatttaacactgcattaaaggttctaaccagttcagttaaataaaataattataggtatacaaattgggaaagaagttaacatacagaaatcagcagccttcatatgccagatagcagccactagaagacatattagaagagaacatgctgtttccatttgcaaaaaaaaaacaagtgataaaatatctgggaataaatttataagaaatatacaaaaacctatgtggagaaaattataaaacattcaaagattcctgaaagacacaaaataaacttgaacaaataaagagatatcacttattctttgataagacagggaaagcaagttgtccttcacattcataaatgcagtttcttttttttttctgttactcggatatattatgtagtgaagtctcggatttcagtgtaaccatcacccaggtacccagtgtacgttgtacccattaagtaatctgttatccctcatccccccccccccacccttgcaatttcaataaaaataccaacaagctctttttctggatctagacaaattgacagtcaacttcagatagaaaaataagcacataataatatgcacatataaaataagcacatattattatgtgcttatttttatgggataggccgggtgcagtgactcacacctgtaatcccagtactttgggaggccgaggcaggtggatcacattaggtcaggagtttgagaccagcctggccaacatggcaaaaccccgtcgctattaaaaatacaaaaattagccaggtgtggtggcacatgcctgtaatctcagctacctgggaggctgaggcaggagaatctcttgaacccggaggtggaagttgcagtgagctgagatcgcaccatttcactccagcctgggaggcagatcaagactctgtctcaaaaaaaaaaaaaaaagctgggatagatcactagagcccaagaggttgagcctgcagtgagctatgattgcaccactgcactccagcctgggtaacagagcaagactctgtcttaaaaaaaaaaaaaaaacataggtaggctacactgtgaaagaagagctctgagggagaactggccctactagatactacaccatattttaaagcccatataattaaagctgttggtattagtacaagaaaaaagcgcacacacattgtaaccagtcaaaagatagtattaaaattgaatatttgccacaaatatcacaaatacaagtgatagttctaatataaaaagaccttttaagtattgcgagagaaaagaccaaaattctagagaaaaatgggttgaaggcacaaatagacaagctgcaaaagacataaattgctttgtgaacatgtgaaaaaatgctcagctgtacttataataagagaaatgcaaactaaaaccacactaaaataccatttcttactcgttacaatagcaaaaattttcaacttaatacacttttgacgaagtgtcggagagacactcatatgccagtgggctggtaggaatgcaaaatcatgacccttttggaggagaatttctcaatatttaacaaaactgtatgtgtgtgtgtgtatgtatacacacagttagaattaacaatttttctaggaagggtagagggaggagagatgagagattgattaatgggtacaaatatacagtttgatagaagaaataaaagctagtgtttgataggtcagtagggtgcctgtagtttacaaaactattatatatatctatgtatatacacacacatatacataggtatattatatatatatatatatatttttttttttttttgagatggagtttcactcttgttgcccaggctggagtacagtggcaagatctcagctcactgcaacctctgcctcccgggttcaagcgattctcctgcctcagcctcccgagtagctgggattacaggcatacgccaccatgcccggctaattttgtatttttagtagagacggggtttctccatgttggccagtctggtcccaaactcccgacctcaggtgatccgcccgcctggacctcccaaagtgctgggattacaggcgtgagccactgcgcctggcctattttatagtccaaagtgactagaggagaataattgcaatgcttcttgcataaagaaaaggcaaatatttaacgatgtgatggatatcccaatacactgatttctttacaaattatgaacgtgttaaattatcgcatgcacccccaaaatatatatgtctgttacgtatcaataaaaaattttaaaaatctaagaatttactttgaagatataactattaaaatatatttgaaaatacatatgcacaagataacctgctgcaacatttttataattgcaaaatactggaaatagtctgacttagaaacctacaagattgttttagttaattatgcacatatacactatggaatactatccaagttaaaaaaaggaaaagaatgatacctatgaactgatacggagtggttttcagtatatattgctttgtggaaaataaaaatgtgaaatagagagtatgctactttttttttttttcctgagacagagtttcactcttgttgcccaggcgtgagccaccgcgcctgacaagagtatgctactttttgtgtatgaaagaagggagaggccaccgctggctcacacttgtaatcccagcactttgagaggccgaggtgggtggatcacctgaggtcaggagttcaagaccatcctggccaacatggcaaaatgctgtctgtgctaaaaacacaaaaattagctgggcgtgatggcagacacccgtagtcccagctactcaggaggctgaggcaggagaattgctcgaacccgggtggcagaggttgcagtgagccaagatcgcgccattgcactccagcctgggctacacagagcgagactccgtctcaaaaaaaaaaaaaaaaaaagtatactggagttctttgtactaacagcttttccgtgtatttgaaattatttcataataaaaagaaagcaagctggacaggtaggcaagcttgaggtccaatcataggacgcttaagttagtaaatttgaaatcctgaggtccttgaccagtggatggtgggtactgaaggagggtatgggaaatgctggtatagcaaatagtatgcatcccattttcctctgcctgccttttagctcctcaacactgagttatgttccagtgatccttttctccctaatttctcccatgagagccagtctgtagttggtttttcaacaaacatctgtgaaagaaaaccgaagttttaaatgacttctcatggttattttttttcctttctcttgcaggacattggggacacattgagcaggtatagttttctgtttccctagtgttaaatcaaatatgagaagactgtctccttcacatttgtaaatcctgaaaggagccctgagcctgaggatggacatcttatcaaattgacacatatccctgaagagagtcactagtatacaaagaattagatgaaccacagctctactcagtaaaattcaggaagtagggggttcatgtgggaggctgccggtggattaggggtatgaggacacttccatggagagggtgtggccttacagggacctgggctgaatataagggtagtttatgtctattgcttcctatacatttcagaatcctttcccccttcattatctcattttttttttttctgtaatgggggaaataaagcctaagaaaggtgtgactggcctgcatttacataattactgatgagccacctggattctggctcttattcttactcttgctatttctctatgttccatcaaaaaaaaaaaaagtgaggaagaactccctggcagctggaacacgatcaaagagggagagcttggagggggcagtaagccagggcaaagttgttttgcaggatggatgacgaggcaagtgggatgggccttgggaagctcatgtttggtgtaagaatgccttcaggggtggaaactgactttgaggaagctgtactgtgaaggtgattaagatcctgaatggtgaaaaccttctaaagcaaaatgcagcttgactatgtgggagcatttaaggagattggggaggtccttatagatggggcagtttggctgggaggcctgtgttgatagaatcatgttgatggaattgaggttcctgagggatcctaggatggagataaggtggagttcataccagtcccagccagatgacctaagcaaataatactgttacctgatactttatgatgccagtctagctgtgacctaacatacagagttagctgcctcagaccctagcagtttgtgacattaaggattgaatttggctatataagataggaaacccaaaattttattggcttaaggcttaaacataataaaagaaatgtgcaggttgggtgcggtggctcacacctgtaatcccagcattttgggaggccaagtcaggtggatcacctgaggtcaggagttcgagaccagcctgaccaacatggtgaaaccccatttctactaaaaatacaaaaattagctgggcgtggtggtgcatgcctgtaatcccagctacttgggaggttgaggcaggacaattgctcaaactcttgtggcggaggttgcagtgagctgagatcatgccactgcactctagcctgggcgacagagcctgactccctctcaaaagaaaaaaaaaagtaagaaatgtgcaggtaggtagtctgtggctagtgtggtaactccagtgatcctcagagactcaggtttcttcccattcactgttctaccatccctaaggtatggtcctcatatagtccacaatagctggtagaatgccaaccaagaagaaggagataagtcgcatcacattacctttttttcttcgtttttttttttttttttttttcatttttcttttttgtagaggcagggtcttaccatgttgcccaggctggtcttgaactcctagcctcaaagtaattatcccaccttggcctccaaaagtgttgggattgcaggcatgagccactgttcccggtcatgttacatttttaagtagatttctcaaaacaccatgagatacgtcttacttctcataggccagaacttagtcacaaggtcacatctagctatgagggactgggcagctgtgagccataaaaggcagaagatggcagaaggggtattggataggcaactggcagtctttgctatagacatccttgcagggctagggaattgggtaatgtcccccacagtgcctttctatctgaacatgtcattctttccatatttgggaacctgagaattcgggttaattgcccaccataaatatcaaggactgtcatggaatctagtgctttctggcaaagtcagcctcatatgtaattcagtaaacctttttgagtacttagtatttgaaaagctgtgagctaggtgctttggggggtatgagaatgagtacagtatcctattttggtctagaggatcatagctcaggaagagaaggtgggaaaagctgtagtggctgattttaaagactgtccgtgtacgctagacagtttaacttagcccctgtcctagttcctggaaggtcatggaattgggaaaaagaatttacttgggccggacgtggtggctcacgcctgtaatcccagcactttgggaggccgaggcgggaggatcacctgaggtcaggagttcgagaccagcctgaccagtatggagaaaccccatctctactaaaaacacaaaattagctgggtatggtggcgcatgcctgtaatcccagctactcaggaggctgaggcaggagaatcgcttgaacctgggaggcagaggttgcggtgggccgagatggcgccattgcactccagcctgggcaacaagcgaaactccatctcaaaaaaaaaaaaaatttactcatgttttttaaatttagggctgaaagaatcaggattcctgaaccttggatcacacctccagatttgcaagagaaaatccacatttttgcccaaaaatgtctattcttgacggagagtctaaagcagttcacaggtaatgtgaggagaggtgtcatgaggggaaatggatttatactgagtatctgcatattgcctgatgaagaggataattttccagccagatagtgggatgcagactgaatattttcttgttttcttttcttagaaaaaatgcagtcagatatggagaaaatccaaggtaaatttatctacctactgggcttttgatgtaaagttgcttggaaaaaagaacatctgcactgaaagtgggaaacgtgggataagggtgatacccattggccagccttccctgatattttacatcttccctttggtcttaattaattttctcaattaacagcttcttgttctaatttgaagtttgttaactgtatttagtcaattcgcagtctgcattgatggaggagaaaaataagcaatccaaaaattaatccagaattaatttgattgtttacttcggaaagaatgaacaaaaactaccttggatacgtttcacttgagccagtgtttatcattgtaatttactgagttcctactgcttgtgggcacaggtgccagctcgggctggaggaatccagcagcactgacaggcagcaccgccagggacatggttaggagcgggcagtcaggagtcaggctgcctgggttctgggcctgcctctaccacttagtaaggattcaacaagtaatttcctcatctgtaacagaacagtaatagttcttacctcctgaggtataagaattaaggttagttaccatttctaacacttctagaatagaacctgacacataataagtcctatatttatgtttattaaatcgttctaggcatttggagaagcttttccaaattaaaatttttctgctcacgagccacattcagtaaagagttggccatatattattccacccaggaatactaaaattcctgggcagtctggtggattctgaaatccttatatgtaggtaaacccttctcttaattattagaaattacaaacccccacaatctttgataattttctattttgtatatgctgggttcatatatgcattgcatctattcagatatatactttttggggcatctagcaacatagagctagcagatacatgtcctctacaagcaagacaaatggggagaaactccactcaatacagtggataataccagaagtggttagttcaggcatgactttccttgatctggctcttcttttcttgccacttaaaagtcttagtgggataatgtgtgagaaattctgtttcaactataaagtgccttataaatgaatggtcatgtttaccccagagtgtcagtgagtgtcacttgagccattcagctcttgtacacagatgacttatgcaactcaaaagttatgtatgacgtggggttggaaccgcgtttccctctgcagaatcagctgactcactggaaggtggaattcttgatcttggctcagttttatcccatattctaccagtctcaggcatgtggttatccctgtacttaagattcccaatccctctccccttaaagcttttggttggatgatagagccatacatcatatgaaaaaattagtgcatgactaacaacagaggttctggggtttctggtggagaccactgctttatgatgactaaccaaagcccccttagttatgtatttcctggaaaccctcatgacttccataactttgctcttttattctttcagaattaagagaggctcagttatactcaggtaggtgatgagagacaaaaccatattagggtaaggagtaaaaatccttgtgaacctaactactattatgaatgatttggaaattgcttagatttggattcttttggttacatgtataaagatgatacacaacaaccacaaaaatcctcagttgtttctatgtgttaacagtatctttgcctcctgaaatgtctcagagctgaagccatagggtaaaatcaatctcaggtgttaaagaaggattatagggtggaaaccgcagttccccaaaagtagaacagagctggtacactagtacactgctctgcccgcccagcttcagggtcaaaccatggtttgtgacaagcaggactgattgagctccacaatagtgctcttgagtgctagaggaagtctaggagtcttgtgtcatcccatcactgtgcctcagagcaaagtttgaaacttcccttccccctcacaaccgctttcaccctactatagagcctgggtaaatttaacattgcagaagtattcaaatctaaggtgtattcgtcccatagtcacagtcaccttctgttatgaattatcctctaaatgaagagaaggactctacatacagtggatctgcagtccttggtgtgcagtggctctgatccatatttattttcaacaagtattaaatgagtactttgcttgtatcctacactgcctaacattgtgcagggtattttagaggaacagaagagcataagtcatcctactcttggggtttacattgtctggttggaggtatacccatgacacaagaagaaggtaggcagctgttgtagacagattgttgaaccaggagccaagggttctggggttcttggttacctctatcagttgcctgtcttttgtgggagtaaaaatttgtgggcttaaatttctgagaggtaatgtttgggactcttcctcctgaacaagatgtgaggagcaaatgagagaatacatatcagtatttttatttatttatttattattttaattttttaaattttttattattcattttagaggcaggttctctgttgcccaggctggtgtgcagtggcatggtgatagcttgctgcagcctcatactcctgggctcaagtgatcctcctgcctcagcctcctgagtagctggaattacaggcatgcaccaccatgcttgcctaatttttttacttttattttttgtagagacagggtctcaaactcctgtatgcaagcaatcctcttgcctcagcttcccaaagtgctgagattacaggcatgagccacatatccagcccattatcagtgtttttgaagcaggaaaacacttgatgatagcaagatgctgtaatactaaatgccagaggagatgacatgggtcatacacagttttagatttcagaacagtaagtgtaatggcctgggcagattaagaaaaacttggaggatgtgtgttttggactggacattagaagaagatgaatagagcttcgatgtgcagagtaaagatcttatagaatggataaaagagtgatttgggctgggtgtagtggctcacacctgtagtcctaacactttggaaggctgaaatgggaagtctgcagtgagccatgattatgccactgtactacagtctgggtgacagagtgagacctcatctcaaaaaataaaaaaaagtaaaaaataattttaaaagagtgatttaaaaagtaagcatactgatacaggttcccagtcccttacccacagttctaaaatcccaaatctctgaaagccaaaacctttttcattattttgtgggaaattaattatagcatcaaaacctgaatttatgtggtactgtttagagcctttatccttcattatgtaaacattcatgaatctcacagcagatctattaatacttcattatagaatgctgcctgtctaaaacctgtaatattctgaattctgtgaaacttggggcccctggaattttcagaataagggatgatgagcgtgtaagaaaacctcaattcagcgtatctgccaggcacagtggctcatgcctgaaatcccattgctttgggaagttgaggtgggaggattgcttgaggccaagagttcgagaccatcctgagcaacatagtaagacctcatctctacaaaaaattttttaaaattagggtggtagtgcacacctatggtcccagctacttgggtgtcttaggcgggagaatcacctgagcccaggagtttggggttacaatgaactatgaccacaccactgcgctccagcctaggcaacagagcaagaccctatctcttaaaatcagttcatgatggatattgtggcttcagatgtgaaagaaaagatacggggctaaaattctgtattttcagagtattctggtaaccagctaatccaagcagtaatttttgaaatgtgaagtttagaatatattctaaataaaatacgtgcaacctccagtgggaacctcttattattggggaggtagtagaaaggcgctgggtgttctaaaataggctctcctggcccacggctgactgtcttccttgtgtctctgcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgtttacattgttgttgctttctgggtgttggtaggattgggttcagatgttggaatgcgtgtggggaggaaatggttaatggtgttgctttcccatatgggtgcaaaaatcccactctggccaatagtttacttcaaactggaaaataaaaccactttctcagtgccatgtcactactttctagtggtgctaagaaagtagtgttggacattcatagcctacagttcttttttttttgaggtggagtcttgctctgtcgcccagtctagagtgcagtggcacgatctcggctcactgcaacctctgcctcccaggttcaagcgattttcctgcctcagcctcctgagtagctgggactacaggcgcctaccaccgcgcccggctaattttttatttttagtagagacggggtttcaccatcttggccagggtggtcttgaactcctgacccttgtgatccacctgccttggcctcctaaagtgctgggattacaggcgtgagcaaccgcgcccggcctgcctacagttcttatattggttaatcctgtaattttactaggaaagtattttctcaagtcctttttgtagtattgtgccaggcattggggttccatggctgaggttcatgagttggtgatatcatgtcctaattcttcatttattcatcaggttttaagggaaataatagaaccagggctatagaaagtagcttccatgaggctagattagcttttgctgaatattctgagatctaaatgtatacggtaatatatatacaggcacataaatactactaacaaacatagagcagtgcttggcacatcatatgaagagttttatgcacagtagcttccttaatgctcatgataattttatcaagtgtgtactgttgtcttactttacagataaactgcagcagagagggtaaatgacttatccaagg

SEQ ID NO: 13447 - DNA, 6459 bp, Human
  misc_feature (1)...(6459): n = A,T,C or G
tttgttactgcttgaaatgtttgccttatatggcatgatcagatcagttagcagcctgtgactggctgagacccagctatttgttccaaaatatactcataggttaagcttttagcttgtttctgtggtacattaggttgcagtttgttgttacctagaaactcaaggcacagaggcagcctgttaattgagttaatttaacagttcaaacaaatacttatgcaccagtgtttataacagcactattcacagagttagtttgaaagcaatctaaattccttctttggatagcctagacatttctcctggccataagaaggggtgatgccctgacacatgctacaatgtggatgaaccttgaaaacatgctcagtgaatgaagccagacagaaaaggcattaacccagaaacaaatattgcatttccttgatatgaaatatccagaacaggcaagtccattcactgagacagaaaagcgaccagtggttgccagggcatgggaggagtgtggaacgggtcgtgactgcttaatggatgggagttttattttggggtggggaaagtgtttggggacgaaacagaggcggtggtggttgcacaatgttgtgaatgtcactgaattgtttactttaaaatagttaattacatgctatgctgattttatcataataactattttaaaattattttgtgaaaaactgtgatgcttgggatttgcttcaaaataatgtgggtggggtggaggttcgaaaagttaccaaaaaaaaaagaaagaaagaaagaaagaaagaaagaaagaaagaaagaaagaaagaaaactctggcttgcaaagaagaaaacggatcggccgtggatccctctccagctcgagggctggagctgcggcggaggcaggagctggaagcgaggcgtctgctggcaaaggcgggagtgcacgttgcgctcgaagccccggcagccgcggcaggaaccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaaagctaccaggagagcgagacgggccccgagagctccatcatcaccaaggtcaaggggatcaccacgtccgagcacaaagtgtgggacgtggaggagtacgtgaagccccccgaggtgcgggccgccccctgccccccgccccgccgtgcaccctaccctagtgggcggagggggcagcggctgccgcctggccgaccgccccctctttactgagcccaggggggcagcgtgttcagcatcatcaccagggtcgaggccacccactcccagacccagggaacctgccccgaggtgaggggatcccgcggcgctgggggaccccgcctcagctaggcgggccagctgtcccttgcggggtccctgactgggccgcctccaccctagagcataagggtccacaacgccacctgcctctccgacgccgactgcgtggctggggagctggacatgctgggaaacggtcggtgtgcgccagctggggctgggcgggtggggcagggctgcgtccccgctaatgcctcagtgacctctgcctcccaggcctgaggaccgggcgctgtgtgccctattaccaggggccctccaagacctgcgaggtgttcggctggtgcccggtggaagatggggcctctgtcaggtgcacctgcgccccggcctggggcccagcctcccctctgatccttttcctctgaccagaggccaaacgggcggggcaggagtgacaagagctggggaggggtgggggccaatgccaggcgggggctttgcgggaagaggggactaaacaacccttctgtgcctcctcagccaatttctgggtacgatggccccaaatttcaccatcctcatcaagaacagcatccactaccccaaattccacttctccaagtaagagccgcggggtgtggtgacggcccagcctgagggctgccttctgggaatggggtatttggggtgcaggtctcgcctcctaccgcctcctcaggggcaacatcgccgaccgcacagacgggtacctgaagcgctgcacgttccacgaggcctccgacctctactgccccatcttcaagctgggctttatcgtggagaaggctggggagagcttcacagagctcgcacacaaggcagggcaagcgcaggcagggtggggccagggtgggctcccacctgcacagagagggcctggggtacaggggaccagtccctcctccctcctgaccagctggccccgctcaggcagaggaaagaaatgcgatcagcgcaacccatccggtgtggcgcttgctgaattattgacactggccatggggctggctgctggcaccccttgtgcctcagacactggacgcccaccagtacccctgagctgccccatgggcccctcagtgcacacctcacatgcagcctgggactgacccgggctctcgaggggcctctcgtgtgccctcctgacccccttctctggctccttcttggcagggtggtgtcatcggggtcattatcaactgggactgtgacctggacctgcctgcatcggagtgcaaccccaagtactccttccggaggcttgaccccaagcacgtgcctgcctcgtcaggctacaacttcaggtgctgtacttgggacaccgctgtccacactggcatagctgtggtggggtcccgagaggcccaatgcctgtggggcagccctggagtgcagaggacgagtgggcactggcgttcccattgcaggtttgccaaatactacaagatcaatggcaccaccacccgcacgctcatcaaggcctacgggatccgcattgacgtcattgtgcatggacaggtgcctgcacctgctgggggtgggtggccagccctgctagcctgggtctgagctcctcacgccccacccctcccttaagccccatcagacgccgtcagacattctgaccacgacccccattctccccaggccggggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcagaaccttctggcctcgttccttggggaggagcatcgtgagcctgtcaatatgggatgtcaggccctgtcggcctggagctgggctgcacggtgacctctgtctgggtcatctcccctctaagcagcctgcgaggtgtgcagggcacatgtctgcctgccccatgacacatggtccccacagccagccaggccacggtcaggtctgcccaggctgggagtgcactgggacccaggccacctcctcagtgcacttgcttctgacagggccaccccagactccaaaccaaagctggctcatctcaaaatgtgggaggacagcatgactcaggaagagagaaataggagggaggccgggacagctgcacacaaggaaaacgaaagctcagactacagcagtgctcagaccagtgttcattcctactccatgggagggggcaggaatgccgagatgggaagtcaggccaggcgggggtggaaggacaccagcccgggagccagcactaactgcatcagggcctgggggtaatctggttactgcatcctcagatgctgcagtggttagactggtgcccactgggtggggggaggagcccagaacagcgtcatgatgtcacctgtgccagtgacagatgacatcctgcctctgaagggaaacccagtctcaggagagcaacaccacgcccaaaggtcaaagagcggagaagggcgggtaagacgaccctggtctgaccctaaagcctgagtttggaggtctcagcacaactccagagtcctcatcccagcgctgtgttcaggtggcgagaacatgtcttccatgggccccatttcccttgactgtggcctcccagcctcgggcatcggcctcaggtcaccccacggcctgcacatgctgtgtggctcacaaatatccagctcatttttggagaaactggctcttctggttgagccgctgcttgggaaccagggccagagcttcccgtttctgacccctccaccactactcaaatgcccgcagctagcctcacagtgaacccaggctgactggcgcccacggctgcaccgggcgacccctggtcctgctaggtggccttcctgggggacgagcggctgtcccccggccccatcactcctcattcctgagggttctccagattcgcttccaggaatgaagcctagtcagccagcctccctcctcccctgcttgccctaatttgatttgatctccactctggaggcctcagcactcctccatctgagcaggcatcaggtttctccaggcaggcggccccagcagcatccaggggccaaacacgtgcccagtggtacccagtccccgatctgaggcgctctgcacaaatacacagtgacaacctagagaaacttcagtatgaaatacaaataaaaacaaagtgtagcagcgatggcctcagacagtagatggcagggacaaactaaggctggctctgggccaaagacacgagcctcctggggagcctgtggggccccctccctcctgtgaggctctcgtctggggtgtctgcatttctgatttacatttcatacttgtttggtgccctgtgaaattggc

SEQ ID NO: 13448 - DNA, 6459 bp, Human; identical to SEQ ID NO: 13447
  misc_feature (1)...(6459): n = A,T,C or G

SEQ ID NO: 13449 - DNA, 31039 bp, Human
ttaaaggccccacatcgcaataccattacattggcaattaaatttcaacacgtgttttgaaggggacattcaaaccatagctccctacacatctgaaatccatctacatatttccacctccactgccaccactttagtccaaatcactctccattactgctagctcacaaaagtgcaataactttccaactagtatccctgcctctcttctttcccttagctatcattcttcacacagaaacaagaggtcatttaatgatttaaatcaaatcatataattctcttgctttaaaaactcctgataacctcacagtagaaaaccaataataaatgtgaaaagaatgatggaattagaaaatcaccatttggcaaccattgtaataatcaattcaaataagaatcatcagatattagaattaatgagtgaaatgttgaggcgtaaacaggatgtgtacatattctcaaagtatttcctcacaagatactaattacaaagggaaaaatgaaacattatcagggataaatcttcagcaagtgatcaaagttaacattaccagcaataaaacaactaacatcatgtcccttctaatgtaatgctctgacatgaatgaatacaaggtcatttctgtagtattcctgccataaatgcatcacttgaatcaaataacaaaaaaatcaaacctaaattaaggaatattctacaaaataaatggtttgtattcttcaaaagtgttcatgccatgaaaactgaagaaatactaagcaactattttccagactaaagcagattggaaacatgacaactgaatgcaaggtgtgatcttggattttcttttgctatgaaggacattattgggccatttaccaaaaaaaaaaaaaaatgcataaagttgatagatcatagtattggtaattttctgattttcacaataatactgtgtctctgtgaaataatgttcctgtgttgggggaaaatacacactgacgtattaatatttaggagtaaaaaaaatgctgatgccctatttacaatcggattaaaattcaaaccacttcaagatttggtctcctgtgcacttgttctcttcctgtcattcttccccacttaatcattatgagaggtcactctgacgtgacagttcccagcgcaagccaagttttttactgttccctaaaccactcttttgttaccctattttagtttaaatatcactcactcagaaagtcattccctgagcacactgcctaaagttagtacctccattgtctattaaagcactctttcttcttactattttgcttatttattgttacctatttattcccactgaatggaaattacattagaaatgggggtatgctctgttcacggctttttcttgaacacgtggaatatactagcgctcaaaaaatatctttaatcagacttatctttaactcttaccaaaaagcgttatactcatagaaagagcactaatacttccgtaaaattctaagctgaattcaaagacgataccctttaagtgaaacttcacgagagcctgagcacaaggaggtgaagtggatgccatcaagattctgggtcagggtcgggacgcggaggaagacaggttacttcgcgcctactgctttttctactttttgtgagagtataccagcatctctccctttggcttaaagaaagaataaagtgaggagagaataataatataaaagataaataataattccaaggaaaggaatagagcagcttctcagataccacgacgccaagcggctcaaagtacgcgaaccgaaggaggagcctttgctttccccaaccccgcctccattgcttctgcacatgcgcgccgccagcctctcgcggcccgcttttttcccacaatactcctcgtcctgggggccggagccgcggaacgagccacagagaaaaaggttattggttggcagttcagccaatgagcgggcctgttactagtttgcggcatcctgtggtataggggaagcgctccgggcctggaatccctacgcgtccctttgggtttagcacgatgagctcaatcggcactggggtgagttcgctgtctgtcggtgtaatagtttaacctaaggattggggttgaagggaactcggacagaccacatggggttcgcggacccggggtgctctgagaccgccttcggctgggtgggccatttgcagctgtttggagaccggtcgtctttatcccctatatgctaggcctgcgtctcaggtgaccgtgactcctgaagcttttcagcgcaggtgtagccggcttggcgtcgccgcagtgaggtttggagccgctttggattgctgagtcactttcttcagccacttagggaaaccgaaagtggaaactcgtggggcttgaaatagtgtgttctcttgagaaccaccgaggcagtgagatttgggattccggggtctggagatcgtgctttttgtggactgcgtttgcagttcctagggtgctgctgattcacaggccttctctgtctttaagtgtgcagatcattgaccgctcagtttaagagtcactggaaatcctgtcggaacagaactaataaaaatggtctgaaaaacaatctgatgaatccttcagtttttcctttctcgtttttcctatacaaattacctaacagcgcttgtaggcatttattccgtaaacgtttaaatggttacttaggaacttaacagcttcagacttttcatagactgttgaggattttgcagtgggacttgttaacttgtttggctttcctttgttaaacgtattgcatatgtgcagtcagtttactccttttatgtacttctctatatagaaaatacagtttctaaaagatttattggttatttgcactagagttattgaataatgagtttctcagttcctcaatttctacttcttaacaagattctcatgctcagccttaagttcaagtaccggtgttctaaatttgataataggcaacttatgtctggaatggtttaatccattcagttatgaatgctaaagttctgccatacttttcttggataagtaaatgctcaatattaaatcttgtagcaaactgactttgcaattatattaatattaccttgaattaatagtatttcattctacaaaccttttaaagaatacttgataatgtaaccatgtgggatattttagtaacaatggtagggttaatgatctgggtttaacagatcaggaaacagactcagaaagtaccactgctgaaggcttttcttctgtcttcatttctcccaagaactccagatacgaatatttgtttgtctgcttgacatgtctgttcacttgatcgtttaatagtcatttcgtactgcatgtgaaagtagagctctgggttttctcctcaccttgccattttgcatctactacagtcttcagctcagtgaatggtcatatgaaaaaatctgttattcatctttaattcctttttttactttactcccagaaccaacgctttagcaagtttatttttttatttttattttgtttgagacggagtcttgctctgttgccaggctggagtgcagtggcacgatcttggctcactgcaacctgtgcctcccaggttcaagcaattctcctgtctcagcctcccgaagagctgggactacaggtgcgcaccaccacgcccagctaatttttgtatttttcgtagagatgaggtttcaccatgttggccaggatggtctccatctcttgaccttgtgatcagcccgcctcaccctcccaaagtgctgggattacaggcatgagccatcacgcctggcctagcaagtttatttttattatttttatattttactctactctcaaaaaatattcccttctacctcttctctcgtctaagctactaccgctatctttggaacaccttatctttgcttctgttgttctctctacagcttattttccgcataaagccagaatgatgtttttaaaaatatagatgataccactccccctgcttaaatttctcattgcatttagaataaaatacagagtcctttttccatcctggaagacacaacataatctggccctcagctacctcactaacacagtttactcttctttctgctgcttacagtgcttgggacacagtgaccttatttctgtttcttgactgtgctagccttatttctaccctaagatctttgtgccaaatgtcaagaagacttttccttcatatcttaaatggctagctccttgtcatttaggtttgactcagcctaaatataactgcccagaaggccttccctgatgatgtagtctgtagtagttcattgctttactcttttattttcatcttagtgccttttctgatttactgctgtacctctagcacctagattcatgtctgatgtgaaactgaaggacttaatgaatgagtatacctttgtattccgtatagtaacataatagatactcattaactgcttggtgaatgccgaatgatttgtttgaagtcttttagtttgttaatggcagagttaccgttacaaatttaaatgttcgaactccagtgctggttctactgccccatattaatctttttcaaaaatgagttttgtagtctgggtgaaaagtgttctgacttcacctgggacctgtatccattactcttcaatagctgaaatcgaaggtatatagctttatcttagctactgttgctgctctgacaagtttccctttcctctcttgaaagcaaggtctttgttgggatataacaggttcctgatgtttcagccatttagaggggaagaaactgtatggtcattactgccaaagatacaagcttactgttgcccttttctccttaagtatgacctgtcagcctctacattctctcctgacggaagagtttttcaagttgaatatgctatgaaggctgtggaaaatagtaggtaagaaacatttaaccaggtattacatgtctccttttattttatatatttttggcgattaggctttgttatgttactttggtacaaattagtatatgtccccaaatctcaatttattcatttccagatctctttctaggccagatgctttccatgagccccagtcctatatttctcgttgattccaggattatccacttagattttccatgttgcagagtgtataaatcacattcattatcatctttttgttttccattttcaaattcttgatttgtatcataggcttcctcagccattaggtttgtgaccttgttattttttatttctcatacatcttgtgttttaaatgtcttatgcaattagtcacatgttcgattcagcaaagattttttctatgtctgtttctgttttgagacctgagtctcactctgtcacctaggctagagtgcagtggcacgatcttggctcactgcaacctccgcctcctgggttcaagtgattctcttgcctcagcctccccagtagctgggattacaggcatgtgccaccatgcccggataatttttgcatttttagtagagacggggttttgccacgttggccaggctggtctcaaacccctggcctcaagtgatccgctcacctcggactcccagagagtagccccagtcctatatttctcgttgattacaaagagctgggattataggcgtgagtcactgtggccagcctaaatacgattttaaaaagtcagatttatgcaaatatgaggaaatatctttaaaaaattgaaaccttaaaaacgaatgtgttttttcctgaatgaagaaaaaatgcagccgggcgtggtggctcacgcctgtaatcccagcactttgggaggctgaggcgggcggatcacctgaggtcaggagtttgagaccagcctggccaacatggtaaaaccctgtctctactaaaaaataacaaaatacaaaaattagccgggtgtgatggcacacgtcgtagtttcagctacttgggaggctgaggcaggagaatcacttgaacctggcaggtggacgttgcagtgagccaagattgcaccactgcactccagcctaagcaacagagactctgtctcagaaaaagctaggattttaaaaatgagacgtagtttcactcttgttgcccaggctggagtgcaatggcacaatgttggctcaccgcaacctctgcctcccaggttcaagcaattctctcagcctcccaagtagctgggattacagacatgcaccaccatggcccgctaattttgtatttttagtagagacagggtttctccatgttggtcaggctggtctcgaactcctgacctcaggtgatccgcctgcctcagcctcccaaagtgctgggattacaggcatgagccacggcgcccggcctaaaagttcttctttttaaagatgtattaacctgtcctttgatactacacccaaagtgaacaaatgctagtttcttattttaaaaaaaaatgtttatttattttaaaaaagaggcatggtctcactcactatgttgcctcggctggtcttgaacttttgggctcaagtaatcctcctgccttggcctcccaaagtgatgggattacaggtgtgagtcactgcgcctggcttattattccttttttttaaaaaaaactttttttgggggcaggacataggatctcgctttgtcacccaggctggagtgcagtggtgtgattacagcttactgcagactcgacctcctggtctcgagctattctcctccctcagccccacaaggtagttgggactacaggcatgtgccaccacgcctggcaaattttttgtagagacagggtttcaccatgtggcccaggctggtctcaaactcctgagcccaagtgatccgcctgcttaggcttcccaaagtgctggtattataggtgtgagccaccgcacccagccgaagtctttgaattcttatgaaaataattttgacctcgaagactgcctgaaaggatttcagagatttccagattttcaagaatgttttaaacagtgtggaagatgttgagttgagataattaagacaggcttcctgctgggcgtgagccacgcctgtaatcctagcactttgggaggctgaggcaggtgtattgcttgagctcaggagttcgagaccagcctgggcaacatggtgaaatcccgtctctactgaaaatacaaaaaattagccgggcatggcagtgcgcgcctgtaatcccagctacttgggaggttgagacaggagaatcacttgaacccgggagatggaggttgcagtgagccaagatcacgccactgtactccagctggggcaacagagcgagactccatctccaaaaaaaaaaaaaaaaaaaaaaaatagggacagagtttcaaaatgttggcctggctggtcttgaactcctggcctcaggcaatcctttcacttgggccttccaaagtcctgaggttacattctgacctgtactgcttgagttcaactaagtttgcaaaccttttggggaaattcatttaaataggcagtagtgaagaggaaatgtattctagcatccaggataacctcaaagacatggaatcaaaaatgaacatgaggtttttgaaggttgacagtgaggtaaccagtagagtacagaatttataacaggaaattgaatatgctcagggggttctgccagacccttaggagtttaaacttgcaaggggagccatggaagacacctaaagtgttggggaaggagtgtcagaaattcttagaaaatttgttgtgtgcatctgttgttcatttttctgggaggaaatgccatagtttcatcagattttaagaggcctgtgaataacacaattcccctgctttttagattgtggatccctttttagattctgactatggcaaaatgaaacacagctaggaattaggctggtcttagattaaacggattagagaagtagaaaagatggtgtagtaatctaggcctgaaattataaggatcccaatgctggtataattattgtaaagaagtggacatgaaggaaattttgaagaaaaaaattaatagtaaatagaagctcaacatggaggatgtagagcttggtgatgctattatccaaaacagagaagttgtgccggtagtcccagctactgaggctgaggtgagaggattacttgagcctcagacttcaattcaatcttgggcagcatggcaagactccatttctttaaaattaaaaaaaagaagaaagagaaagttgagataattttaccagaaaactgtacaatcaagcattgcttattttgtctctattgtttccgatcagaactacctttatcaaaaaggaatagaagaataaagtgtaacacattttcatcttgaaatggcaacaagtaatttctccacattttacttgaggttgtgtgtgtgtgtgtttgagacagggtctcactctgttgcacagactggtgtgcagtggtgcaatcttggctcactgcagccaccacctaactgggctcaagcaatctctcacctcagcctcccaggtagctgggactacaggcgtgtaccaccatgcctggctaagccaggtttcgccatgttgcccaggctcgtcttggactcctgggcttaaaagatcctcctgcctcagcatcccaaagtgctgagattacaggtgtgagccaccatgcctggtcttaagaggttattttaagatctttttattttaaacagttgtagcagaacatatattttatttttatatacgtattagaagcaatatgtttattatggaaaaattggaagaaagagatgagcaaaaggaagaataaatcataatccttctacccagagcagtcactgttaactttttagtttgtatctaaccttttatgtctgttatgtaccatttttaatggacatgaatttatgtcaacatttgtttataacatgattatcataagccagacactgagccatattgtgtttcgttagcatcatttttatacttacatattaatatatttttagtcaaatgatgtactagattctggagggagggtcacatgatatttatatggatttaatgtatttattacactttagtgtgttttctcttcctggttttcaaatgttttaaggtatttggcatgccttaaatgttacttattttgtttttttgttaaacttaagtttatgaagtttcttttattttcagttaaaaaactgattttcttctccttgtttcagtacagctattggaatcagatgcaaagatggtgttgtctttggggtagaaaaattagtcctttctaaactttatgaagaaggttccaacaaaagactttttaatgttgatcggcatgttggaatggtaaggtcatgtttaaaatgttcctttttgtcttgtccaatttcttttgaagtaactgattggaatagatcactgtgcagtcacaaaagtaatcagagcaagttactgcatttgtccagttcactgtccagtagaaaggcagcattctcataaccttattagtgatgggggaaaaaccaagttgctgaaagaagagcaggtgagggagagggctggggagtatgcgtagaaatgagatcttggcagcacacattactaatgaaggtatatgcttgagaggtgaagaatctttagctttctgtatctcttgtggggatcactgtcaaagtaaagatgccatcagatagcgaacacctttatataaggtggaacatcaggaaaggatgtttaatgaaaaggaaaagtgaacacatccataatagtttcatagggcatcactgaaattaagttattcatgcagctggtatctaagttatgagtgactaaattgcaagccaagccatagatacatgactggtatatactaaagttaccctacatagatggcagacttggcttagtgagaaccactactgaaagaaaaaaaaaaaaaaagaatcaaatgattctaaccctgccacctgaaaaggaaaggaagaaaggagaatatctctatattaggttttatgctgggagctctttacataaattaccttgtttaatcttgacaacccagtgaaggttatatcaatgtcattttcttttttttttttttttggtttgagacagagtctggctctgtcacccaggccggagtgcagtggcgccatctcagcttattgcagcctctgcctcctgggttcaagcgattctcctacctcagcctcccaagtagctgggactacaggtgcccactaccatgcccagctaatttttatatttttagtaaaggcagggtttcaccatgttggccaggctggtctcgaactcctgacctcaagtgatccatctgcccgcctcagcctcccaaagtgctgggattataggcgtgagccactgcgcccggcctaatgccattttcacaggtgaaaaaacagatgcacagcaagtaaagaaaagctgggattcaaacttgggtctgcatgttactcaagagccctttctaaatgaaaagacaccttatatgacccacatcgttcagctgatagctttcttatatctaaatgagatttaatgttacacacaaacacaaaaagtactggtaaagtataaccagtaaaccataaagctaatttttttcttcttcaaagattattttatctcaacaatatgtttctcctgaacagatttttttattttgctgcaaatgacaggattttattttattttttgagatggagtctcactctgtcatccaggaaggagtgcaatggcgcgatctcagctcactgcaacctctgcctcccgggttcaagcaattctcctgcctcagactctcaagtagctgggattacagacatacgccgccacacccagctaatttttgtatttttagtagagacggggtttcaccatgttggtcaggctggtctcggactcctgaactccagtgatctacccgccttggcctcccaaagtgctgggattataggcgtgagccagcgtgcccagcctagcattttattctttttaaaggatgaatagtattccattgtgtatatatacattttctttttactgtttttttgttgttgttgttgtacagatttttctcgtcacccaggtactaagcctaggacccaatagttattttttctgatcctcttcctcctcccaccctccaccctcaagtaggccccattgtctgttgttcctgtctttgtatccatgaattctcatcatttagcttccacttataagagagaacatgtggtttttggttttctcttcttgtattagtttgctaagaataatgctgaacagatttattattgccagtgaaactgatatgttttgatgaaacttgctagattgtaacctagctagtaggaggtgatcttgtattcttttatgtactagcaaaagttaatattttgaaaaaaattatgcatgcatatatatatgtatgtacacacacacagaggtcttgctctgttgcccaggcttgagtgcagtggcatgatcatagctcactgcagccttgcgctcctgggctcaagtgattcttctgcctcagcctcccaaatagctgtgactacaagtgtgccatcacacctggctaattttttagtttttttaagagatatgatcttgctgtgttgctcaggctggtcttgaactcctgggctcaagcgatcctcccgcctcagcttcttgagttgctgagattacaggcatgagccaatgtgccctgtcaacattagacattgaagagggctggagaaaattaagacttaatatcctccctccttccacagttgtcatcttcaagtgatttgagaattatatgactttacagtaagctttctctaaagcaacagaagattctttaagtgatgtaacttactggcatgggttaccttggggaagctattctaaacacgcgtttccttgtctgcaaaacaagagtgataatagtacttggcacatacagttgttgtgaggttaaaaattattatgcaaaatgcttaacatgtaatgagtgctcagtatctcttagtaattatcattattactattactgggtagcgtaggaaaaaaaggctattaaagattgtgataccacttttaaattctgtaactgtcctgggctagagggtttcaaaaacttggttggtttatggtaccttaagtgtctcagtagtttttctcatggcttccctaggccgaaaatacctaatggtttcatttattaagtatttagatccaaagaacttagtgtttacatcctaaaaacttagtagccgtttttttttttaaatacacacatagtgaaaaatatttttatttaaaaattaaaatgttttattttaagcaaccaaaatttctagtatatacactgcacaacctcccaaatttggatgtggccactgtcatttcctgttccacactgatttttgcacagtacttactttttttcacagcaaccactaacagccaagcttctcaaagatgtggtggcattgaaaggaatgtagtaaaacgatctaatgttcaaacggaactacttggacatttttctccaaacttagaatgtgccacactaggccaggtgcagtggctcacacctgtaatcccagcactttcggaggccaaggcgggcggatcacctgaggtcgaaagttcaagaccagcctgaccaacatggagaaaccctgtctctactaaaaacacaaaaattagccgggcgtggtggcgcatgcctgtactcccagctactcgggaggctgaggcaggagaatcccttgaacctgggaggtggaggttgcggtgagccgcgattgcaccactgtgctctagcctgggcaacaagagcaaaactccatctcaaaaaaaaagatatgccacactaacatgtgatttcactgcagtgcctgagggcctctcggcacatacatagtaactgcaattctgtttttgtttttgtttttgttttgagacaaagtctcattctgttgctcaggctggagtgtagtggcgtgatctcggctcactgcagcctccgcctcccgagttcaagtgattcttgtggctcagccttgggagtaggtaggattataggtgcccgccaccaaacctgactaatttttgtatttttagtaggggtttcaccatgttgtccaggctggtttcaaactcctgacctcaggtgatccccctgcctcggcctcccaaagtgctgggatcacaggcatgagccaccgtgcccggcctagtaactgcagttctaagccgcaaatcttgaaagaggaatggtttatcattgtagtttattcagccaataggctgaaaaaagatttgcgattgtgccttttagaacaaaacagttacaggttgagcatctctcgtctaaaatgcttgggaccagcagtatatcggatatttttcgattttggaatatctgcattatatactcatcagctgagcatccttaatctgaaaattcaaaatccaaaaagctctactgagcatttccttttttttttttttttgagatggagtctcgctctgttgcccaggatggagtgcagtggcgcgatctcggctcactgcaacttccgcctcccaggttcaagcaattctctgcctcggcctcccaagtaactgggattacaggtgcctgcaaccacgcctggctaatttttgtatttttagtagagacggcatttcaccatcttggccaggctggtcttgaactcgtgaccttgtgatccacctgcctcggcctcccaaagtgctgggattacaggtgtgagccaccaggtccggcctgagcatttcctttgagtgtcatgttggcactcaaaaagtttcagattctgaagcgttttaaatttcagatttttggattagatatcctcaacctgtaataactttagagaaaagatcaaatttgggccgggcacggcggctcacacccataatcccaacattttgggaggctgaggcaggctgatcacctgaggtcaggagttcaagaccagcctggccaacatgacaaaaccaaaccctgtctctactaaaaatataaaaattagccaatcccagcttctggggaggctgaggcaggagaatcccttgaacctgagaggcaaaggttgaagtgagcccagatggtgccattgtgctccagcctaggtgacacagtgagactctgtctcaaaaaaaaaaaaaaaaaaaaatctgaccaagacccatggtttttattcgttataatgaggtagtggtagtaaatcaggggaagaggatttatgatagaagtagtcctgaatattggccgggcacggtggctcacgcctgtaatcccagcactttaggaggctgaggcaggcagatcacgaggtcaggagatcaagaccgtcctggctgacatggtgaaaccccatctctactaaaaatacaaaaaaattagccgggcgtggtggcaggcacctgtagtcccagctactcaggaggctgaggcaggagaatggcatgaacccaggaggcagagtgtgaagtgagcggagatcatgccactgtactccagccctggtgacagagcgagactccgtatcaaaaaaaaaaaaggaaatgtcctgaatatgaacattggacaaagcaatgaagttatacttactaaatttctaaattataatttcatactcaagcatcaaaatgccttgtagagagacctttaagccaaaaaagtttattttgaatggtaatacttgttaaaaaaatgtttaataagtctttattaattgcagactttgatttgtgataggaatgtgttcctctagtaaattggtgcttttttttcaggcagtagcaggtttgttggcagatgctcgttctttagcagacatagcaagagaagaagcttccaacttcagatctaactttggctacaacattccactaaaagtaagttgataacatattgaggaaccttttggacagtaatagaagtttattaataagctcttctgcttccctccatagcatcttgcagacagagtggccatgtatgtgcatgcatatacactctacagtgctgttagaccttttggctgcaggtaagaaattttgtgaattattcaaaaggcagatctgtactatagatatttattatgttccccagcatcttagccttttacatacttaaaaatagaaactcttgtcgataagtattagggcaatgattaaataaaacagtgtacatagaaactacttgaggctgggtgccatggctcaagcctgtaatcccagtactttgggaggttgaggtgggaggatccctcgcgcccaggagtatgagaccagcctggccaacgcagtgagaacctatctctacaaaaaaaatttaaaatttagccaggtgcagtatcacatgcctgtagtcacagctacttaggagctgcttgagaggatcatttgagcccaggagttgaaggctggaatgagctgtggccataccactgtactctagctggcgcaatagagactctgcctctttaaaaaaaaaaaaaaaaaaaaaaaaaaggtttcaatagtgaaaaggactatatagatctgaagtgattataaaacaaggaactgataacaatgactttaatctgattataataagctctcggtgttagtccctgatattcttaggtaattttaaaaattacgtctcacaattcccattaggcacggtttctctttctgttgaagtgctgatattttattgtggggtaaagtggagattcagctgcataaagacctggaataggtataaatattcaaatttggcttcacagagaagacttgtgactagatttttctaaaatgaaaagacatgtttggcttatgacttaaaacagtcaaacatgtttggtcaaaataatacatatactaacatctgagtgctcagctgtagtcctacctttgagttgtttatcatcagtcatatttaattactaagatattaaagaaaacttgagttttattctattggtaatattacattagggttttatgtttttactttttgagacagttactgtcacctgagctggagtgcagtggtgccatcatggctgactgcagctttgacctggctcaagcgatgctcctacctcagcctcccaagtagctgggaccacaggcatgggccaccatgcctggctaattaacaaaatttttttttgtagagacggggtctcaccatgctgcccaggctgacattagtcattcttaagcttctcagttaaattacattatgaaacactttgttttcagaccatgtaaaatacctttcaactgagctctgagttcatcagttaacttctctactctttttaagggagtaagaatagtagagataactttttttcataactttttttttgtttgttttgttttgttttgagatggagtctcgctctgtcgcccaggctggaatgcagtggcacgatctcaggtcactgcaacctctgcctcccgggttcaagctattctcctgcctcaacctcctgagtagcagggattacaagcacctgccaccacgcccggctaatttttttatttttagtacagtcagggtttcgccatgttggccaggctggtctcaaactcctgacctcaagtgatccacctcagcctcccaaagtgctgggattacaggcgtgagccaccgcactgggccagagagaacttttttagtaaacatctattgggcactgagttagtcataaatgtggagacacaggtgtgaagtcacattgataaaatattagtgatatgataaagggacaacaattagggaacggactctttctggacaggaggcaaggaagagtgtgagatgtagggagacttggtagttgcaagcacaggaactggtatgaaaatacgtgcgccagagagagttaagtatgcttggtgtgtagagtatgaggtttagagatgatactgatgtaggaaggggtccagtcatataaaagtctgtgctccatgctgattttcttcaaagaaatgttgaaaggctttaaaatagtgacaatgagctatatatcctgaaggataagtctcatatcggtagaaaatggaaggaaatgacggtagggatgggaattgaatagttaaaatattccgcatataagatgatgtgtaagatgctgctgatttcttttctactctaaggcaaatatagttgtcccttggtatttgtgggggattggttttaggacctcccatgaataccaaaatccaaggttgctgaagtccctgatataaaatggttaagtatttgcatataacctgtgcatatcctcctgtatgttgtcatctctagattacttgcaatacctaacacagtgtaaatagctgttacactgtattgtttagggaataatgacaagaaaatcacagttgttcagtacagaagcaatgttttttgaaagttttctatctgtggtttgttgaatccacagatgcagaactcatggaaacagtgcccactgtatgtcacaatttcagaaaatcagtatttcatacaatcagctaatagcctaatttgttgagcacagaaaaatacactgaaccaattctgattattgcagagaaatgattggcaggatattgggaaatagaacgaagggtggaaagaatttcacatggattcagtatactctccgtcaggaattttgttcccttgatctttttgtgtttatgccttatttattgggccctctcatagttgtggttttcatctatcgttactcctttccctgtactgctagactttccaggagaccttcatcagaaagattaatactaaacaaacaaaagctacatgaattttgaataatctcatgtaatagttttaattaattgaaaccactgtttcaaagtacttactgagttatatgtgtattagtaatttatctcagaaagaaaatataactgcattttaaaataattttttcacaaatacttttatgttattgccatggtttaagctgtttgtatactttcatgcagtttcatgttagggtcttacagtgtgaatgacggtgcgcaactctacatgattgacccatcaggtgtttcatacgtgagtaattttgaatcatttgaaattctattttagtttaatggtatttcattagcatttaagtctcattataagattatatgaaattaaaaaaaaactcattcaaggaaagtaatttttcttttttttttttttacaacaacctcttgtccaacagaattttttttttttttcctttttgggggaacagggtctcactgtggcccaggctggagcacagtggtgtgatcacagctcactgcaacctctgcctcccaggttcaaacagttcttctgcctcagcctcccgggtagctgggattacaggtgtgcaccacctggctaattttttttatttttagtagaaacaggcctttgccatgttggccagactggtcttgaattccagtcctcaagagatctacccacctgggtctcccaaagtgcgagtattacaggtgtgagccaccaggcccagccatgttttcttatcattaataactgatacgaggcagaggaaagattttttttcagtatgttatttatagaaactgtatagtgcatatagtattttgaatatgtgattttcctttattactataaacactgtcttaaaactgtatttaatgtcttttttcctcattcttgcccaggctggagtgcagtgacacaatcatagctcacttcagcctctcaactcctgggctcaggcgatcctcctacctaagcctcccaagtagctgggactacaggctcatgccaccatgcctagctaatttttgtatttttttggtgtctatagagacaaggtctttccacgttcccagggctggtctcaaactcctggccttaagcagtcctcctgccttggactcccaaaatgctgggactacaggcgtgagcatcgatgtccagccatgtcatcccttttattttatttatttataagatggagtgtcactctgtctcccaggctggagtgcagtggctcgatcttggttcactgcaacctcttccgcctcctaggttcaagcaattctcctgtctcagcctcctgattagctgggattacaggcatgtactaccatgcctggttaatttttgtatttttagtacagatggggttttgccatgttggccagctggtctccaactcctgacctcaggtggtctgcccaccccggcctgccaaagtgcaaggattacaggcgtgagccacagtgccggacctaattttgtttcagacagcgtctcgctctgtcacccagactggagtgcagtggcgccaaacctccacctccccagttcaagcaattctgcctcagcctcccgagtaggctgggattagaagcatgcatcaccacacccggctaatttttgtattttcagtagagacgaggtttcaccatgttagccaggctggtctcgaactcctgatctcaagtaatccgcccaccttggtctcccaaaatgctgggattataggtgtgagccaccttgccctgccttcccttttaaagagaaggtttaaatgtgatttctaagagctttccctaaattattaccatttttttttttttttgagacagagtcttgctctgttgcccaggctggactgcagtggtgcaatcttggctcactgtaacctctgcctcccggattcaagggattcttgtgcctcagcctctcaagtagctgggattacaggcctgtaccatcacacctggctaatttttgtatttttagtagagacagactttcaccatgttgcccaggctggtctggaactcctggcctcaagtgatccacgtgcctcagattcccaaagtgctgggattacaagcactttgtgtgagccactgcacccggcctgttaccgtttcttaactgttttcttatccttacatttttgtcgtttttactaattgaagaaaatgaagattcttaaatatattttgctgtaacagaagtatatatgtgtacatcctttttttttttttttttgatggagtctcactctgttgcccaggctggagtgcagtggcgcggtctcagctcactgcaacctctgcctcccagattcaagcgattctcctgcctcagcctctggagtagctggcattacaggcacctgccaccacacctagctaatttttttgtatttttagtagagacagggttttacaatgttggccaggccggtctccaactcctgacctgaggtgatctgcccaccttggccttccatagtgctgggattacaggcatgacccaccacacccagctgtgcatccttatctttaaaaaaatttacaaaataataaaattgggggtttagagtactgaactcataggaattaactttatttctgtctctcaggaatatataatttcatttttcattgtcatagtgctaaaatcttttccgttcctgttccccaaaatgtcttaaagtgtatatgattacataatttacatatttttggatatacctttattaaaaatacaggttgttttggaattgtttggtattttagtatttttgagccctttggcattcatcagaatgtgtttgactatatttttctatacttgcttttaaaagtcatttagcatcctttcactaggttatagaaacattagtagtcattaattacatatgatagtgtactaattcagtgattatatatatttttttctaaatagggttattggggctgtgccatcggcaaagccaggcaagctgcaaagacggaaatagagaagcttcaggtaataattaatgcttgaatttttactatgtcgtcatcctaatgcagtgaaattttatcaccacagacatttcagtctaaggcagggatgtccaatcatttggcttccctgggccacacataaaatacaccaacactgatgatagctgatgagcttaaaaaaaaatctcatcatgtgttaagaaagtttacgaatttgtgtttggccccatgtggcctgtggctggggaagctcggtgtaaggatatagtgtggtttgatgttgagagtttatgaagctgctaagtcactgaatgggaaagctggtaacatattatctgtagagttgtgttatacatccctttatagattctgaataactgctataaagcctcaatctagaaaaacacaacttttgatatgatttcacaaaatccttgaaacctatttatgaatctctgtgagctctagtttgaaaattttgtttaaaattttgagttaataaaaagttatatttttcctatattctttctttggaacacagcttttatgtctggctgtgctccaccggttctcttagctttgctcctagccaggtaaggcataaagcctacactcttacgactacccactttttctttcacaaaattcagctattagtgtgaaaaagttttcttaaaaacttggttttccttttagccatgcgttgatcaacttaaagacttcatggatactgtttcaatattattgattacctgtcagaaacttgcctaaaaagcaggcataccatttatcagtgttttggtaaactgaagtgagatacaatttcacatacatttaatgttaatgctgtactagaaccctgctcaactaattactcattcaacttatttaagaccagcttctagaaaatacttattagtgcttggcatttatacaatgctaagttctagaaccccctataaaacctaatttgtttcgtattttagtaaagctgacaaaaggatcttagaggtcatttagcccaagctcaactgcagattaaacacactgcataggaccacagaatcagctggttctgaacagtatccagaccttatgagtcttagacctatgttcttttccattgcacacttactagtatgatgctaggttcctatcttctactcttttccttttgttttcatctctccatactattatatggaaatttgaaaattagaatatttatgtcagttgagggggattacccctgtaatcctaccagtttggtaggccaagttgggaggactgcttgagcccagtagttccaagaccaggctgggcaaaagagtaagaccctatctcccaaaacaaaatgttagcgaggtgaggtggtgcgtgcctgtagtcccagctacttgggaggctgaggcaggaggactgtttgagccccagccaggagttgggggctacagtgagctatgatcacgccactgcactccagccagggcaacagagcgacaccttatctcaaaaaaataaaggaaattagaatatttagagcagttactatctgtctttctgtagttaaatcctagcaaggaatgggaaaaacaataaatcccagagaaaaatcaagaaaaaaaaatcactttaattgaggaacactttcagtttgtgacaaaattatgctgtgaatcaggtgttgcaaattatggcccactgcctgcttttgtgtaagttttattggaacacagctacattcagtccatggctgcttttagaatacaacagtagactttaacatttggaacagggaacagaaaccagagccatacagctaataaacttgaaaatatttacaagttgatgctttacaaaatccatctgctgacccctgctctgtaccattgttctcttctgatggtctgtttactaaaaaataaaaacttcacaaacatgtaaaaaatagatttgccatttaaaatgtgcttttcaagtttgactttttaggatgcaattaattcactaaatacagaacttaactaaggacaaaaatttaaagatcagcattctttcccttcccatcacgctcaacttaacatgaagaactgtaaacatcctaagcttacaacaaacctatctagttagacttcagttaaccacttacacatccccctcccccatgaactatttggaaaaagctgcaggcgtaatattggatccctaaatactttattctccttataccattatcagacccaagtatcatctaatagtccataatcaaactgcctaagcagtttctacactgtctttttaactatttcaaactatcaaggttcgcattttcttccttagaacttttagtctttttcttccccaaaatatttgagtccatgccagttgcctttagttgtacccaaataatggtttgtctatttcctaaaagtagtactcttaaatttaaatttagtgttatttttgttgtcattgttccttcttcctcatgtggttgtgcaggcagagcttgagcatccagatttcaaaattaaaaaataaaagataatctagtttaatatatagtagttgaatcaccttaagtctagactgctgtatgagcacccattatctttcactatattccatcatcccccaacatatccacagtagatgaagggcagtttgctcaaacattgttttgatcctgtcatgtctgttcagaaatgcctgtctattcagaaacccacgtctaataacaaaatcttggactggttactatcaaaacccaacaacatacagactcctcagctaggccctagggatatttttctaccttgatttccaaatgttcattgaaagaatgcttaattctaatttggaaaaaagtttttggcttcccacttctgctttacacgttcatctttcttgaaatcaaatccaatccaatctatattctaagaacctgctcaaatcttggttcttcaaagctttccctggtattttgcatttttgctttgaatagttccacgaaggataacttcttactccttccttcatctttctgtatcttgcatatagtaaatattaatgacttgtttgcattttgttatcctaacttggctataaagaaaatcagatgtcttcaccagtcgttcaaacttcaggtctgcctacagattcatagatggctgtggatttttataattttgtcacaaagttagtggtaactacaggttatctcagaatatcttttttggcgtataaatttttttcttttccttttttagacagtctctctctctgtcgcccaggctagagtgcagtggcgtgatcccggctcactacaacctctgcctcctgggttcaagagattcttaggcctcagcctcccgagtagctagggttacaggcgcgcaccacctccatgcccagctcttttgtatttttaagtagagacagggtttcaccatgttggtcaggctggtctcgaacttctgacttcaggcaatccggccgcctcggcctcccaaagtgctgggattacaggcacaagccactgcacccagcctggagtataaatttcaaaacattaaaatatgaatcaggaaacttcgattctggtctttttcagactttaggttattttccttggttttatatctgagtataaaagtgaaaatagttattacacaagtggaaaatgttcttctgatgaacagtatacattttattttctatagatgaaagaaatgacctgccgtgatatcgttaaagaagttgcaaaaatgtaagttgaaatttttcttaccatccacaaaaatatttcatttgacctttgcatatatatattacattaatcctaagaagctgttttcctgtaaaataacttagtgtataatttttagaaggtaaatttaacattctaagaagcctcacgaaggaagaaaatgtttttaagcaatattttttagtagtaatgaataggatgggaaaaatagcttgacaaaataaactcctgttacaggttaaggacatataccattagggtcttaatttgttagctcccaacttctcaaatctcttaagtcctaataatagtaatcttaagattgcctctattgtaagaatgcttacaaactttataggttacaactaattatttcaatacatgatccatgaagctggctcatttatataatctgctatttatttgggaaagatatgtttcactttttcaggtttattataaaagttcctataacaaggtaagaagagcagtattacaaaacatttcaacaaccagcttaagaaaccctgaatagtttattacaggtatataaagtagaatactattaatatgtaacaggtatttggacagtaaacaataaaaaagtcaattaacctgggtagtgatgtttctaaaattttgtgattctctagatcaaagagtgtagacatttggtattacaaaaagattccaacaaaatacgttgtgtagccagctttttagattcaaaagttatggataatcgtaattcataacaactctaagtattccacattagaactacataaacaaggtctagtcaatcacctgtctgtatggtagtgtatcaggttttacatctaacaatacgtggaagaaaaaaattccaatgggctctattgtttaataaacatactatttacatcacactcagagtctcttattaaccggtccatcattactgctactgcctttacccctcttgccacctcctcccctccgccctcctagtttcagttgtgaagcaagcagaagccattctatgattgtcagttaataatggcaacactaggaaccaacatgcagcagagctgctaagaaaggaagtcagatatcttccttgaattgtatagtatgttatcatgatatactctgtttccttcaccgaaccaatcctttgaagtccttctggaaatcagttcttaccatcttttatatttaggtataatggtagtcatctgttaagtgttccatgttaggaaagccatcccttcatcatttaagaaaatggagcagcatgttatcttttacttagttgtagaaaatcaagatcctctcatattatagcaaggttttagaagaccctccaaaaagtaaggtatgtaactcagtgcatagtattagataaagctatactctgctactgtacttaatttgatacttttttttttttgagatggagtctcactctgtcgtccagactggagggcagtggcacgatcttggctcactgcaacctccgcctcccgtgttcaagcaattctcctgcatcagcctctcaagtagctgggattacaggcgcccaccaccacacctggctaatttttgtatttttagtagagacaggctttaccatcttggccaggctggtcttgaactcctgaccttgtgatccacccaccttggcctcccaaagtgctgggattacagatgtgaaccaccgcacctggcctcttgatactttttatgttactttaatatgttgcatgacagtgcctccttctttgctgtaatttgtaaggtactacaatgtgaaggccaggttatgtggcatatatgccattataaaatggacaaggagcttaaaaagactactgccaagaagctataggttgaagagaccactaataattgcaagcacataaattagtttttttttttttatttttttgaaacagagtctcactctgttgcccaggctggagtgcagtgtcgtgatctcagctcactgcagcccctacctcctgggttcaagcaagtctcctgcctcagtttcccgagtagttgggactacaggcctatggccacctcacctggctaatttttgtatttttagtagagacgtgggttcaccatgttggccaggatggtctcgaactcctgacctcatgatccacccgcctctgcctccccaaagtgctaggattacaggcacgagccaccatgtccagccaattagttggttttaaatatatttaagttaatggacaaaatattctaaaagggcacagttaatgacgcctcttcctagtgaatccgtgttctttatgaggtatcttttatagttgtatctttttttttttctgagatggagtctcgctctactgtagcccaggatggagtgcagtagtgtgatcttggctcactgcaacccctgcctcccgggttcaaggaattctcctgccttagcctcctgagtagctgagattacaggcgcccaccaccacacctggctgatttttgtttcttagtagagacagggtttcaccatgttggccaggctagtctcgaactgacctcaagtgatccatccgccttggtctcccaaagtgttgggattacaggtgtgagccactgtgcccagccaagttatatctctaaagcaatgtgcaaaaataaactgaacttgggttgattaggtatattcaacatttgtcgggagagtagatgtttcattttatttcagtccctgtgtaatttgtcttctctaatgttaaatactatgtagaatgtgtctgtgtaattttatagatacttttattatggatggacattctaatttgtactgactttgggtctgtgaactacttcaatgtttggaggttaccaaaatcttacctttcccttttctattctagaatttacatagtacatgacgaagttaaggataaagcttttgaactagaactcagctgggttggtgaatgtaagttatttttgtacatttatttgccttaggaatgatctgtaccacagctaatttacaactgagtgtcctttctaatataatgaaagctaaagcaaatttactaggttgtctaatgaagggaaagttctgcttaataattgacttaagttgtgaacacgttattttttgaaacatccatttcatggttttaagatattatgctataaattaatgctcaggatttataaatagcataatttactttcatttccataagaacttaatatgtaggcacatataatctcatgtagaagcagcacacaaaaatattcgagtattactcatagtacaactttgcaaccttaggtgagtcagatatgtggattgggtagatcctatggtatactgcaagttacaatatggtactcaatttaaaattcatttacacatgtggcttaatttacagtaactaatggaagacatgaaattgttccaaaagatataagagaagaagcagagaaatatgctaaggtaagccacagcacaaaaacttctcttggccaggtacagtcagggaatctcttagcccaggagtttgagaccagcctgagcagcacagcaagacccccatccctaatttaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccactttcatatgaagtaactggtggtcatcagtcactgttaatctttagatgtgatacagatgacagatgtttcagttttggataatttttcaaaaactgacccttctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaagcaccaccatgcttggctaacttttaaaaattttttgtagagaccgcatctcactatgttgcccaggctggtcttgaactcctggacttgagcaatctgttcacctcagcctcctaaaatgctgaaattacaggcatgagccaccgggcctggccacaactcatatatttaactgtgaatgacacaagtgttggtcttagaaaaatacaggaacaatactaaattggatccatttacagacaggtaaattgactatccctaagccaatctatggtcattcctatactttcccaaagttccaaagtatgaatgtcacatgaatgttgaattcttctttgaatgtatctattcttaaaatttacaccagcatagttaaaaccctctttgaaagacactggttctaaagagacccaaatatgagcagctaagctactatagatgccataatataagcagatatacctagttcttcaactcttatgaaagaaagaacatcgagtgacgtgcttttctttttttgagatggagtctcgctctgttgcttaagctgaagtgcagtgacatgatctcgactcactgcaacctctgcctcacgggttgaagagagtctcctgcctcagcctcccaagtagctgggactacaggcacctgccaccatgcctgactaatgtttgcatttttagtagaaatggggtttcactatattagccaggctggtctcgaactcctgaccttgtgatctgccagccttggcctcccaaagtgctgggattacaggcgtgagccaccatgcccggccaccaagtgattttcatacacactgaacaggattaacaaatgtaggttcaattgtaaggatactttgtaaccactgatgag

SEQ ID NO: 13450 - DNA, 15230 bp, Human
gggagccacttggaaagtaaaaatcaaaggtgtaacttctcaagttataataagatatacctcctcttaactgtaagttttatcctcatgacaattgtcccctaacagttttctgtttaaacagaatgtgggtgtttcttattcctccttacaaaatatagttctgtctgtgatggaacttgcagctgtgattatgtcaagctggggatttccaggaccctgtccaccagtaccgtggtgcatctttctaggccacctagttcttctgctccagctgtggtctctttctcctggatatcccagcaataactcagctaatacatctccccatgcctaccccaccctacactagtggacaggtgctttctatgatgtggtctctgactatctctccagcctcattccttagctgtaggattgtgcacaggtctctaaacagttgtgtgttcttaggtatctgcacatggctgattttgtgttttgtttttttaaaataaaaagatgaagtttctgtttctcgcccacgtggagtgctggagacagtggtgtaatcatggctccctgcagtcttgaactcctgggctcaagtgatcctcctgccttggcctcccaaagtactgggactataagccacttttttttaaccgagatcacccagtctttgcctttctttgcataatcaagccctatttactgttaaggctcagttcaagtagtgttaccacttttgggaaagttcacgtaatctgaatttttctgtgttcatcatagcactccttccacagtattagaatttttttaaaatttcctttatttttctttacactgtgagaacacctgaaggctgggaataccttttatgtttttatctcactgcctaaaatagtggcatataggaaatgctaagatgtctgagaaagacgacaatgattgcttgctctccagcaaagttaataatcactataatctcatgatgatatttgcaatggcttctacatttttgcgttttgattttgtttttttttagtttcgcaagagggaagtcctgaaagaaatagatgtgaactatgttccttcgcctcctcctcccacgtagattgacttatacctggaacagctagcagtactaggtgtcattgggaactgatttcttttttcctgcttacaatatgaaggttttttggatccttttgtcttaaagagaaaaatatataggccccaaattctgccttttaaccccttaagtgatttggaagtattcactttaacattggttttaatcctacttttacttttttgaagtaccctatgatgagaggacctgatcctgctgctgctccatatagtactcagaaatcatctgttctacctctttatgaagtaagttctttcttacatctttgtgttccaaaataatttgtagaatttagaagtgtaattttgttatattgcattctagaatacttttcaggagctccaggtaatgaggcggagcctgaatttgtttagaacacaaatgatggatttagaattggcaatgctgcgtcagcaaaccatggtttatcatcatatgactgaggaggagaggtaaaagttcattttgtcttagcacacctcaaaaagcttttcattcaaagtcttctcaacttatattttttaaaattaggttttgattctactgctgtgtaccttgtatctgttttgtgaaccagtgtagataagattagtcatagatagtgttttactaagtaaacttgtatgccttcaatatcctaagggtagtggtaacctgctttcccgtgtttgagatatttgtgagaggataggggaagaaagactaatgtccttgtggatacacctattgtagttgatattgtactaatttctagaacctgagatttccatgccttctgttagcatatagtagttgttgaaagatttgtgattaggaatctccaaactgcatttttccaattttgtgcccttcaccataccaataggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtacgctacctggagggtggtcggagttttcaccaaaggtttatttataatgttccaataatttaggacgtgtgccttcatttcaagtcatttattttaatggtattaaaagcatgcatactgtttaaggagctttcccacaaatcagttgaatgtacaatttgtaataattgtcataaatagtatatttagaaatatgttgaaaatttttaatgataaattttaataacaggaaagaataagggcttatacgaaagttgagggtttttaaaggaaaaatgctagtgaattaacatatgactaatgtaaattttaattgttgcatgtaactgcagagaacacagatgcatattttgctgtttttttttctttcatgcctttaaataaaaaagtgttccttttaaactttttctttattttggattcttttccatttgtttttaaaggaatcaaatgatacctgtatattttcatacatatatatacatacacatacatatatgtattttcctaaatatatagatatatatccaagagaataaaaagaaacatgtttttgtaccacttttcatacttctaatgtttctttccataacatttgaacttcaacagttgtattatttttgcaaatatctttgaagttgtagaatatgttgctttgaaatgctgaaatagtgaattattctttgttaccttaacaatgtatttgattttgttaaaaagaaatggatgaatatacacacatacaattatgtgtgtatatactataaatgaagtagaataaacaatggtgtataaacacatatatgtatagcatagactaaggatgttctgtattgctaatgaatgtacttttcaacatggttttgatttatcattctgagaagtgtatgttggtgacgggagaactagaacatcctttttgcatattgtatcagttttaactcacaataatgcattttatgggatctgtgacacttgagagtaacctttgtgacataaagggatgcttccaggcactaattagccaattaattttattataaaagtcttgtgatttgaaaaaatatatatgtacattataattatatatgcatgtatgtatatatacacacacatatacatatatatattgttcttaccttttcagggaatgtgtggcagtagaagcgctgataacttgtcatgcccttctccattgaatgtaatggaaccagtaagcttctttcctcttaaatcactggggaagggaatgatacaacatttcagacacatagtttccctagtttagatgaaatatatgtttattttaaatacataatttgataaattattgttgattggaagtgactttcacctttgaaagtccattgctgtctgaagccactagaaagccacctgaattgcaatagtgatttatctttctgactaaaggaggtaatgcaccataaaaacatgtacagtggctcatgcctgtaatcccagcactttatttaaatggttgaggtggaaggattgcttcaagccaggagtttgagaccagcctagtcaacaaaatgagaccctttctctacagaaaatttaaaaatcagccaggcatggtgatatgtgcctgtagtcccagttactcaggaggctgaggcgggaggattgcttgaggccaggagctcaaggctacagtgagctatgattgtgccactgcactccagcctgggtgacagagcaagaccctgtctttaaaaaataataagccaggtgtggtggctcatgcctgtaatcccagcattttgggaggctgaggcaagtggatcacctgaggtcaggagttgaagaccagcctgaccaacatggtgaaaccgcatctctactaaaaatacaaaaattagctgggcatggtggcaggcatctgtaatcccagctacttgggaggctgaggcaggagacttgcttgaacccgggaggcggaggttgcagtgagccgagatcaagccattgcactccagcctgggtgacagagtgagactccatctcaaaaaaaaaaagaaaattgatttttaatttacatttcaggagacatgtgctttcacagtttgatcctggttctttaggtagttagagctgtaacatgaccacgtttttaacagaaatctgtctttattgtgttagacagattggttcatttgggggcaaaagcactatgagtaactatttttcactagttactcttccttacaagtgatttggacactttggtggtaacaagtaaaatttcatcctactatgtattctgtttacctgttttgttgcttcatctcaataggaatttaaattttacttaccatttttgcaaataaaattgagtagttattaaattaatggaatagatttatgtctttacaaattacatgattttaggcaataatgacaaccaggactttaacctttttagctaccaatcttaattccaagagagaagaataacatttttttatgatctccaggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggtgggtaaaatctgtgtttcattcatttatttggaggtatatgttagaggagattttgtctgaatattaattatttacagaatgttcttttgattcactgtattcaataattttcacagagcttttaaattagctttcctgttgatcaagtttgtgtcaattaagatatatttgtaatggcatttctgcaaatttcatactctaatgtgaaataattacaattctctgtgttcagtatggtgaaaaagatatgtgaaggactcaaaataaacatgacgtactctttggacctcttgtttccacatctacaaaatgaggatttacagtttagatctcttcgaggattaaaaactgcattttatagctggacgtggtggcatgtgcctgtagtcccagctactcgggaggctggggtaggagaattgcttgaacctgggaggcggaggttgcagtgagccaagatcatgccattgcactccagcctgggcagcagagcaagactccatctcaaaaaaaaaagaaactgcattttataattacaattgataggagaaaatgattttgtgattttaataagtataaatagattgatttggtttggtgttttttattcaaaaatcaaaatatacgaagaaaagagggtttgccctaggtgatagcagcataagaacttgaagaattaccatagttatggatgaccaaaagaactgcaaaaggaaattacatatgattagtagtgaaagttcaaaagttgagaaaattagtaaaataaatgttttttgcactgagatcaggtaataggaaggaatagaatatatcgtttaaacagctcaatgcaattatctctgtttacctagtagtattctgtggattaaattgtacataagcaaatgtgaaatttgctgtatatgcagttctctagtatttcaatcatgttgaatcaaatcacattttcaaaacaagcattatagcagaagacttcatatctgtaatttattttcatgatatgactctaccaactaaatgtttaaaaggtcttaattctataaatttatttttcctacaaatgtaattatttttgtaaattggttttggctgcctaatgtttagcaaactcagcattcaccctactcggtcaggtgtgtctatgattaataatccattcctgtttacatgttttatatcaaagattagtttttgagtgaaattatgtaattattcttctccacactatatttgctaactgaggaagcgggttttaaggtaatttttttttttctagaaatgtgatggttttgttccccttagcttgctttggtatgaaagttttctttgaaaactttatattgctcttttaaaacaaatactccattcaatgcacacttgaatcctcatttttagaattttaatggcctgatatgtcctgtaggtgatttcctaagaataaagtgttcatttcagactagaacattgattctttggcttataagacacagcatatagaaaatttagttattcccattaggctgccttggtcctagagaattaatcatttaaaagaacctctcattaaatatgaaagattttataatttgcaaacacttaagctggtatgcaaggcaaatgttcaaagaatttttcagaatttgttatttaaaccattaattagaaactacttagttctgaatttggcataggcttgaggaaattgggtttaacatttattcttttactgtctacaaagggcctacccagcaaaatatgtatagatcaaacaaggcataagaggagtattgttgtacttaagaaaacaaattattttgaagtactttaaaagcatatttaatagtttaatgccagttataatttaaaaaattatgttaatattctcttagttacaatagttttctgtttataaagtatttaaaatttagtttggtttttattccagtcattcaaattggtaacctttttacctaaatacatactgtactaaattccaattttttaaaatcttggtgtacagctaccaagaaaattaaattagattctgtcttcctagcagatctgagcccctaatcccattaacaaagccaccattcaggaaggcaagatttaatcttgggttgaacagttttgcaggtgaggattaagcatgtttggcaggcactttcaggaaagttttcttactgcgttcatggatgcatgaaaacaatggtatctgtcaggcctttgtttctttcgttgtaccattaagtgaggtttttaaaaagagggttttcatcatttataatgtgttaatacagtagaattctttttttgaaggacaacattgaaagtcttttcagacaaatatttaatacactaattacatagctaaacttttgtcatattaaagatacctcttttctgcatgtgcattgtactaggaaaaaagtacacactgtcttaaaatttgcccaagtcatctgtgatgtatgtgatcagtggcctgaaactgtttgcagttactttaaaaatgtataaatgtgtgtaaataaaaagattacttaataggatgaatgaatacatgcccacagaagccaattcagcaaaattaaatgtcaaggagtaaacatagattgctttgtgtttagagagttatttgttaattagagttcatagacttgattcatgccttttgggatctttattagagcacgtctgacatgttttacccatgtattttggtaaatacacagcttgctcatgtgttcttatggaaatttcttttagtgatcacttgtaatagctgccacttagtaggcactcagtaagtgcataataagtggatgtgttcccacatacttcagacttgtagtcagtctttttgtattgtcgatcagcatgactttctcaatctcaggtagtctgtatttagcctacatttttttggaaattatgctcataaaggtaattttaccatccatcccagggtagtttcctcacttctaatccttccaacctctccatagcatgggagactttagaactaaattatttgtccatgcatttattcattcaataaattaataaagacattgtatcattttcagggccattttatctgtagtctgctttcgtttttctgctttctcttcctttttgtgtctgatattgtctctcacccttgtgctttctcactctctcattgattcattcattcagacgcttactgagttcttactgtatgctgagatacactgataaatgagacctgacctgctcgctgaaggagctcacagtacaccttccatctgacctcacccttcctattctgattcccttctgctctctagagggaactgtcttggcagtcaggctccattatactcccctcttatttgagaccgtcttgctacagagttttctatctccactgtcatctgaaattgttctttctttgttgtgacataccatgtaaaagctgccattctctgagaattttgtcccacactagtctctcatttatcaaaattttttgttcttatgtcattaatgaatcaataaattatttttcctttagtattttatgaaaccgacgaggtgtggtggctcacgcctgtaatcacagcactttgggaggccgaggtgggcggatcacctgaggtcaggagttcgagaccagcctggccaacatggtgaaaccccatctctactaaaaatacaaaaattagccaggtgtggtggtaatcccagctatgcaggaggctgaggcaggagaattacttgaacgtgggaggcagaggttgcagtgagccgagattgcgcccctacactccactctggatgacacagcaagactctgtcacaaaaataaataaataagaaatatattttatgaaacagtattcattttgtgtccattgagattatatcatgcttgatggtagggattcttttatactttattccaataatgcctgtactcccaaaaaagattggcacacattcctggtttgtcaagaatacattttggcgactgggcgcggtggctcacgcctgtaatcccagcactttgggaggccaaggcgggtggatcacaaggtcaggagatcgagaccatcttggctaacatggtgaaaccccgtctctactaaaaatacaaaaaattagccgggcgtggtggcgggtgcctgtagtcccagctactcaggaggctgaagcaggagaatggcgtgaacccaggaggcggagcttgcagtgagccgatattgtaccgctgcactccaacctgggtgacagagtgagaatccatctcaaaaaaaaaaaaaaaaaagagaatacattttggctagtttgttttttgagtgatgaagaataatgagatataataaaatggccatattgcattggtagcaggactggaaagactatactcattgttgtgaatatagatttgcagtggtcctaattcagtatgttgtatttctgtttatatactgtgactaagagattctggtttttaaaatatttgtatccaacacatacttgtttgaaaagtaaatctgaagtgctgtgtgcttcagaatcttctgatgttgtttaaagtttagaaatattgataaaaggtaaagtgaaaagcttatagtatttaaatatattccagtacagatggttggtagctaaggagtgttttgtttctttaaataactatgtataaatctatgtattgtgtaccaattttgcatgatagactaatacaggaccatttttggaaagattatagttaagatgtgtttgagatgtacttaggaacattgtaggaaataaatcaatttggctgacaggaaactggaaatgtagaatttttaaaagcttgttgagagtatcttgagtgcttatttgggaacacattatcactttatttcaggaaatacacatttatagctttcacaaagggctatttaaaagtgatgctgtatcattagagagaaaaggtggagataggcatatgtaagtgtttggacacctgtagaagaaaatcctgatggaattgtcatttcctcaggtctgtttgccttttccaacaataaaatgagatgtatatcctcatatcctatatgcatattggaaacaaaagcttagatggctggcagtgataccatgcaactaaagaaaaagttatttctttagagtttatggttgttttgaggatgttttttatattataaaataaattgtactaaatgataatttcttcttcccattttaaatgtgttaggttgaacaatatgtctttagataccttgctgtcagttggcataaacaggcagtatacctgtatactattttgcctctaaaagattttctcagcaatgagagcacttgtgtctctgctgattaccttacaaagttagacaatactaaaaacatttaagaagtccttccagattatttttttgacatgaggtaaagtatttactagaagttttttaacttatgaaataacattttctaatgtcctcaccttatgaattgtgatatttgtaatctagttagctgaacaattctagaccagtccttgggagtctgatctgggttggatgatagatggactcgattccccactccctctctgtattgcagggagattcacatgaaggtgaaattaagaaattgaatgctatttgtattttttccaaaaacaggaaaaaatgaattccattcatattggtaaatttttgttttattgtttttccaatctagattaaagagtctattgttggggaaatcagacgggaaattgtaagtggacttttggcagcagtatcttcaagtaaagcgtctaattctaagcaagattatcattaaacagaaattataggtaaatttttctgagtttctttgttgagctaaatgtaaatagtaactggcattttattctttgttttgttagtatacaggtttggttctctagttaaattttgagttttagaatgtatgtaatatgttattttacaatgtgaaaatttcacacaagcctatttgaagtgtaagtcaaatcccataatacaaatctccaaggaattacttatattgggtcattctactgaaatttcattatagtaataaatcctggaattggaccttcaaacctgaatcttattttgattataatggtatttcagatgtatagttttaaagaacaagattttgtgaattaatcacaacttccttttttttttttttgagacagagtctcgctctgtcgcccaggctggagtgcagtggcgggatctcggctcactgcaagctccgcctcccgggttcacgccattctcctgcctcagcctcccaagtagctgggactacaggcgccagccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccgaattaatcacaacttctaagtatctttcctaattatttttatcttttaaagaaacatatcccatagattcatttctaataataatttatttcaaaaaactcttttatatgtctgtcttagtaaaacgaattactttcattttatctcgtagctctaattacattaaaaaatttttttgtagagatggggtcttgctatgttgcccacgctagtcttaaactcctagcctcaagcgatcctcctgctttagctctaacttcattttatataatatatattaataataattcttggtgaatgcaaaaagaaagaataagttgagtagaatagaactaaaaatattcattgaataagacatgagaaacaaatgtaatttgaaaagtataatatacaatttcagatataggaaattggaaagtattttaataaattatgtcacaaagcaattaataggaattattttttttaaagccagggatataagaattaactctcaggaagatgtatagagattacaggataatcatgtttctgtgtatatatatttgcataaaattctcatcttcctttaaagaagcttttaataacagtatttgaaagaggtttaaaactgacttctcttttcttttttaaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaagtgttttagtggtttcttaaactgcaacatgaagattttgaattagatttgataggtaacaaatgaggtccaaaagaattgcagcatataacccaatagagtgatactctcttttcctagggaagtgttatgatactttaaaaaaacaatgctttaaaaaatgctgtttaagactagaccaccctggagagagggcatgattgaggcctctttggcttatctagttctgtggtcatgataattaccatcagaggtcaaataaaacttctctttaaaaataagctattaaactacaaacaatagatattaaaatactatttaactctttgttcaataacagcagtaataacacctatcaaccaaatgccccaattttttttttatactttaagttttagggtacatgtgcacaacatgcaggtttgttacgtatgtatacatgtgccatgttggtgtgctgcatgcagtaactcgtcatttaacattaggtatgtctcctaatgctatccctccccccttcccccaccccacaacaggccctggtgtgtgatgttccccttcctgtgtccatgtgttctcattgttcaattcccatctatgagtgagaacatgcagtgtttggttttttgtccttgcagtagtttgctgagaatgatggtttccagcttcattcatgtccccacaaaggacatgaactcatcattttttatggctgcatagtattccatggtgtatatgtgccacattttcttaatccagtctatcattgttggacatttgggttggttccaagtctttgctattgtgaatagtgctacaataaacatacgtgtgcatgtgtctttatagcagcatgatttataatcctttgggtatatacccagtaatgggatggctgggtcaaatggtatttctagttctagatccttgaggaatcgccacactgacttccacaatggttgaactagtttacaatcccacccctaaatgccccatattaatagaaatatagtaatcaacgattttaactatttagttttgaagtcacttttagttaatttttgacaacacaagatacccagattttgataatcaaaattagaaatataacagttgcaataataggctgagacaatcagcaaattacctacatagtatatgaatcaaataagaggagtctcaacaactatcagagttttatgttccttctccccactttattgtgtacttaacatttgaaagctatcaagttcaagccaccgtgctagctgctatgtggaaatgaaaaatgaaagggtcaaaaaaaagacaaagtcaaggcatcttttaatttatggatacgtttagaagtgtcaatgaataactaaaataatttgagagactatagcctggggtggtcagagaagcctaccaaggagatgagatttgagtaaagtcttaaaagtagtcaagaacattagcaaaagttatcaagaatacatagagtttgaattaccatgtacatgatcaaagcaatactttttaaatgccaggttcattgtgtgtattgtgctaagagcttgcacaaagcatagaagagaaagaaacttgaaatggtgattttgatgtttggagttgctatgaatgatataccatgagaaaaacaggcagattttgaagtacatttcagatttgaagtacatttgaaaaattctcagatttgaagtacatttctttcctctaaatatattcagttgaatttcatacatttaaaagtaccgaatatttgctcagctggccatcttcaa

SEQ ID NO: 13451 - DNA, 139562 bp, Human
  misc_feature (1)...(139562): n = A,T,C or G
atttccgctctcagtccatagaccatctcccttagactgtccacaaacccagcctttgcccctctaaattcatcccagctgacaaccacccttcctaacacacacacatacatcttttatcgtcctgatctaccctagacggtctcatcactatactggctcctccttacccccgtaaatctcccaggtacacttcctgatcaccctccggatacctcatccctatctattccttttataaataattccctgctcctccttctcacccacaatccactcgcagttcaaggcctcattgccatcgactccactgtctgtgagtgcttcccaatatgccccaggacccctcctggtgtcacgctctgtatcctgacaccccttgtagacgagtcccgaaattcccgccccgtccctggagctcccactccctcccagacctccacaaaccttccaggcccccagccctaagcccggcaccactgtccacccttcgcggctcctgggtcctcaccgcgcccctagacaaacccggactccctctggtcccacccgcccttgcaccgcttctagccgtctcggccacccacgtgtgttcccagcccaccgaccacgctcccggcacaccctatagccccgcgctgcctccgggagagcggacggggaaagccgagggtctccgaggggcgctcgggctctggcgagaggaggaaggactcagggaagcagccggggaggcccggggctccggggagaggtcgggaaggccgaagcgctctggcgaagaggccggggaggccgaggggttcccggaagcgggccgggaggccaggggtctcaggggaggcccagcgggccgtgcagcgggcgcgtgtggcggcgagcggggcctcaccgtcagtcacggctcccatggcgtgcgcggcggatacttaaaagccacaggaatctctaccctgccacttacagactgtctcagcttcagtctctgaacggagataataataaaatccacatcagcggattgttttgaggattaaacacaaaaagttgtaaagggctttgcattgagtccaacacataataattaatattcagtaaatattaatgtcagagttgttttactaatctgtcttccactttcctttgatgtggactttgccttctctcttaatctgcacaggttgccttttcctgccttttctatcaggtgacactccacttattcctcaagacccacctcagaaatcccctcttttttttcctagaaggagttgaccttctgcctactagccatattattttatgcatattgctggtgtcacccttaatacgttatttatatgccttatgctaggaaacatttaacgcggctcactggaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggtttgttattttattcagccataccgttgttttccaattttcctgtcccccaagtagatcttgcatcttcatatccgggatgaagaagttgtgtaggataaacttggttgtttcactttccttactaaatttaggtacattctccctgttttcccccagttctttcaaagaggagaagttgcagatgcaaatgtattaaagtgaagtgtgtttaacctctagcaagaaatatgtacaattttagtcatattatgtgagaccagtgacttcaataataccattacagtgctctcaagaattagtgctcaagaacttgacttttgtcacaaagacaaaaattactttacatgaagattctgagatgtgacttgctctcccctaaggtatgaagtttccgactttgaaaaaatactgacctaaacgctggctgtaggtgggcatcatcagaccctgttcatttccttggttttaggagacagggcactctaagagaagaattgttttaaatcttaagtactacagattgtaaactgaaattgtcaattgattggggttcacaataccaagttgcattttggtggggatagttattgtttagaaagtaattgtcggccgggcgcggtggctcacgcctgtaatcccagcactttgggaggccgaggcgggaggatcacgaggtcaagagatcgagaccatcccggctaaaacggtgaaaccccgtctctactaaaaaaaaatacaaaaaattagccgggcgtagtggcgggcgcctgtagtcccagctacttgggaggctgaggcaggagaatggcgtgaacccgggaggcggagcttgcagtgagcccagatcccgccactgcactccagcctgggcgacagagcgagactccatctcaaaaaaaaaaaaaaaaaaaaaaaaaaaaaaaagaaagtaattgtcatgtggtgaaaagttttttttaagtgtttcttaatcttatcataatactgattttgaaacagtgtcagtgatttaaaataatctgtaatattttcatgggaaagtatcactgccccctgtaacttaaattttcgtgagatactctctgagttattcataaatggagtgctgttcaaacatttctataagttaatttgataacctataattttgttggatgatgctagaaattttctggagtaataagaccaagaggaatttgaaagactttaaagtttgagctgtacctgaaaataaacattcctgaaagttattttatttttttttgagacaggaccttcctctgttgcctaggctggagtgcagtggcacgatcatcagggctcactgcagcctggaactcctgggctcaagtgatcctcccatctcagcctaccaactagttgggactaccggcatgttccatgatgcctggctaagttttttatttttatttttgtagagacatgatctcactatgttgcccaggctggtctcaaactgctgggctcaagcgatcctcccgcctcagcctcccaaagtgctgggattatgggtttgagccactgtgtccagcctgaaagttcttgactcaagtggtgggaaacacataatttgagcctttatgaactctaaaatctattttgtcagctacatgattttacttgcaattgcattgacacagatctattcattgaacatttaagaattgtcttttcatcatatcgtatatctcatatatatgagagaacatcttttagtaaactttacaagtggtcttctttttacatattaacatgttgatgaatgttaaagtagcaaagactcaagcccttaccatactaatgtttcttcttttcaagacagatctttatgggcagaaacacagaaatggaagtagcagattttaagaaaactgattcagactttgaacttgtatgaccttatatttattgatttatttgagtcataagatttctgggtttttttttttttgagaatatgaaagactagttaagaaaatttgtgtgtttatttgatatttgctttctgaaaatataaaaaattatgagagagctagctatatatggtctttattctgggtctgtgaaataatgtaaggaattttgtactatgcttttagagcaagagttatcctgggggtctgtgaccctccaagggttggtttcaagggattcctgaactccctgtagttgtgaccagaactttttgtgtatgtgtatttttctggaagagggtctgtagttgttttagaaaagagatccaggacttaaaaaaattagagacacatctttttattgaataaaatggaagttagaattcttttcttttctttcttcttttttcctttttcttttgaaacagggtctcactttgttgcccagtctggaatgcaattgcatgaaactggctcactgcatccttgacctcctgggctcaagtgatcctcctgccacagcctcccagagtgctgggattacagtcatgagccatcacagaatgaccattctaaagagaaaaaaacatttttgaaaagtagatctgtgtgctcgttacttgccttttaaagttatcttcaggctgggcacagtggcttatgcctgtaatcccagcactttgagaggccaaggcgggtggatcatttgaggtaggccgaggcgggtggatcatttgaggtcagaaattcaagagcagcctggccaacatggtgaaaccccatctctaccaaaaatacaaaaaaaattatccaggcgtggtggtgtggcctgtaatcccagctactcaggaggctgaggcaggagaatcacttgaacccaggaggctgaggttgcagtgagccgagatcactacactctagcctgggcaacagagtaagacactgaaataaataaataaataacaaacaaataaataaataaagttgtcttcagacttagaggtgtaaaagcacttccattttattcccacaacaaagcattgcctatcagttgataagccaagctggtctgacgtgctagtcctgcatgtactgtggctgtgtttttaaaaaattatatctaaaaattcagaccagatcgtttgatggtagataagcaaagatttgatcttgacaccagccgttggagtaaatgggtctttcagctccactctcttctctccagaaaatttgaaatttgactcaaagggaatcattgtaagaaaatgtgtttgtgccttggcaggacagtagaacatgatgggaaaaacacagtttgagtcaaaatagacttaaaattcaaatttggtttcctttattcactgtagctacttaccctgcttgactcttcagttactcatctggatatggctaactagtagagttgttgggaggctagctagaagtttcccgtataaaagtcttagctcctctttggcccgcaagaaggacttacaagccaggtttggggaaccattaataaacatctgaggaaacatgtatattcatggtataggataataagtacattatttccaaattggtgtgatgaagatattaacacttaaaacattgttttttaagaaaaagattttcaaaaatgagttaggattgagtggtccccaaatatagatatttagaggaaagtggaaaatgatggtttatttggcagaggggaggacatggatgctgctgggcaggaagaaatgatagccacccaccagcattatatttctctctgtgggcaagattccatttaacattttctcttcacttataatctgaattaaaaaattaaaatactgcacatgtactttatagtccatcacccctaaaagtgcttcagcactcctttcgttttgagaccttcacaggtaacccagggacttcatgggtggaagttacacttataactttagttgtctaattctgctgtctttaaaatgccttcacagttgggtacctgtgttgatttttgtcaataggaaagggtctggcaggactgaatcatattttactttaaatgctgaagtaagagagggcattatgagtcaaaagaaagtgtgagatacgtaaataaaatactgtataatgcttatggccataaaaataaacttgcttctactatttctatagtcttaacctttcctgtcatttattcgtggtgatcatttatgctttctgcccttgggttgggaaatggttatgaacacagcctttaggctttgaatatggccttgattctcatttcctgagctctctggttgtgttcaacttggtccagtctccttctttgagtctagaggagatgaccattaaatgggataataaatgcaaaaaagttttgcttactcctaggctcctagtaagtactcagaaagtggtagccattttgaagacagttacattctcatctttagaaggagatatcatacatctttttcttttcttttctttttgtttttttttgagacagaggctcattgttgccaaggctggagtgcagtggcatgatcttggctcactgcaactcctgcctcccagggttcaagctattctcgtgcctcagcctccctagtagctgggattacaggcatgtgccactacgcccagctcatttttgtatttttagtagagatggggtttcgccatgctggccaggctgatcctgagctcctgacctcaggtgatccacctgcctcggcctcccaaagtgctgggattacagctgtgagctaccgcaccctgctagagatactatacatccttttaaagagaatacctttattcatccttattcccacttagaccttctggaaccatcttactttcaactcagaaaagccttttacattttcttgttatgataggcaggtatcccaacatcttgatgacctattggacttctccattgttcttagccaatggggttgcattctctattggcctggcaggttatatcaaaatcttggatatgtcaggggccaaaccaacaagcctgcacaggtttggagctgtgatccatcaaacaactgtgtgattttatagcctggaacagagatcagcaaattttctgtaaaggaccatatagtaaatattgtttactttgccagccatccaggtctctacacctactcagctctgccatgatagcaggaaaacactcatagatataaatgaatgggtatgactgtgttccaagaaatgttgatgaacactgacatttgaatttcatgcaatttttatgtgtcacgtcatattttattttttcaaccatttaaaaatgtgaaagtcattcttagctcctgttatatacaaatcttagctagatttggtccatgggccataatttgcagaatccttgcctagaatattagatgcatagatttgtggcattgccaagcaaccacccccaacatgtgcacacacacgtatgtgtgtgtgtgctcacacactgctgttttatttagcatactctgcttttggtatggcagtttgatctaatgcctcatctctttggataggatgaaacttcagtcaataagtttttattagtcatattgtgtggccgccttagcacatgcatgattctgtcaccaattaattttatttattgttaagtgttctcaccttgcccatttttttatagagcttgatgattggaccctctcagatgtgatggtttttgaagggaatcagtgcttttggagctgtcttttgcttaatgttcctattaatccttctttgccgtggaagggaagtaattaatactggcctctcaagctgctaactagacattctttcctaaaggaaatctgtatcctggccttccctattccctttctgcatgatatgtttggctttataaagcacacaaaaattcctcttgtgttctaacccctggagattagctctaggattggtgtgtacagagcatgtagatatatatgtctgtgtgtaatttcatccggccatcactgaagctctgagggctgcttcttttagtttcaccttttcactccctctacctttctctcctggccattgtgtaaggatgcagatttggtgacctgataactgctctaactgattggtttattttttgcttcgtttcctgcttttcaacattctctactgatttgcttattttgcagcaagtacactctttttggagtttaccttttcaaaacaacattgtgctgaaaataaaaccactagagattatttgggtattgtaggatttttccccctccaaatgtacagtaaatacagtataagaggcatgactcagtattttagatatagaatgcaatttaaaaaattgtttgccattttatatatagatattagaggtgtaaaatgtgttcttacttttagcatttaagggtttccttcttgttaaaaaaagtaaatttgctacatatcttttggataacagtttgggcaatatgaacccaaagtcattacaaaaaaagaaaaaaaggtaaattcacatctaggaatttaaagaaacagttggtgaagtatgcacagatgtatgtaccagattgctcacctgtcctttttttataacaaaacatagaaagtgatctaaatacctatggataggggattaagtgaattagggcctatccatgtagtggaatatgctgcaatctttaaaaagaatgatgcagtcaatatttattcatagaaaaaaaggtatataatgagactatgtataagatggaacttttagaatagggttttagtcatctttgaagtatatggaagaaaatgccaggagcaagaattgttacaggggagaatctgttttaattattaaattataatctaaaactataattttgattattaaacattattataatctggtttgtttttaaatttaaaaaaaaaacagattataatttaatgctttaattatcaattaaattgttccttttttttccttagccagttaccttcaaattcaactcacctttatttgcacctgcatctttgtggtttaactatgataattttagcaaattttcacttcagttattttggctttggagtatgttctatctcctatgccccacattctggtggagatacagttcattgtttatatgaaattagcaacattgatctagccttgacgaatgagaaacgtaaccacatctggctgtgacatagtgactctttgtggactttgggccttagagtttgttataggaaactttaggacgtgaatacactataaaatatagaaatattacgataattcatgaagcatgtctgtcagttatctattgttaacaacccattccaaaagtttgtggcttaaaacacataccattttatttgctcataattagggcagagcagttctccattggtagtgcctggcctgaggtcactaatgtggctgcagtcctcttaagtcttgagtcagaactagttagtcaagctgggctatctctctgagctccacataatctcatcttctagcagcctagatcaaatttcctcaggtggaggcactttgttccaggagggtgagaactgcaaggtttctggaggcttaagcttaagagtcacacagtaccactctgccatattctgctagtcaaagcaagtcacaaggccaactcaaattttaggagttggacaaagataccccctcttgatggcaaatgctgccaagtcatattgcacaggatagcctacagggaattgttgcagccatcaacatatgtgccaacctgcttttgttatagtaactaaactctgtttgtttgccatgattgataaaactctgttctgaggaacagtgctaaatggtttcctgtgttacctcttgggataacagctctacatgtaggtagtattatcccattttaaaggtatgaaaagtgagccttagaaaggttaagtaacctgccctagagcttttatctagttagggacagatcttaaaagttaaggaaaatttatgtctataccagtgtttcttaatcccatcactaaagaacttgcatgggggagggagagaggaagggtgggaagtgggaggaagcgtagtttttaaaatctcaaaatccattatcttaaaattttacatgaattttgtattctactctataatatatcccttttcaatgtgaaattcatggtttaattacttgccaatcaaattaaattttatccccccaatttttaagaaaatgcaattcttctagacacagtataacagctaatcagccagagatctttggttgtaagcagtaagaactaaatctgactactttaaacataaagagattactggagggatgtggtgacaacaatgccaaagaatcaggcttcagagtgaaccagatctagagcagcttcagggatccaggtagcaggactcagtagacagtcttctcaggatacaggagggccaacctctccagcagtttttaatcccactttctactgagagtatatctttcaggcccatactgggtcccagcaggtgccttggttattgcctcactcagccagtaccctttaggggagttgtcattccccagaagtgggaattgatggagggcaggtaaaaccaacagatatttactatctgaacatttgtgggccactatgagtggacttggtttagacattgtatcacatataagcgacaccataatgatccctggttcacccgtctccttcccaaccctacatctaagggttttgttttgttttgtgtttgaaacaagctgtccttctgtcacctaggctggagcgcagtggcacaatcgtggcttactgcagcgttgacctcctggcctcaagcagtcctcccactgcagcttctcaagaagccggggatacaggtgtgtgccaccaaacctggctaatacattttttttttcttttttgtagagactgtgttatctagactggtctcccatttctgggctcaagccatcctcccaccttggcctcccaaaatgctaggattataggcatcagccaccacacctggccccgaggattcttaaactcccatctttaaaagcattcttgtggctctacactgtctatttccatttaaccttactggtacttaccactctaaatgcaatactacatgtgttttttacatgataatctttcctaaaatatgcattttcctcatttttaaagaaaagcatatagactctaaccatttgttggtaacagagtcactataaacatttttatccagtgcatagtgatccccttagaacccagtgagataaagtttatggtctctgcactaaattttctcaaatttctctgcatttatttttcggtcttcttgtgtctaagtgctttcactgtaactttgctaatactttaaaatacgcatgttagactttataaaagcttataggctgaaggggcaacttacatttatttggcctttgtaagtatgagttaaaccacacttcaaatgataaaatgctgtgcatatacagtgtgattttatacagagcatttgcacgtatgttctcctgtttcattgtatattccaatcctttgaagtcagggaagaggagatattttctctatttttcagctgaggataaggtttagaaagggtgatttcccctccaacctaagactactgcagaattcaggtgttctgattgcccatgccttattgagggtggttctagaacagtggtttactaactgcagaagctccttttctggattctgaagtttccaggctgaactggagatgggtaaactaatgtttggcctcatttgagtaatgttccctaattgtagtgacgttggtgtgtgtcttagtctgttcaggctactctaacaagataccataaactgggtagtttgtaaacaacatacctttgtttgtgacagttctgaaggccgagaagtccatgatcagggtgccagcagattgtgtgtctgatgagggcttgtttcctgtttcatagaaggtgtcacatggtggaaggggcaaacaagctcctggacctctttcgtaatggcactaatcctattcatgaaggttctgccctcatgacctaatcaccctgcagaaggtcccacatcctattaccataacttggagggttaggattttattttatttattttatttttattttttgtagagatagggttttgccatgttgtccaggccggtcttgaactcctgagtggcaagtgattctcccacctcagcctcctgagtagctgggactgcaggtgcatgccattacacttagctaattttttgtgttttttgaatagacagggtcttgctatgttgcccatgctggtcttgaactcctgagctcaagtaatcctcctgcctcagcctcccaaagtgctgggattacaggtgtgagccactgtgcccagcctaggatttcaacatgtgaatttgggaggacataaacattccgaccatgacagtgtgtaatggtggtgtctagtagtcaccttggtaattagtagctgctgctgtttattcttgccttggaggcccagcatctttttatttccccacagatagccaggtgaggagctgatttaccccatctcttcttgccacaattagctgggtttgaagtacctcttggagcccttcgatctggccttttttatttcttttccctgtaattaccactttgtgatgtagtcactcgtcctttcagcccctggactcttcttttatatggtcctggctgttttctgctgacaggtctatcactacaagaggttttgagaggagcacttgacacttttgtttaattaaggtctccagacagttttctgttaatagcagggttgtatgttaggctctttccccccattacttttaaagtttcattgtagtctggatcataaacttgtctgtggtggtaatatggtggttcttgtttggccagacctttttgtaaatacacacatcccaagacttctgtagcttttggaaccttgttctgacatttaacactagttttaaagttgtctttttctaatttgtttcaggcactgatttctacagcttctaaccatgttttgataagcactagtcaaaaaactattttttcctcttgcatttttagtttgtttgttttttgtcttatggtttttgtagatactgtgagcctttggaatccttcaacttaattctgaaaagaatgcgagtaaagttctacattgaaaaataagtatttttcatttccttatacttttttcactggcatttttaagttttagcatactgaacagaaaggcatttttagtgttctggctcatagctcctcttagctgctctaagaggagatatttaaggctcaattctctgtgtcctccactccgtaccctgtttattattattgtggtagttataactataaatcatttgcagatcgaagttagaaaagagaccatttgtcattacattaagacagtttaaaggaatcgcttgttcaaatttactagcttcctgaagctagtaaagatgtttatggtttccaagattccctgttaatatatttcaacactacaagacagtgaataacacatgttcagctattatagattatgaggaaagctagctcctagaaaagatttttcagtactataaatggcactaaactgaaaaatcagttgtcataataaacagcggtcctgatctgagagtaggcaggtttcttggtgtgtctgtgcttttagctaatggccagcaatgagtagctctcttttccataaatctggtatcaagtattaatcagctgtagactggaaagtttttatttgctagcatttgtagtggaggaaacaccagtctgttttatctgtctcttagccatataactgcatatgatatcatctgcatggcgttcttacagagagaaatagttgtattctttttcatttgtagtcggagtacttcagaatattaaaatagtgaactttgaccttgaagcatctaaattgtctcagttaagattgtgatgtataccagaaaaaatttacaccttaaattcaatttagcattcttgttttgcacattttgaatggtttttttaatttaagagcaaagtccatagaatgattgtactattgaaaaatcttaaatctcaaaagctaagaaaggtaatttagattttaagtttcaagaattacgtaaatttgggtcttaaggaaaaactgaaattcctgaatgcttacagaggtttttgtttaattttttttcgtgattacagaaatcataagtgtttgtagaaaactcagaaaattccacagatagaaggaaataaaagttactcatacttctacccagagatatcactattaacattttatgtatatccccccagctgcttatagagttctccaataaaatatactttgaaatgcatgcttagaagtaagggtagaagagtggtagaaatgggtacatagtgtgaaccaaattttgttaatcctactgcttgtcagactgcccgccaggtgttgccttcaggctgatgagagctgcctggccctttggccagctttggctgatttgcagcagagcatcttttcttagacaactgtctatatctgtctgtgtctttatcttagcaactgtttcttgtcagctccaaatgcctgctggttgcagagagagacatttggggtccttgttggagtggcttattgatatgagccataagttcttatcaaccccgtggaaaaattctttaaatcagctcttattcaaaagaatgcccgaatattcacaaatatagtatccttcagattacttgcaccaagtaacagcaaggtatttagagactcccaggtgatttcaattaacatctaacctcaaatccggtctccttggtaagagaaaaatccagagaaggagctcaaagcagattatggtataagcatatgccagtcctctcctgtggaaaaagaaaagtgctaatctggtcagaactgttaaagagacaggcaaggctgagcacagcagaattctctcatcctgttcatcttttgcattagtgcagaaaaaagatttatctcaggatgaaagaaagaaggaaggatggcaggcaggtggctagtaataggagatggttggttctcttcctctctgcctgggctagtggtaagcaggtcctcaggtctgaaaaactagtaaaagtgaagtgacacacagggcagcttccccaggcagtgatacaacttgttggtattcagtgtgaaaatacaaagctgactttgattccttgccatcagccagaggaaaccctggagaagtaggaggcagtggcatctctttgtaaacattttattcttgacaagtaacagactcctacctagagaattgtaagcgttggcccctccattctgccagctgtctttcaagagcactctcagtattctcctgcactgaccagtttaaaaggtgtcgtttctgctcccatgcagtgcttggtgtgaaggaattaatttgcaagatgaataaccattgtgataactgctcacatgcaaaggagagagattgctgattttacaggtgtgtggtttgctttcttagatctggcaggaaacagagtccaactcagatggtttaagagactttaaatgaaagaattattttcagaaggacgggcagagttcaggatgacatgggtttctgtcacctagaaactaataggaatggcaagctgttatcactgctagatctgagggagcaaagagaagaaatagtgttactggagtctagtgagagctggtgccatagtggatgggctgttaagacaggagctatagtactagaggcattcagccactgccagaaaagggagcccagagcagggagggaacaaggagggaatattctcctctctgacttttttctttgctctttgatctttttccagtgccttctattggccagacccacctggaagctggccagcaggtgaatctatgatgctgcccatagaggtcagcctcttgggactcagcagggcccagtatggtggaaagttggtctgggggtggaaagtggatcagacaaaattataccataccctatagcatattcttaatttcactttcatcattttatctcatcatcctcatctcctgaaatcccaaaataaaccttaaagcatgtgaactattgattatgactcagttctatcttttaatataaatagcccaaagagttaccctactcttatcagagaaattaaatattcaaagagagaatctgaacagttctcagaagaattggaaaatcactgaaagaccttctgttggggcattttgttcttggttaaaattaaactaacatttaaaaaatatgcatatgaactgtacaagtgatttatcttaaaatataaaacttgtacttttaatgacacattgctgaaatgtgttttttattattaaggttaaggtgcaaaaggaaagtgcaacttaagtccttatggattatctcttcagtttttttttttttttttttaaatagagtcttgctctgtcacccaggctaaatgaagtacagtggcgcgatctcggctcactgcaacctctgcctcctgggttcaagcgattctcctgcctcagcctcccgagtagctgggattacaggcgtgtgccaccatacccagctaatgtttgtatttttagtagagacggggtttcactatgttggccaagctagtctcgaactccggacctcaggtgatctttataaggcagagtgaattagcaaaaagattcttattccaccgatctagaaatacaagaacagatgtggccagtcgcggtggctcatgtctgtaatcctagcactttgggaggccgaggcgggtggatcacgaggtcaggagatcaagaccatcctggataacatggtgaaaccccatctctactaaaaaaaatacaaaaaattagccgggtgtggtggcacgtgcctgtaatccctgctactcgggaggctgaggcaagagaattgcttgaacccgggaagcaaaggttgcggtgagctgagatcgcgccactgcactctatcctgggcaacagagcaagactccgtatcaaaaaagaaaaaaagaacagatttttagcttatcaaaagagagtctgttttagtccataactttattgagttttgaggtttgagaaatgggaagatgaatatttactctgtaaatatgaatggtgaaaagaggtccacacttacctataataattggtgctttaataaaagcatcagctgtgggattaaaaaagagggaaaagtgatgtagtctgtctttatcagagattcttttagacaggtcacaaatatttatcaaaagtctacagttgccgtgtcctagaagtacagatgaaaaaagtgccagatagccctgactcaaggagttggtgtcagagtgagcctttcattgctgtttccttaagggcagccagtcttttggtgcctttccattgcctagaggaaggatgatatccaaaactttgaacagatctttcagtggtcctctgatctggccctgcctgcatcttctgtctcaccaagtgctctggctttttagttccttgaacttgctgttcttcctcaatgtcttttctactgagatttcatttgtctggggtgcttgctgccaccctcatctccctcatacctttttgcctcctttaaatgccacctcttcacagaagccttccctgaccttctagacaaaattcagtgactttgttacttgctttaaaaccctgtgtattcagacacgccgcccttctcattcaaagcactctttcaatttatttgtgtaaaggttttatggctttctttcctactagaagtaaacaccatgagaacagcgttcattgctgtctgtttcacagctgtctcctcagtgctgagcatggcgctcaatagatacttgcaaaaaagggaaaaagaactgctttcaacccaacccctactactcaccagttgtgtgacctttagtggtttgcttcttggagtcgcaatttgttatctgtagaatgggaataatgatgataatggctatcatttattgagcagttagtatgtgccagactgtgctttacttgcattatcttttcagttaaaccccatcagagaagtgaaaagatttgcttgaggtcacatagtttgaaaatagaaaacaggatttaaactctggtctgtttaattcaaaaaaatggattactcttagccatgcctttttgtgattgagtagtagtaccaatgctgagaatgctgaggttgaggagggagtaggtttggaatctcctaaaccattttagggaatcggtatgggattaactctgcctatttgaagagataagtgacctctaaactgatttctgaagaagttagttgggtctagaagcagccagaagtgcaaatactctaagagaacttttcagtgtgctggaaactggccttgttcattgtggttggagcattttttttttttttttttttttgagacggagtctcgctctgtcgcctgggctggtgtgcagtggtgcaatctcagctcactgcgacctctgcctcctgggttcaaatgattctcctgcctcagcctcctgagaagctgggattataggtgcccaccactatgcccagctaattttttgtatttttagtagagacagggtttcaccatgttggtcgggctggtcttgaactcctgacttcgtgatttgcccgccttggcgtcccagagtgttgggattacaggcgtgagccaccgcacccagccgcttgattggagcattctacagggctaagaactataaggttgggccagagagtaaagtaaagggacttaccggctgctgggccaggctaggccagggagttactttctgctaaacactgtggggagtccttgatggattttatttgttgaaaatactttggaagcaggaagtcccaatttggagtccatcttgggggcagaagtatccaaagcccttctctcagtttgcatctctagcaaagaacacattttaactaataatttcattctgctgcacccagtgtgacagtgtttgaaaaggaaccagcattgtgaggtgaggaatggatttttatgtttagttgcagcagtataattttgctgctgctgttactgttttcctttggggacagattccctaacccagatggatggcaaccttacacaagttacttcacctctctagcctgtttctcatctggaaattagagatagttaaaatatctatcttgtcagcttgtcgtgcaacatttacacagtgcatggtataaaatgaacttttaggcaacattaacggttattgtttttaatatgacctatccattctggcctttgattcttttttttttttttttttgggtcggagtcttctctgtcacccaggctggagtgcagtggcacaatcttggctcactgcaacctccgcctcacaggttcaagcaattctcgtgtctcagtctcgcaagtagttgggaatgtagacatgtgccaccatgcccagctaatttttttttatttttagtagaggccgatttcaccatgttggccaggctgatcttgaatggctgtcttaaggtaattcacctgccttggcctcccaaagtgctgggattataggtgtgagccaccaaacttgacctctggcctcttaaatgaatatgtgttgtttatttatcagacaggttgattgggacataggtgctgacatttttaaagatcatgattttaggatcttagaaagtaaaactggcaattaaaaaaggcaacgaacaccttagtgaggcagttttggtgtttcctagatgtgtttaggatgaacacatagatgaaatgcataatatgaacatgagccagtacttaaagagctcgtggtgtgtgccaggagtgtgttttccatgcattcttcctgagaagtaggtttgattatacagtatctattttacagataaaggttgaggtcttttctttctaaggtgttattagacagctatagacatggacaccaaaacttgttgagccttcagcattgtaaaggcttggcttaccttccatcaccctcagcagttctgctggaagggaaaaatggaaacagggcccttaattttttctcattattggattaattggaagcactaggcatggtgtgctgcctggtggatagtagaggctcagtaaatgtttattgaatataaatctgaatcagaccaagtgaaaaaaagatagagaaaagcagtattagatcctggccccagactttaaaaaagtctgaggtcaccagagattttattagcatagtccatttgttaatattgcaggttaatggttggttgaaggctgaggtgaagaattgtccagtgtgtgttgcatgggattaactccagtctgggcaatttagttatctctagaaatctgttcacttcccactaggtacccctgctgctcaagaagctccaggctctgtgtttgtgttcagctgattcatttattcccaattaaaaaaaaaaacaaactagttgtaacattaaaatatgcaaataagataggtgtgactatcctaaataatcctatgtaactattctatttaaacataaataggaaggtataactgccataagtcatcacgagtgtatttcaaagccagatctgattgatatttctgtttacccttagctcaggtaattaagagttgacaccaaggaagtatcatttagtattaaggggagaaaataggataccttattgcatagaatagcaaacaagtagcatttaattctagatttcttcttgtttcccccaacaacagaaaaaaaaatatttttttctcctgggggaggttgattaggatatttatttaccctgtcaaacctgaaagtcagatggtagcctgattaccaagcttgattgattaccaagcatcctttttgtgatttattattttatgccacaaaaggaagatacttgaagagataattttgttcatttactatagaagtagttcatgtagaaattttaaagtgtcaaacattaagacccagtgtccagatcttggtttctaataccattctccattaaaaggagattctgtgcctgagacagggaataaacaatatgagcctgtagtatcttctagctccagaaagtaagaaaataacatgcgcacacacacacacacacacacacacacacacacatactctcacacacacacacactcattcactctctctctctccacacacaatgatggggtgtgtcagagggaccaaagagacaactgaaagagctcccaaaggtcaaacctagaacaatttgagcagctaaaaaacatagtattagattgtaacccaatatataaaataaatgtaaataaaatatacagtatatatatttttaaaggctcatataaacatataaacaaataatatgtgatataaaatcataaatatccatgaggccatactggtataaataaatggttggataaataagcaaatgggagagaatagataaatctttaatataaaagaactccaaatgatttatgcagataatcatctctcaaggagatggaacatcactgccaatctttttttttttctttcttatttttttgggggggatcaggttctccatctgtcacccaggctggagtgcagtggcacaatcttagctcactgcaacctctgtctcttgggctcaagggtgtcttcccacctcagcctccgagtagctggaactacaggtgtgtgccaccatgcccagctaattttttttttttttgtattttttatagagatgggattttgccatgttgcccaagctggtcttgaactcctgggctcaagcgattcacctgcctcagcctcccaaaatgctgggattacagttgtgagccaccacgcccagcccactgcccatcttttaagtctgagctgtgcctagtgacttccttccaaagagtgcaatatgaaaagggaggaaagagacagcttcctgacattggcctgggcagtgactttttggatatcaccccaaaagcacaggtaaccaaaaaatagaaaaatggggttgcatcaaactaaaacagcttctgtataacaaaggaaatagtcaacagagtgaaaagacaatcaacactatgggagaaaatatttgcaaaccatatatctgataaggggttgatatctaaaatatataaggaactcaataacaaaacagataacccaattaaaaaaggagaaagaaactgaattgacaagacgtacagatggccaacaggtatatgaaaagatgctcaatatcactaatcatcagggacatgcaagttaaaaccacagtgagatatcacctcactcctgttagaatggctattcaaaaagacagaagataacaagtattggttagtatgtggagaaaagggaatctttgtacattggtagtggggatgtaaattatagtacagccattaagaaaaacagtatggaggtttctcaaaaaattaaaaatagaaaagaactatatgacccatcagtcctacttctgcatatatatccaaaggaaatcagtatgtcacagaggtatctgcactcccatgttcattgcagcattattcacaatagccaagatatggagtcaatcttggtatccatcaatggatgaatggatacagaaaatgtgatatttaggccaggcacagtggctcatgcctgtaatcccagcactttgggaggccaaggtaggtgaatcatttgagaccaggagttcaacctagccgggccaacatggtgcaaccccatttctactaaaaatacaaaaaattagcagggcatggtagcatgcacctgtagtcccagctacttgagaggctgagccaggagaatcgcttcaacctgggaggtgaagtttgcagtgagctgggatcgcgccactatactccagagcgagactgggtctcaaacaaaaaaaggaaaagaaaatgtgatatccagtgtatatatgcaaataatgtaagactgttcagctttaaaaaagaaggaaatcctttcatttttgacaacatgggtgaacctggaggatattaagtgaaataagccagacacagaaagacaaatactgcaggaatctcacttacatgtggaatctaaaaacattgaaccacagaagcagagagtagaataatggttgccagaggctgggagttgggggagtggtgagggaaatggggagatgttgatcaaagagtacaagtttcagttaggatgaatgagttctaggaatctgttacacagtaatggtgactatagttaataatactgtatacttgaaaattgctgagagtagatcttaaatgttctcaccccccaaaagatgaggtgacagatatgctcattagcttgatttaattattttataatatatacataaaagatcatatttacactgtacaattttgtcactcatgccttaaagctggaggaaaataaataatcacatgttggtattggttcattagctgtgacaaagatactatacttacataagaggttaacaatagggaaaaccaggtgtcaggtttacaggaactctctgtataatctttgcaacttttctgtaaattcaaagtcatcccaaaattgaaagtttatttttaaaaaagactatggcaaggacaatagtctatagttcaagtttaattttcatcccgtagggagcctgaggtaaataaaatagtccttagtgttctggtcttattatggtgtaaagtggggcagttcttccttgctgttgtcttataaagccatgacagtttgtttgcagaatcagagaatgcagtatttctaaatgtcctcctgtggaatttcctactggcatgacttttttcccctttgcttctgcccagtagcagtcccttgagtggcatttgctgtcctagttaatcagagggtaggagaaatgaaaaactctcgtcttcccactcccatgaagtttcaatgggcactggaaatgtaggtcaaattgcatcaccatagaaaggagcgaacaggaaggtatttatgaagtgctgccaatgtctctttagattcagagtcatgacgaactggtattgagcccgttaggtgtgagatacagggaatcagggggcatgtttgtgatgtagtgccagaatgttatatttcaaccagtgataaaagatctctgtctgaaacctagtggaaatgacttacactggctttgtttaatttgcatctcccagcttctggaattctttttgtctcttatttattattggcacattgcaaaaatttgtattaatttagccagagagatgtttgaagtgtagaaactattgccatgtatacattttaagaagtctattgtttcgtagtcacataagtctaataatatattttggaaattacgtataaacataagcacagtgacatcttgattagcacatagaaacctcaaaatattttttcatttttaaattatgtttaaagtatctgttagatggatctctgttttattatttattttattttattattttttctagacagggtctcactctgccacccaggctggagtatggtagcactatctcagctcactgcagcctcaacctcccaggctcaagtgatcctcccacctcagtctcccaagtagcagggactacaggcatgtgtcaccacacccagctaatttttgtatttttttgtagagacagagtttcaccatgttgcccaggcaggtctcaaacgatccacctgcctcagcttcccgaagtgctgggattacagatgtgtatcgctgtcctcagcctctgtcttctttttttttttttttaatggaaaaatcttacagattttaggatataaggaaactttaaatacgtgtttttattttttacatattgtgtgctacctactcctttgtaagatacccagatattgactgccagaatattctgttactgacagtgttatgaacagtaagcatcctgatagcaaaaccaagtctaaaacctctattttcactcccttcttctcccatcaagataatcagtagttgctttatgtacaaaatggaaagtcagatgataagagatttttacagaggcttggatattatttaataatatgaattgaatagattattctgtggaatatgtttataattcaacatggttttggctattttttaactttttattttgagataattataaatttataggaatttgcaaagatggtccagagaggtctcggttattcttcacccagtttctcccatttattatgtcttaactatagtgcagtattaaaaccaggacattgacattggcttaaagtacatatatggttctgtgtcatcttatcatgtgtattttcatgtaatcactaccacaatcaagatatagaactattctatcactaaaaagatcttggtcgggcgcagtggctcatgcctataatcccagcactttggaaggctgaggcaggtggatcttgaggtcaagagatcgagaccatcctggccaacatggtgaaaccctgtctctactaaaaatacaaaaatagctgggggtggtgtcaagtgcctataatcccagttactcgggaggctgaggcaggagaatcgcttgaacctgggaggcagaggttgcagtgagtcgagatcgtgccagtgcactccagcctggcgacagagcgagactccgtatcaaaaataaaaattaaaaaaaacagatctcccttgtgctacccctttatagccacattcattcctattatcctcacagtccctaactcctggcagctgctaatcggttctccaactctaaatttgtcattttgggaatgttacataaatatgatcttttaaaattggcttttttcacttagcattttaaaaagaattttatttttaaaagaatatgataaaatttttaaacgaatatttatttttttaaagttgttacccagagtttgattcactaattttaaggccatatatttctagcttgggtgttccatactctgtgttgctatatttgaacagcagctaaagtcgaatatgccgacgtaatagctgattatagcattaaccttattgcctgctgttaaggatgataccttgatgttaaagggaaaattaccctgggaaaagtccatcctatcaacaaagtagatattacaattgatgaagagcaggaataagaagtcccaatgtttataccaaataaagtaactgaccatatttgtactccatttcatcttgaaatcttcaaaggagagagactttttggaacatgatatttaaatgaacagcagttgaaatatttacattaattaactaatgcaaagcttatgtcacagaattgtggaatgtcaccatacgaaatcaagtgtctgcatcatgttaagcttctttgaatgtcttaagtaggaaatggagttctatggataggcaagggctagaaatagcctcagaaaaatcaaatcttcagatgctggtatactattttctgacaaaatacggagaatattctaggatctataggagggcatgttagtgtttggctgcaaataatgataccatggctctagggaatgccacatggtcaaacctatagcactgagcaaatagaaagtgaatcccaggataccattctgcagcacatggcagtgaataagcactggctcctcagcttctccagaattcatgttcctgaggttgtgtcaggacagatttttatgaatagggtaatcttgcaactagcaaatgatttttgtttggccctagctcctaacattttagatagtcttcctcccagttgggaaaatattcctggtaattaaaatcatcctctacttaccagcttaacatttttcccttgatcacatttgttttctttaagcagcatatgattgtacttaaagtagctattgggatagaggagaagggaaacaatcatttattgaccatcagctatatgccagccactttgctaagtgtttatgttcattcatgcatgtaactgcagtattgaaaaatttcattaatgatactcattaagttatggatctgaaataaacagcatcctaagcaactgtttgtagcaagccaattttcttggtcagatttactcaaggggtttgttgaccaaaacacagtagagaaagagtgagacatagtgcatatatgcctgtgagaaatggtttaaagaatataattatatctattaatttgtatattcatgagacagtgtgtaaaatgatacagaatttagacatgtaagacccagcccctctcctcttagctgtttatccaaatgagggaaacaagttttgagttaaaggaaaatatcaactaactacaggacttaaactgcttaacccatcaatgtaacatgtataacagggcattacataattatttttgaaatctttcagattgtaaatgctttaatattcagaagaggaaatgattactgatctctgacccttgattttgttatctgtatgattttgctacctcgtagaagtaaataaaataatgtatataaaagacttaatataatgcctactacttagtataccttcaataaattgtagcggttgctgttggtaatgaaaattatgacgatagtaagaatactttataagagtaggctaactgctataatgacccaaaaccccagtgccttaacacaatataatgtttatttcttgtttaagctcagagtgtgttggcaaggaggctcagagtgtgttgattcccccagtcattcaggagtgaaattgtgtggctctgccctcctgtaagtacttggagccctttccatttgaccaacagagggtaggagagactgaagctcaagccagagaggtttgtatgggcctagcccagaagtgtggcacccaacatttctttttttattttattttattttattttatttatttgtttattttgagacagagtcttgctctgtcacccaggctggagtgcagtggcaccatctcggctcactgcaacctccacctcccgggttcaagtgattcttgtgcctcagcctcctgagaagctgggactacaggcacgcagcaccacgcctggctaatttttgtattttgagtagagatggggtttcaccttgttggccaggctggtctggaactcctgatctcagtgatctgcccacttcagcctcccaaagtgctgggattacaggcgtgagcgacgagcgactgcacctggccccagcacttttttttttttaagagatggggtcttgctcttttgcactagctgaagtacagtggcacagtcatagctcactgcagccttgaactcctgggctcaagtgatcctcctgcctcagcctcccaagtagctgggactacaggtgtgagacaccacacctggctaattatttattttaattttcatagagatggagtctcgctgtgttgcctaggctgatctcgaactcctggcctcaagggatcctccctcctcagcctcccaaggtgctgggattacaggcgtgagccatcacacctggcttacacaacatttttgttcacattttggattcagtcacatgtctctaccttactgcaatgaatattgggaaatttaggcaaactatgtgctcaggcagagaatgtaaatataggtgactattggcgatctctatcacaaatagtatttacaaaggcttagtagaagtggaagcattttccctggatcttttagagaagagtgaaatttgttgtgtgctgctcagcctgtatttaggaggtaatatttaaagaggtgggtagaataattaaaaactgtacgagcattattaatgaaaactacatttatcccactagccactgcccttactgtcagtcatttggtaagtgacctttgggaagccatttatctgttacagacctgcatttcctcacttacaagtattctttgtagggctgtggtgaagattaaacaagacagtgcatgtacagagtttagcagagggtctgatccaagttaagcactcagcgaaaattgttcttattggtagtgttgataagtatggcctcagagtaaaacgcgtgctagctgttcatttatttaacatctatcctaagggaccatgctagactagcaaagaatgacttgactgaggacacatatatgaattttagaattttgtaaccccaggccagtcataggagattaacgttcccctggtagactattggggaacaaactctctctgttccccaggctttcctcctcccagtcaactttaaagacacctctaccacacacacacacacacacacacacacacacacacacacccgccaactcctgtcaacaggagtactggactttaatttgcctcttatcgctccttcacacacacacacacacacacacacacccacacacacacacacacaccccaactcctgtcaaccggagtactggactttaatttgcctcttatccctccttctcccttccttagcattgatgtctataggtgagtttgcctggtgagagtgaaggtaaatgccagagcagctctttattccactggcctaattgcgagttcttagcaaggcaatagcatcccactccaggcacatattaacctgagtggctgggtagccgtcaggacctgtggttccattttatccaattcaattcatcaggcatttattaacacttaacaacattgggccctagggatacaagaatgaaatgttgcagacccagcctccaggaagcccacctagggcagtaggcatgatgacctgatgaggtttcatctgagctgggttttgaagtctagatgtgagttacttggaaagtaagaaaggagttcaaggaggcatgaacaacaggtgtggagaaacaggtgggaattgtggtgtattgcagtggagggaatggttttaagctcaactctaacatgcactacctcagcttttattggcctcatctcacaagcctcaattttctgataaaggagcacagaaagagttcctgtgttatagatgggaggtctaagtgaaatgatgcatgtaaaaggcttactttttattactgggcgcatggtaagtgttcagtaaatgtcagctactactactattattattgtcatgtgcttttataaattgactttcaaatctactgacttgatcagggttttgcacaatgacaaattggagaattactgggaattttatattttacttttagctaatggtgaaatggtgccctgtagtcacaaataatggatagaaaaatgccttgctgacctttctttgctaaaagaagagggaacctagttaacctcagtgaagcctgggagagataggctcaagatgggagaactgtgtgtcctgaaatggcaaaagagtgaaggatggctatattgaacatatttggagagagcagagggactgaacattgtgtaggtatatactaatagaagctgttagaaaatggaggctcctttaaaaataagactccacatgaggcgttctacgaagtgttgagaaagccctaggactgactgcagtggctgaaatgtactcaagaaacccaggccagagttactggagcccttcctcacaattggccttggctccctctccacttgtgtgttttcacattgacttgatcttcagtggagtaactctgagcagtggctgtagctcagcaggtagaaaaactctctaacccttgaagaggggaatacagtagcatagcaccattgaaaaaagaggttgtgtatagagtttcattcttaaatttgctttgccaaggagaaagcctgtgagagtgaaagcaaggtggaactggggtccaaagagagggagtaaactagatgccatattaatttgtatttctggagaatatgactgcagtttatatataacttggtttaaacatttttgtaacctgcttaagaaatttgggtttgggtggtcgattttcatttggaagaaaagattaggaagacagtatagttttggggacacaagcatggctacctacaggagacaggtctgaaaggaaaataagtgatgcagccagctgagtactttggaaattacatgccaaatgacaaagggcagctcccaacacagcttcattcagttatccccctccaggaaagttggcccctgtggccagatttttagatttttcccagagaaaccaggagtttggaattttatatgaatcttccagccttttaaatattaacaacaaagtcatattgttttccccaagatcaccatggaaaacaaaaaagtgggctattttaggcctgtggacttttccatttgcagtgagtatcaagatggagagaaaaatgcacagcctaggagttaggtggctcagctgaataacactgccaattctagtgccagacacagtacttggcatggagcacattctcaatgtgttttgttttgtttttgagttagagtctcattcttttgccccaggctggagtacagttgcatgatcatggttcactgcagcctcagcttcccaggctcaagtgatcctcctgcctaagcctcctgaggaactgggactacaggcatgcaccaccatgcctggctagtttttaaaaattttctgtagagacggcgtctcacccttcctcaagcagtcttgaactcctggacttaagcagtcctcctgctttggcctcccaaagtgctaggattacaagcatgagccactgtgccccagcctcaacatatttttattgaataaataaaccagctgagataaatctctcttggttttcagtctttacatatctagaatggagagattggagtcagccttcaaggtttcaggttgttttttttgttgttgttttctctccctcctcctcctcccccaacaagctctgaatttataagatcacaactctttgtgctttccttgtaggactaatttctctggctccttttcttccctgttatgccctctccaagaacctagggtggcagtctcacgttaaagcttggcgattttgcctagaagttaagaatttaagtttatactgttaaaaacaagactgacttggtttagccttttttctttcgtttattgtgattagtaggtttgtgcttaattttgacacactggatgacataacgaggtgattcagattatgccttaaattgcaacaaagttctgaatcttaacagaacacagaaatgttactcctagaaaataagccattttccctgtaaaagccaatataacactgcccatgtagcattgtaggcttttctctgtttaaaaggaatgatggggtgtttctgaacccttcggccttctgcagtatattcttttataacacattctggtgatagctctacttttaaaatacgtttttttactatcttggacaagatcattttttgttgcagttatcacaaatcagttccaaaaaataagctcattaaaaggtgggggcgggggcacttaccctagatgccaggggattcttagaaccctagggaacctagggaaggaagtgctttgggccactcaggggctatggcagtaacaggaaagcccaagaacactcccaggcagagattctctctctctttctttctttcttccttcctttcttcctttctccttttctctctctctctctttctctcttttctgtctctctcttgtttctctgtctctctctctctctctgtgtctctctctctctttcttgttttttctcctgggggaaacgggagataagtggcctcttgggtcagattcactctgagcagcacattcattctttcattctctctttgctgactgtctttttcctatagactgagagagcacttagaggtagcttgcagcctccaccaaactagaccctcttcatctcaatttctcgttctaagaagaacacattgactgtctcagtttgtgtcgtgtgtccagctttgacaaagatgggagtaagtagtttgtagccccatagtacaagtatgacttggcatggagttgagaattacttagtgcttagaaaaaagggtcaacataggctagggagctcctgtaggataaagatatcttctataatctccctcccccttaaaaaaaaaagtaaataaatttatgcttcaagttaggtcttctttctttctctcccactgctaactggccatcatttaaatacatcttttttaaaattatatttattgaatgcttattacaaagtagttgttgcatgaataaaaggtatcaagtttaatgattctaagaaaattttccaagtctatttaaaatgatttctttttaactatttctctttgcaaaacaaaattaagttgccattgaggcagtttggtgtactggaaagggaactaaatatcaccaaaggcccggattctagttacagtttcacaccacttgttggctaggtaatcttgagcaaattatgaccttcctcaatctgtttcttcagtagtaaaatggagatcatagtaacagctcttttgaacacagggttattggaagatcaaatgagagaaaacatacaagcatgtaataggttttttcccatactaaagaaaggctcttgacccctattctaagtagagaagtttctgtttttaaatgtttatttttagtaactgcaactatcatttttctctaagaattggatttcctataaagcatttttacagtatgtgactagtaagtgatgaattcttttaaaaccaaaactatcctgaaggagatttcatagtattctgaatctgatgacttccttggatactttggagaaatagcagcagtgtccagatggaaaattgaaaaatggcttgacctagtgaaataagatcaagtgcagagtctaatctgatgctggtgttgttctgccttcaccttctgtctactctgaaggaatcaccatcagggtggtgaatgcttatcatgaacataacatctttattgactgtctctatcatgacaatttgtaattagctttgaatgatttttgcacagctataaagtatttaggattcaaagaaatgcattttggctcaggacagacatgttgaacaagaaaacagcttttattggaagtaaggcagaaaaggagcactaaaatggaaatcagagaaattttttaaaagaaaggagactgggaaggaattagaaatctgaagagaaacatctggtttataaagattgtgagaatgattttaagcattactgaatagcattttgagtgaataaaattgacacttttaaaaagggagagggaagcagtatgacctgggaataacttaaaacctaataaagataattatgagtaaatgttcaaaacatggcatataatttcagccactgattttcagagatgctttatttgtatcttaggatctcaggccataggaatatttggttaccatcttagagtacatgaaaataaataaaagttgagcaaagcactattacctcctccacatcttgctttatagccagtgagaattatagggagagaagtatatgagtagtgaatttttcatgtgagctcagcctgtcttgtgctttataccttgacaacatctgcccgatagctgtgtcattgcccatatttgtcgctttttctcttctgctgcatgtgagatttgaagaccagcttattttctaactttggtttgttaatctgtaatttattgactccttaactcattgctcctccacaaattaattaaaaagttaccacattttacctgaaatatatgcacacaactatgaagataatggagcacatagtttccttgtgctttttaataagatggtttaattgaattgttacctgttgaagtattaaaaattgcttttataaactgctgaaatgataaagaacgacagcgtgagctctccagataataatctcattcaatctgtgtttttaaaatctgtgatttgacaagtttcataggagcaggctttctgaatcgccattttaaaaattaagtggaaactcattagtgcaaattatatacaatgattttaagccccaggaggctaactctgtgtacatattgaatagtcatttgttcttggtttattgtaactatagccaattaagttcattgtaaaaaaaaaaaaaatcacatttgtagtaaaattggtaaaatgtcttgaaatttaacagtttgacatctcaaagcacatataattttggaatatctggcaaccaatgagattgtatgtttctgattagctttgtccatccactgtttcatccatttgccttttttctgtttttgcagatctgaacagaattaagacgaacgagctttcacaattgcagcagatgaagatccattggtaaattgatcaggatttttggcctaccctccaaagaaaaggtaactggctgttctgatatcgcaaacacagttgaataaatataatgcttccagttataatagagtttgagttttaccaaaggatgatagtttattttaaggcatctgtgtaagatcttaaatgttaaatgtaatcctgaatatgatcttagaaaaataaaatgacaatgagtttaggagtatgatattattaggtatttgtttctcaacacaaaaactactaaataacatcccctccaaatttgttaaaattgcaggaagactttagttatagaatcctccttctttcccagtctatacccacttttttctggaagttatccaaaagtgtgctcttgtttctttccagcaccattcccccagctcctgttttcttgtctttccatgtaatgtagacccagctgcttagggcagggaagatcatcagcaagactgtaaaacaggcaagcgttcttcaggaacactttctgggcccattgcctttgcccaggctgacagacagctctgtggtaatgagtagtctctgatcattacaaaaatagcagccatcattaatggagtgtcttttttttttttctttttttgagacagagtctcactctgttacccaggctggagtgtagtggcgtgatcgtggctcactgcaacctccacctcctaggttcaagtgatttttgtgcctcagcctcctgagtagttgggactacaggtgtgcaccactacacctggctaatttttgtattttagtagagatggagttttgctatgttggccagactggtctcgaacccctgacctcaagtgatccacccgccttgacctcccaaagtggtgggatttcaggcatgagccaccaacgcctggcacattaatgttgtttctcactgcatgtccaccattgtacatttactgttttgggaggatagtggtgaagtttcacataatatgaagcaggaaattcctggaggaattttgatttaaaaaaacaaaaagggctgagtacagtggctcacacctgtaatcccagtactttgggaggctgaggtggaaggattgcttgagctctggagtttgagaccagtctggccaacatagctacacccccaactctagaaattttttttttcttttttttgagaccttttcttgctctgtcgcccaggctggagtgcagtggcgccatctcggctcactgcaagctccgcctcctgggttcacgcaattctgccgcctcagcctcccgactagctgggactacaggcgcctgccgccacgcccggctaattttgtttttgtatttttagtagacacggggtttcgccgtgttagccaagatggtctcgatctcctgacttcgcgatctgccctcctcggcctcccaaagtgctgggattacacgcgtgagccactgcgcccggcctaaaaaaaatttaaaaaattagccaagcacagtggtgcatgtgtatagtcccagctactcaggaggctgcagcaggaggatggtttgagctcaagagcttgaggcggcagttagccatgatgatgctgctgcacaccagccccagcggcagcaagaccctatgttaaaaaacaagcaacaacaacaacaacaaaattattctcctacttctgaaaggaatgagataacctttaagttaaggtgcagtttaagatgagtcattaaagactgaaacaacagaatcgaaacaaggaagacgaaaggagtttcagcctctggaatcaactatcttacatacttaggcaacaaatgtgatgccacaatcaggttttaggcaactgtagcaaaaatggtagcatttcagacaacacgtaaaagataatatttttaccattaccaatctgaaacaacttcacaaaaagtgttttagtactgttgagatgtttgaaagaacaagagtttggggagctatgaagtctccaccttaaaaacagcctcttaaaatgttctggactaaagctgaagggccataatgcagagatgtctttcagtgatcgttgaagtcatcacgttgaatgttgttcattgtatcatgtctgcaaggtgccagagaagagagaaacaggctttcctgtgtggtgtccaatcactgacaatggaggggtatggggagaagttaagaggaaacatgtttggcagaatgccagaggagctctttagtgcctgtttatggagtttctactgtgtgcatggggattgtccctgggaggaaaaggagaagaataggaggtgatttacatggactgcagtgatgacctaatgcttttttgaatattataccaatgaaaagattaatatgatgccaggaagtaagtgaccaagaagcagagaaagaagaggaggcacaagttcaaaagtctgtagaggccagagagaccagagaggggaataaagtgagccaggtggaactgtgagaaaccatccggtccatgatccatctaatgtggcaatcccttctcagcagcagattgtaggcccgatatctgttcattcaacaaacatttattgggtgccaacctatgtgctatgttctcttatggtcactggggataaattagtaaatcgaaaggacaaatatccctgccattgaattggcacttacctttttttcttaattaacaagtaaaaattggatatgtttatcatgtacaatgtattcttttaaaatatgtattcattgtggaatggcttaaattaactaatttaatagctaattaacgtaggcattacttctcatacttatgttttggttgtgagaacctttatctagtctctttgcaatttgcaagaatacaatacattgttattaactatagtaagcatgttttgcagctgagttcttgaactcattcttcctaactgaaattttgtaccttttgactaactttccctaaacccctcacctctatcctctggtaaccaccattctattctctacttctatgaattcaactttttaagattccacatataagtgagattgtgtgctgtttgtctttctgggcctggctgatttcacttaacataatatcctccaggttcatctatgttgctgcaaatgacaggagttctctttaaaaaaaaacaaaaatagagataggggtctcgctatgtgtcctaggctagtctggaactcctgaaccctggcctcaagtgtttctcccaccttggccttccctccagagtgcttggattacagttgtgagctaccatatctggctggattgccttctttttaaagattgaatagtattccattgtgtgtgtgtataacacagtggaatattatttagccataaaaaagaaggaagtattgataacatgttccaacatggataaaccttgaaaatgttttattaaatgaaggaaaccaaacacaaagaccacatattatgtggtttcatttaatattcagaataggcaaatccatagagacagaaagcagatgtggttttcgggggttggggagggaatgtgggcagtgattgcttgatgaatacagggtttccttttggagtgatgaaaatgttctggaactagatagtaatgttggttgtactacactgtgaatgtactaaatgtcatcaaattgcacacttaaaatggttaaaggccagttgcagtggctcatacctgtaaatccagcacttagggagggcgaagcagaaagactacttgagtccaggagtttgagaccagcctgggcaacatttgaaaccccgtctctataaaaaaagtacaaaaattagctagccgtggtggcatgcgcttgtagtctcagctacttgggagctgaggtgagaggatcactggagtcttggaggttgagggtgcagtgagccgtgattgcaccagctggattgcacttgagcctgggcaacagagcgagaccctgtctcaaagtaaataaataataaaatggtgaaaatggtgaatttcagttatgtgagttgtatttaaaaaataatggcatttagaaagactttcagaaatgtgtactttatgtcttggacatgagaaggtggtttagctagagtggagtctttgtaagggggagcggtggatgctaagggtgggaaaaggtttggctagatattgaaagatattgactggctaaggagtttagcagctataaatatagcaccatatactccatgaggaagaaggaaactcaagagaggttggtgctctgggaatcccagctaaagatgaagtttcaagcaaaggaagtgacttgtagttttatcagtccatgccgttgccactcacctaacagagttttgtgacaatctcacaaaagtttcaatattagtttagagtttcttcttcaaaaaaaaatctttataaaaggataatcatcttttaaaataatcatcctgaatataaaactatgttgataaaaaatctaaacattatataaatatatatgctaataaaaagttcctttaagtttaaagaattaaagcatctttaattctttaactccttgcttctcatatggtaaatctagagttatctagattgttttttgcatagacttatcatcatcatcatcatcatcatcatcaccactttttcacaaaaataggcacatgtgggccgggcacggtggctcacgcctgtaattccggcactttgggaggccgaggcgggaggatcacgaggtcaggagattgagactatcctggctaacatggtgaaaccccgtctctattaaaaatacaaaaaaattagccgagcttgggcctgtagtcccacctaccccggaggctgaggcaggagaatggcgtgaactcaggaggtggagcttgcagtgagccaagattgcgccactgcactccagcctgggcaacagagcaagactccgtctcaaaaaaaaaaaaaaaaaaaaaaaggcacatatgattcatagtattttttgcatgtttctttagaaaatgtttatcttggctgtcattgcacttctttcgtttggaccattacattatatgctattttatttgtaaaaacaaacaaaaagttgaaaagtaacggccacatacctctattagagaatgaattgttataaaatgtgaaagtagctaacacactgagcacttaatatgtgccaggcactattctgaacatattaatttattgactcttcataagctgatgaggtagatattattgttatcttccttttgcagaggagctaactgaggtacagatgaaaaaattatcctgccaacgtccagagttaggtggtggcagagatgggttccaggaccagcttcatctccaactcatgttcctatgaggaatgctgtggctggtggtgtcagattttacttaggattttttcaagataagtcaatctggaattttttgtgaaattttccaagttttaatgttggcttaaaaaatagctttattgagatgtaattcaaatgccataaatttacccctttaaactgtacatttaatggtttttagtgtattcacagtattgattgtataactgtttcttctatctaggtcaaaaacatttttagcacccacattggagaccccatcgcattcctaagcagtcactctccatcttctcttccttcagcctctggaaaccactaatctgctctctgtctgtatggatttgcctattctggctaattcacctaaatgaaatcaaataatatgtgacctatttgtcttctttcatttagcataatgtttttaagatttattcatgttggagcatgtatcagtgcttcattttatggctgaataatttttttttttttttttgagatggagtctcactctgttgcccaggctggagtgcagtggcacaatcttggctcaccacaagccccccccactcccccgccaggttcaagcgattctcctgcctcagcctcccaggcagctgggattataggcgtgcaccaccatgcccagctaatttttttgtgttttcaggagagatgggtttcactatcttggccaggctggtcttgaactcctgacctcgtgatttgcctggcttggcctcccaaagtgctgggattataggtgtgagccactgcacctggcaataatattctttgtagagatatatcacaatttgtttattcatttgttgatgtacatatgggttgtttccaccttttggcttttaggaattacactgctaatgaatattagtgctcaggtatctgagtctctgctttcagttcttttgagtgtatacctagaagtggaattgctggatcatatgctaattctgtgtttaaccttttaagtaactaccactgttttccacaatggctgcactgttttacattcctgccagcaatgtatgaggattccagttttttcatatccttgctaacactcttcattttctgttcttttgttgttgtttattacagccatcctagtgggtgagaggtggtatctctgatttagatttgcatttccctaatgactaatgatattgaccttctttttttgttgttgttgttaatttactgggctgcgttctttcttttctacattctagttcaagtcccttatcagataaatgatttgcaaaaatgtgtaggttctgtgggttttcattttcttgatggcatcctttgaagcacagaagtttaattttgatgaagttcaatttacccatttggctctgttttcattcttttttaatttaatttaatttaatttttttttgagacggagtcttattctgtcgccagactggagtgcagtggcacaatctgggctcactgcaacctctgactccctagttcaagagattctcctgcctcagccgcctgagtagctgggattacaggcacgtgccaccacgcccagctaattattgtatttacagtaaagacggggtttcaccatgttggccaggatggtctcgatctcctgacctcgtgatctgcctgcctcggcctcccaaagtgctgggattacaagtgtgagccaccgcacccggccttggctctgtttttaaaaagaaatacctggtaagtcagattccaacccactaattgcccgcttgtgattgctgctttgctgccactgccccagaaaccatttggaaaaatcctcatgctttttgaaaataccggttttctgaagagatggagcaagctctggaaggcaggaaaggcagatttctcaccaggagcaattttgttttggttccccttttctactcctgaagttccttcacttagaacaccttgatgtagacgtgggggcatagtaggaagtggacagaggatcaaggtctccaggtcttgaaaattttatgtttatcaaaagagaatattggttaaaataaaagattaaattggtgaaaataaatatttgtcttgagccatagatgatgtcatttaaaatcagaatggccataagagtgtggttagtaattgtgtgtttctaggaagaaaggtttatgaaccagtacacctagaagtcatctggggtaaggtcttaccctttatatttctttgaatgtgtacttgggaggagaggaggacaggtaactgtattcattcatagtcattcatacacattagtgaaaaatagttaaatctgcaggcctttacctctaccaagaaaaggagagctttactttggaggtggaaagggagtgcaagtttttgtggaacagtctgtcttttgagaagcagtacaaacccaggtaggctcctggatcacggtgcaaagacagaatgtgggaaagtcaagggtgtcatgtttgctggatctatagctttgcttagagctggaccttggctgaggaaaggaggaagaagcatttgtgttgttccttccctcttatactaacacacctgcattgttcgtcctaggtttcaccccaaaggcattttgctgaccaatttggagacatggttacaactcgtcttatggtttgtgggaaagtgggttccaggttctaaataacacccttatgttgggaatgcaaactgttgatctctgggagactaaatgtatgtctcattgtcaccttgatttcagagcatatactcttaactctgaatccatgaagtcctgtgatatagaggtggggatgagttcccatgtatgtgcttagtgagagggttcaggaaagagtttgttaaagaaatggaatttgtggaagaactttgattgaacagcaggatttctgccaagggagggaaactgttaaagatggagtgtcctatatgagcaaaggcttgggaactgggagttggatggggttggggtgggggcatgtttgaagttctgaatttgtcatttgggctagaccatagactacctgcaggaggcaactgaacagtgtagaagtggtggagctgaggcaagggcaaactgtagaggaccttgaatgctaggagagaagtttttatttattttatccgtcagtggggagcccctaaaaatgttagagcaatcactaacatggctaaagccataattcagcaagattggtctgatagtatagcgtacatagattagaattagggcttactatgtgacaagcatggtgctaatagtaatagctgacacagtgtgcttttttgcactgtaaatttcttaatgttcttcataaagtagttactcttgttttactcattttatagatgtagaaatatgcacagagaggctaagtgatttccccagagttacacagctcgtagtggtagaagtgggattcagcctgggcagataggccctagaacccacgctcttaatggctgagcccccaaaaatggtgatatttacagcattgtcagtacaaaggtacatgggaaattacgtttaacaatgtgtttaacctgcattttatggtagctgacgcagtacactagaactctatacagtcgacttccttttatagctgaatattggtccaacttttccattccttgtctttttttttttttttttttttgtaacagggtcttgttctgtcatccaggctggagtacagtggcacgatctcagttcactgcagcctcaatctcccaaacttaagcagtcctccccctcagcctcccgagtagctgggactatagacacatgcctgcatgcctggctgtattttttttttttttttcagtagagactatgcctcactgtgttgcccagactggtctccaacacctgagccttggtcccccaaagtgctgggattacaggcatcagaccatcacgcctggcctccattccttttctataacttgaaactttctatttgtaaaaaattcctcagccgaaagactttaaatcaacatttcaaatcaagttcgtcataaaattacaagccagttttaaatccctagaaacactgggcattactaattaccttttatattataatttattattaccttttatatgtgtattttcaaattttcttctcttttcaagcaatttgctattactggtgaatgtttctttgggagagttcatatgtacatgcaaacatatgattaagaaaacaatccaaaaatttaagggtttgagatgtttagcaaatgatgcattttactatagaatgagtatgtgtacaggttgagttttcaaaaagctatttatgtcttatcttttaagtcctcactcttgcaactttccttattattcctaattttgcacttgattgctatgaattccagccactaagctgatgaattcaatttactctttccactgttctccctctactggaatactgatattcatgacaagctgtaaggtacttcactagagggagcatagttaaggaaaggcatgccccttgtgcagaatacagccctggctctctctggagaagaacgaggaaaggggaaagatgtagtcagaggagtgagagaggatttgaacaaaggctcagccaattttaggaagataaaaagaaaccaaagccaacacattcctaatttagtggatctgagtttcttgttactcaaatgacttcagtcctttggggttgataatggagaatctctgttaccaaccctgtaatttacacagataagtatactgtagttaactgcttttcaagtttattaaaatgttgtactgggactggtggttttttccaattgaagacggttgtgtgggatcttgtatcttagaaatgttttgggtagttttagcctttttacattaaactggatttaatgtaggaaaggtcaactttttgttttgttttgtttttgtacattgtgatacctttggccttggaacaaaacattttatgagtgcaaagaatcctttttgtaaagagagacttgttagccttggcatctactgagaacatccctaaatttgggtgacgagataagaccacattttaaatatgtccttggaagggatgaaatgcacagaattagcagtacttcacctctgacagcccagttcttaagccatagacaatctagttggtggtgacagttttgatgaattgtttcccctacttactacttttctcacatactcagtgaaattactatcttgtgttcaccctggtgcctagtagagtgcctagtctgtagcaggcaatcaggaattgttggataaattgaatactcattattcaagccatataaaatgaattattacttaagttttcagacagtgaagttcctcagagttacaaggcatcatcagaaatgcactggcagaagcactgattgatattatacaggcataatactatattaaaataacatattaagtgaatgtaaattgtattggcctggtgtggtggctcatgcctataatcccaacacttttggaggccaaggcaggaggactgcttgggctcaggagtttgagaccagcctgggcaacatagtgagaccttgtcatctccacacacacatacacacaaaaaaaatttatacacagttatattctttttataatttggtggtatggaaaggggattatctaggtaagaggtcatcaagttctttactgtgggactgtaggtaatacagctaagtattgggtttctgttgtactcttgtttataaacagtatgctttgcataaggaatgcttttaaaagttgccaaaattcagatatcagatgcagtgtgtcagcttgctgttttgactttttttggtgactcattccaactttaaggaaacttctaacgactatggatatcagaacatttctaggagttaggacttttttatgggtgaagaaagagtgggtaaaatgcattggctgcagcaaaagagaactggttgaagaaataccaggaaatgcccgtcaatctcttgtctgcacatcctcttcagtttgatagtaagtttcctaagggattgagctgaattgctcagtttaatataagacacttatttatagtgcttatttatgagattcctcaataattgatagcttgctattagttttgagtattgaggtactcaataattggtaactgctatttgtaataatttcccttaataacgatcataatgccaagaggatacttaatatttttcattttaagcccgcttgtgttttattaaaccaatcaaaaactttgaagaaaaaaagaggtatcaagcaggaattgggaaagaagttgaagtactctaaattgctgcattgatccccattggctagaagtcatattagtgaatcttgaagtagtttcacatccaaaagaggaaagtcaagcaatgtcttgaggaagtaggaccatacttcatgtttgccattctccttatttttgttctcactctgtagtttcagggatctgaagagctgtactcaacaagcaagctccctttgttatctatatggcttggtggccgcaagcttttcttttcaatggtagcttcaaatgccgttaaaatccaaattttcgtttttcttaagtgtagaatttcacaattccaagtaataaattgtgtactttaggaaaacagaggttgggtgttttcatgtaattattcagattttgcagtgatttggaatgaatgaaaaattgaaaatctgcataggggtcatctaagctatgttaaaagttagaagggaactctattcctgtcaagggaattatatgttttactcctgtgcatttttctcattgatagtcttatggaggaagttaaagctgtagaaatgatttttaaaattaaatctttccaatcatttctactattttggttattttgataaggacaggaagtaaccatggtttcactttttggacttgtttgcacgcaatccaggaaaaaattttacagacttatttctaaatctttctaaaataaaaatgtgtgtgtgtgtgtgtatgtgtaagtatgtgtgtgtgtgtgcgcttttaaattttgaaccccaaaccctctctagcaatcccaccttatgtttgggttgcagtgacatttctttattaatttttatgcttatgtaaacttcctgtgtttctgcaagttggaccaacaaagaagttggctacctctgtcacatcagatgtttgaggtacaaaaaaaaaaagaattccacttcctccccatctagtcagagaaagcacttgtgagcaagcatctctgacacacattacaggagttgatactactgcagtgtgaaacatgcgtgaaacatgctgataagaatcactgtttttgtctcaggcttcaaattttcacatcaatttgagaaaatagtaatatcaacaattattgaaagtggtgtggtctgctactgtttcaagtatttttaatgctttaggtcattaagtagccttttattttgccatctgtagcctatcgctaagcaaatgttgtgtatgttggggaggggtgctaagttttgcgggccaatgcttaatttagtgaacaaaatttgaccgaaaacagtattttctaaacatgttttgtaggaattccttatattctcctaatccctagggtctcgtcctgcccaagaaaagacaaccataaagagggaaggactaacaactcaagttaaaaatgaatcagatttttacttttggggtgaatgaatcacttccagaaacttggggtggtgcctctaaaatatgtacacgggttaaagcttctctcggtttgtttcactctcctccattccctcgcacactgatctcatgttctctctttgctggacgaattcaagttccccaggcgcacagtgtgacttccaattgcgggtcgggggcacacatgtgggcggcgtggcgtgcacacggtacttcgtcctgacacctgggcagacacctgggaggcacttccccgctagcccaaggttccctgcacgcccggagtccgctctgcggcggcttcccattcatgcttttgacaactctgcggccgcccgcaagccgagggcaaagtgccccctgcaccagcctctcccgcgctgccctggggccggccggccggctcctccataggtggctgcatttccgacttcgccctggctccagtccgggggcttgacgtgcaaacttcgccggagcgagctgagagggagggaccggcaagtgggaggaggcggcgggaggcgtctccgcttaagggagccggccgggtgccgccgctcggacggacgcgcggacggaaggaaggagcggggcagccgggccgggcccggggatgcaagcggccgaagggtgggcagctggaggtcctggggtgcggctcgggcttccccgcgcgggctgccatggtggggcgcggggttggagccgggccgctccggcgctggcctccgcgccaggtcctctgagcagaagcaggcaggggacccagcgccgcggtggcgggccgcctgctgcccgtcccctccctcgggcggccgcgggagtcgaaagcgaaagctagcccgcgccgcggactttgagcccggggcggggggtggccttgaggaggcgggctcggggggctgggcggccatgggggcgctgtcagcgtgccccacccggtccgcgggccgcgcacgccgccggaactccctggcgcctccttaaaaaacggcccccgcgcgactctttcccccttttttttgttacattgtaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacggtgagtgtccacgccctcctccccccttcaccccctcgcgaccccctcctctctcctcccctcccccctgcccccctcctgtgacccgccccctcgaggggcagagatgctatcgtttgctgggttgcggaacgcggaggtgcccacacctaccccgtgcgtgcgtgagtgtgcgtcacactcctggccactgacctgcctctcccctcctcctgtgtgtgtatatctcctagggacagaattggacgaaagtttcaaggagtttgggaaaaaccgcgaagtcatggggctctgtcgggaaggtgagtccagcccccctgatggagtttgtacaaacccctgggaagtttcattgacagttcactgggaccgggaacatcagcccaccataccgactccccgactccccgtgcctgcgaagatgctgcctgaggagggagggagggggcagagcgcttggaaagtttggtttgggggcctcctgtaatgagagcgtccggaatccttctgtgaccaggcaggagcagcattattggtgatgagcgctgggaaccggcgggaagtttaacctagatctctgcatttctgacctccttacggagaaacaggagtagaggaaggaattctcagctttgaaacctttccacgaatgcttaggggacattttctgttggcaatcgaaacgaattttgaacttaaagaagatgctttacctatgcagtcttatttctgtaggatttaaggtacaagttggggatgttagaaaaaggtcatcataacccggagtgcattttggtcagattttttgcgagctgccaatatcacgggggaaagaaagccagaattttatttggtcaaataagcctttactgcccgtggctggtgaaatcagggtctaattatttgttagttttaaactgtttggtaaaaagatacactagggaaatagggtatgcctccaaatgaaagtcaggccaggtatctggaaagtgtcagactttttcttgagattttctttttctttgaatagtaagcttttgttgtctaatacctgcactaggcctgggcataccgtggtcagaaaggacttctgaagtccagtgaacttcgggttcagtttcaagttattctttcagtgagttaggacaaggctttgagtgaggtttggccccggaatactgagtttatagtccccgaatgcaattttatttctcactcgtagccatttattttgcagaattgttgtctatggcccaaggataggtagaactttggcaactggaacatttttaagtccaaagtttgcccattgttactgtcttcacatttccttctcgcttttcacacctgctttttcttcacttaactctgtttcggtttttttgaattgggcgctttttggcctcttggcactcggaggaagagtaataccagtgacagcccgatgagagcttccaattggaacagattatagaacaaattagttgatttttaaaatgagaattgctatttgagggtaaaggaaagcaagggaaagcacaggacttgttgatgatgttgcaatatgaaaaatcagttgctagtccggttttagtgctgaattggcagcctgcctgggcttaaaaaattaaaatcactaggtggcaactctcacagtaagcagttagagtagaactttagaggacctgacctactcttgttcttagttttcattctctgggtgtggatacatatcctataaaacgtttctaaatctgtgtgaaaacaagattgtaattatcaataattctgctgtaaaggatgagttaagtgtattaatgtttcagtgggtaccttgagctggacagggacccaaccaaattaaggggactgtacctcatttttgctagatatattattttctgttgggatacttttatcagcatgtttttcatgaagaactaagacgttaaactacctacttgaggcacaaaagggacatggatcttgttagtgttttgttttgttttttgagacggagtctcactctgtggccatgctggagtgcagtggtgcgatcttggctcagtgcaacctccacctcctcagtgcaacctccacctcccaggttcaagcgattctcctgcctcagcctcccgagtagctgggactgcaggcggcgggccaccacacccagctaattttttgtgttttagtagagaggaggtttcaccacgttggccacgatggtctcaatctcctaacctcgtgacccacctgcctcggcctcccaaagtgctgggattacaggtgtgagccaccgcctggcccttgttagtgttttttaagggttcccctcctcccccttttaaagttgttctaaccatttagaggatgctgtagctaccaggccacttggaacgtacacctgtctgagttgagaccgaagttttaaattcagtcagttcttcatttgtttgtgactttgcggattatgtggggatattttaaaatccaagtttgaggatgttcagcactcactcagtggacctttatgttctcctaacagaccattgtaggctgcttcagaaatgaaaatacatttaatattatcaaaacttattagactattattcattcattgtctgcttaaaattatcagctaccaagaaaagatgttttgaagttgaatccatactgattcctcttgttaaattgaagaaatatgtagataaattgatcatgtgagtgaatcactggaagtcagaaatgaccctttatttatttttttttttttttgagacggtgtctgactgttacccaggctggagtgcagtggcaagttctcggctcactgcaacctctgcttcctgggttcaagcgattctctggactcatcctcccttgtagctgggattacaggcacgcaccaccacacctggctaatttttgtattttttatagagatggagtttcattcaccatgttagtcagtctggtctgaagctcctgacctcaggtgatccacccgcctcagcctccacgaagtgctgggattacaggcatgaaccaccacccccgccagaaactcctcatcttgaaatatctctaggaatatgcacttgacttgaattctccaatgtgcaattttggacctaggggttagaaagcctggatgtgagagaaagctgcttaaccttgcattagttatttcatctttctgaatatactttccctctttggaagataatactacctacttcccaaggttattgtaggagctgaaattaaattagataatatgtgaatgactcagtacacactaattccttttaactctttcaactgttgataacctgacttcttaattctatatttctaggtacagggttttaaaatctgtgacctttgaaaaggcttcaggggattgtagttcccctgaaattgtatgcaaaataatatgtcagttttctagggtaggtgttcacagcttcccttggattctcaaaaggatcatttacacgtccccacccctaaaattcaaaactgctaagctaacctctctgcctgttttttcttttcactttttcctcttgtaacacattactttgaccaactcctatcaggcaagactacccaagggttaatgctgtggcagaaggttggaactcttgatttagatggagggaaattatttgtggtttaggtagtaaacctacccaaggcaagaatacccaagggttaatgttgtggcagaaggttagaactcttgatttagatggagggaaattatttgtggtttaggtagtatatcattccctcttctgccatttggcacaagtaggcaaatgttaagacaaaatttggttatttttcagaggtcaacctagttttgtttgcattcttgtatttgtattgccttattcttgttctgtaatttgcaatattagttgttagcatgattaattttggtgggaagaaattggtaatacattttgactttttgttgttgttgttgttattgttgttgagatggagtctcgctgtgtcgcccaggctggagtgcaatggtacaggcacgatctgtgctcactgcaacttccgcttcctgggttcaagcgattctcctacctcagcctcccaagtagctgggattacaggcacctgccaccacgcctggctactttttgtatttttagtagagacggggtttcaccatgttggccagcctggtctcgaactcctgaccagaagtgatccacccacctcggcctcccaaagtgttgggatgacaggtatgagccactgcacctggttgacgtttttgaaatgattaaacgtcaaccctggttgatgtttttgaaatgattaaacgtttttgaaatgattaagacaaattactgctttttcccccaaggtgatttgtgaaattccggacttccacagattttggatttgtgaaagttaacaaaattatgtttagattgaattaattggtactaataactgattagggtttctatattagtgcctgaatatttagagacccttaaaaaataaaaactttaaatgccttagttgcacagcagattttaaaacctatattgtgtcattgtaggagtcaacaatggtattgggaaaaatgacatcttctttgggaagctgtccataacttctctaagtctaaccgttgtgtggtatcaaagtactctgtactttttctttctgcattctacgtgtcagcatttgaaactctgcattatgtgatggctccttgttaagagagtaagttccctgagggcaggagtgttgttgatgaaggcatattcagctcctgcacaccattgtgctcagtaaatatttgccccaaaagtggatgagtagagctactaggaagattgaattgagtcactctagtgtgtgattcaaatgaccaatttttcattgtattgtgactccaaaagaagacagtattctgtgtgtttgtgtgtttagggggtgttgctgtatggccccaggggaggccagaaggtttcagcacttttcgttgctctgtccttaatatagtgctccatttacactttccagaaagggtacagacaggacatcacctctcttatctttgatatttaggcaaagaagtagaatagcaacccagtgtgatgtccacacttgatgacaggttatttccttctcataattaacctgaacgtgattgagcctggggcaagatggaaaagtgtgtggttagcacctgtaggcaactagagttcaaaacaaacaaacaaacaaacaaacaaaacaggcttgctaggagttggatagcctcagtaaacacagactgagtcaacagagtaccaccttttttctttcctaggggaaaaaaatggttcatggttaattaatggaaaacaggtgtttgtgaagtattttactgttaaaggtactacattgtgggtataatatcctctcccttaaatagcatttctgtttttctctagggtttcttttgtcttcttttctcctcaactgtttcttatgaacaatttgaaacatacaaagtagagaaaatattttaatgatcctccttgtatccatcacacagtttcagcaaataatgagtcatggcccagtcttgcttcacaaactctgccctactccccacagtgaattattttgaagcatatcatttcttttggtttttattttctgctcacatggacttcaacttatttcctgcaaaatggaggctttttgtgttctgcacctttcttttgaggcaagtcaggctaccatccctgatcctctctgtgggtgtgtaaaggttctgcagatggcagtacttgcagtctgcttatatcttatgtgcagatataaaccaagcctcagacaggaatcggtaaaatccaagttccctgcctcagcatcacctcgtgcttgttgaacattaatgcacatgtaaggagcagtcaggtgatttggttacagatcgcccacacttaagaaacacctccatagatgagaatcagcgtggccgtgacagtgggcattgtccttgctgacagctcctgtgcgtgtctccttccttgtaagctcttcactaacgcgtaggtgcaggaacccccagagacccagaaagaccctcctgtagcagggacttttccccagttgcagcgtgtgggccaaatcttgcctgcatggtttttgcattgcattggttggaataaaaactcaaaagatttcatgacatgtgaaaattatatgagacttcagtgtcagtgtccataactaaattttattgaaacgtagtgacgggcattcatttacttgtctgtggctgcttgctgcatacagtgaacagcagagttgactacacacaacagagaccatatgacccaccaatcccaaaacacttactattggttctttacaggaaaagtttgctgaccactgttctgatgaattccttggttgataaaaggaaacccaatctgcagaatcgcagaatacagtcttattattcttgaactgtctattttgaaggggagaatcttcaaaataataaaatccgttagtcttaaaccaagagttcattcaatattaaagaaacatgttgagttagaaggaaataatggagagtagaaatggtttcacataagaaggttgctgtctttgtccacttttatcattcactatctttttttttaattattatactttaagttttagggtacatgtgcacaatgtgcaggtttgttacatatgtatacatgcgccatgttggtgtgctgcacccattaactcgtcatttagcattaggtatatctcctaatgctatccctcccccctccccccaccccacaacagtcccaggtgtgtgacttttttatggcatacacctggttgggagcagttcacatacagagcacgaatagcgctgttattgccccagcttccaagagccatggaccatgagaatggtgcttgtgttctgttaagcccctcatggtatgtaaatatgcaagagaaagagtccagaactttcatggaatttccattcaaattctccagaatcgctgcccctgagctggtttagagaagctgaagccttgttacaggtcttaggagttataggaagaattcacggggaaacaaatctgcattttgattggagaagaaggcagacgttgttctttaggccccatatctttataattttgtgcttactggaaagtaacacctggcacaatccatgctgaatttctgaaccctcatgtttcgcaattcatggagaccatgcacatgtttccatgtgcacagtaggatggggttcccaagctgtgtccaatttacagttttgattggttcttgtaaactctaatctcaggagggaagtatgaggtatttataaatcacagtcctgtgatctaggtatcaccattatctccattttacagatgaggaaactacgactcagaaaagtgaggtagcccgctaagatcacaaagcatgtaagaggccctgtaacccagatctgtctaattactccacagctcacatgcttaaccattctgctgttccgagccctttccagaatgtacatggcttttcatgagcttgagcaggtcaccctaacctttgtttttcttatccttgtctagaaatactgacctttaccaaaagccattttttttaagtaaaaatatcagagccttttcttgctgtgccttacaacagtcggtgtgttgtatttagttgttcttttataacattttttctttgagggggaggggaagtatctacagtttgcattagaagtaatgggctttttaaaaaaagattaaatgaaagctaaggttgcagcagatagcaaacacaatcatctgggatttgtgccattaaaaaaaattcctttagaaagggagaagtgaaatttcactatttaaatagcatttcagtgcaagattgcttttaatcacattgttgttgaaagtttttattgcagtatttctaataaatgtgcccctctgattattaaagtattttttgattgaagttctaagaaaaagaagcctgttagtagacttagcagttggagttactgtacttttgagaaaaaggcagagggttacatttatattcatcttgtacagcagggattataataaatgagcagaagaaggagaacgatttttgcatttcacccactcataacgtaaaactagattaagtattcttgttcttctttgtaataaagaccctgctagcatgaaatgtttttttctcttatatgtaagcatatggcaaggaaaaagcactagttcattatcaattagattcacaatcttaaaacagaaactatttccctcccaggttatacagatgttttccataatcctgaactccagtcatgcaacagaaaaaaaggtaatgcttttaaccagtggtccccaggctttatatttcaaacaagaaagtttcagaaataatttggggactccagacatacggttgttggcaatttatatgtacttcccctcaaaaaagtatgagaacattgttttggaataaaggacagtcctttaattgtgaaaaagcactgtggtcttcgcagagaagagtatctattttggtgtttgagtaccatagctttaaatcattatttccaaaagcgtgttccagggaaccctgtttctgtgtgctcttggttggtgttatgcagaaaagaggttccatatggcaagtttgcagaagttagctttacacagagacagttctgggaaccccagttctagaattaagcctgggctcaaatctaagatctagtaggtgagcaatttgaaggaaaccgcatagctttactgagcctcacttgactcaggtataaaatgagaataatgctagtaactaataggggttgggagaattaaatgatataatgcaggttatcagtaatgaaagcacagtgtcacaagcacgcctttaatcaagtcatcagccaggactgtcagaggagcagcagaaagtgaaatgccagttttgctttagcacacaaggtgtaggcagtgagaggaaactctggcatgacagagtgtagcaaatgaaccgcagtttttttctttttctttttttttcttttttattcttttgaaacagggtcttgctgtattgcccaggctatagtgcagtggcatgatccatggctcactgcaggcttgacttcacttcctggtctcaagcaatcctcccatctcagcctcctgagtagctggggccacaggtgcacactaccatgcccggctaatttttgtattttgtttgtagagacggggtttcaccatgttgcccaggctggtctcaaactctggagctcaagaaatcctcccacctcagcctcccggagtgttggaattataggcatgagcaatcatgcccaaacctcagtttcatgccttcttggactctagtaaaaatgggaagtgggaggtgacatttcttagttcctcctttagccacctctttgacttgcagagagaagcatgatgtgggtatttactttttcctgcttatgcagagttgtacttgctcatcttctggaagcctgtagtttgtgcttctttatgctgctgcttgtaatgtttttcaaacccccttttttctgggcaaaaaaggtaaattataggcaatgtaataaagtcatcatgaaggtggggagtggatcagaaagataaatgaggatcctacttacatgatttttttaatgtgtggtgatagtcatgggggttttctgcctgtagagggaatttagaaaattgccttttcagttcttggaaatttccaatttaacttagcagttcttcacttaaattaccttgttctttttggaaactatataggaagattggttttaatggaaaaaattattacagaagttaatacatgctcactgtaaagattttactaataatagaagtatggaacacagaagccatcattctgtgtaatcccactctgggccaattttgtattttcagttacaggatttggacttagggcaaatcacactcgatcaaggacacctatgtaactactttgggcagttactggtaagcaaaactgaaacttgccaacctggtcatttcactttctgaccagtttcagaccgtgtcctttagtaggcctcagtgtattttgtttattttgtgattactgccttgagaatcctctgactgttttgccttaacttcactcatttagcttttatcccatgttctctgggcctcatgctaggctagataaagtctgaggatacaactccacagaaggtgagaaagcacagtcctaactcccaagtcaggcagttggtcagcagatacttaagtgccaggttttctgatgggtgttagggatagagtgacacaaatcagatggagccccagccctctagggaagtgagatacagtaaatacacaaatatttccaaggactgttgaatgctgtgaagtcaaaagtagggtaatgagttggggttagggggattctaactaacatgatcaaggaagacttttctaagcatttaacatttgagctgagaccagaatgccgagaaagaagtagccacaggctgggcgtggtggctcacacttgtaatcctagcactttgggagactgaggcgggaggatcacttgagtttaggagtttgagaccagcttggcaacatagtgagaccccatctctacaaaaaaaattagctggtcatggtgacctgtaatcccagctactcaggaggctgaggtgggaggatcacttgtgcccaggaggtcgaggctgcagtgagctgtgattgcgcatactggactccagcctgggcaacagagcaagaccctgtcacaaaaagtaaaaaagaaagaagcagccatcagatcatctggaaggggcactctgagaagggaagggggaggaatgtagggaaataatgctgacaaggttagactgtagaggccaaggaaaggaatttggatttaagtgtaatgaaagttggggggatagttggtggttaggggtagcttcagcaagggaatgatctaattcatgttaagatcactggctaatatgtggagggactggctgaccaggttagaggtaatagtggcttggactttgctaatggcagtggtaatgcagagaggttatcctgttcaggatacgtttggaggtggagtttacatgatttgatgaaaaattggatgtggatgagggagaaatataagaattgggatttggggcttgagcaactgaatggtaccacttaatgaactgaggaatgctggcgaatgtgggagacttagggtcagcagctctgattttggccacactgcttttgacgtacttagtgggcattcatgtgcggctgtggtgtcagcagttgaatacacaatctggagcatggtggagcagtctggggtggagactgggtcagtctgtatcctcaacatacagaggacatggaaagtcgtgggacctaggtttgtttcctaatataggagtgtcaataaagaatccattagggccaagggctgagccttgggtccctccacagtgaggtggtgggtgggcgaggaggactcttcagtgaggcagtaaggaaaccagatgagtgtgatggtggtgaatctgggaagagagaagaacatgctttaagtgaggagtgatggtctctgttatatgctgctgtgaagtaaagtcaggccagagaatcgatctctggctttgacagtatgaaggtcattaatgaccttaatctggagagttggggaggcagaaccctcattgtatggggaagtgatagcctgagctgaagaagtggagagggcaagtatggacagctttttaaagggtttcactttgaaaggggattggagaaatgaggcagtagcaggatgaagacatggggtaaaggatctaagggaatgatgaggaggtttgttttattttatttggatagtattagggaatgtttgtctgccactgggaatgatccaagagtaagggataattggtcacatgtgaaaagaattgataatcacaagtatagtaccttgagttggaaaaaggagatgcaactcagagtccacatggacaggctggttttggatggaatcagagactttatcacattctcatgagaggaaaagcatatggattcagttgcaggtagggatgtagaattgtggaataagatggttagttcattctcgtcatttctgtgaaggaagagggaagttgggagatcatctgttcacagtaagaggaagagttttgtcttcctttttaagtatccagtcaaggatacagggatacagccaagtaacaacagacatttatgcatcctttgtagtagggatccccaacttctcggctgtggatcagtacccgcctatggcctgttaggaaacaggccacacagcaggaggtaagtgggggtgggggactgagcattactgcctgagctccacgtcctgtcagatcaatggcattagattctcataggagcacaaactctgttgtgaactgtccatgcctgggatctaggttgcgtgctcattatgagaatctaatgcctgatgatctgaggttcccctgacccccccaaccctggtcagtggaaaaattgtcttccacgaaactggtctctggtgtcataaagattggggactgctgcttcagaggcttcccagcacccttagaagaaaatgtaaactccctagcaaggcctggatagtgggagtgtgtgcccagaaaatcagaaatctcagcaacttgaggtggaatcctgtcagagcactggggtgaagaagtagagatcaggaaaggaaggcttcctggaagaggcgaatggggagagttggagagttagccagtctggtgtggaagcagcttgtgaggctggggcatcagtgtgtgggagcctggaacttgttgcagccttggcaggtaggtagtggaggacaggagatgggagtagatatgtttgaaagatcactatggtagcattgtagaaatgaattggtggtagctaaagttaagggccagttgggcatgtagccacctccctaatgtgaaatccccaagtttctaggtaatgataaatggaggaagtggaattttaaaatgtacttatacaatcaaatgaatcaaaatgaattgtttctccccggtaaaaccctttaatggtttctatttgcttgcctttgttcgttcatacaacacatatttattgagcatctactttgtgctaggtattttcaggaaaacaacagcaaagaactgccctctaaaggtttattttagtggaggagacaggcaacaacaacgagttaaagaaaagtatatggcaggtggtaaggggtgttttggaaaaagatgaagtatgggaaatacaattttaaatggggtgagaagggattttctgagtcgtgacttgtaggatgtgagagcttcagtcgtgcatattgtggataagctttcacacagaaggaacagcaaatctgaagtctctggttggagaagacctggtgttttgaagaacagcagggggcggagtggctggagaggccagtgtggagagaatgctgtggaaaaaggtcaggtgctgaagggttatgagtgagttgggcaggcagatcacacagggccttgtagcccactgaaaatccaaatcctttactgttgcctacaggctccacttgggctttttcccactcctcagttcttgcatatgctcttcccactgacgggctactgcttctcctgctgccccacacctcttccctgatggtttcttctaaacctgctagacttaggttaagtgtcaccgttttttttaatttgtcctaatgctctccctccccttgccccccaatgcccaacaggctccagtgtgtcatgttcccctccctgtgtccatgtgttctcattgttcaactcctacttatgggtgagaacatgcggtgtttggttttctgttcctgtgttagttggctaagactgatggcttccaccttcatccatgtccctgcaaaggacgtgaactcattctttttatggctgcatagtattccatggtgtgtatgtgccgcattttctttatgcagtctatcattcatgggcatttgggttggttccaagtgttgctattgtaaatagtgttacagtaaacatacgtgtacgtgtgcctttatagtagaatgatttataatactttgggtatatacctagtaatgggactgctgggtcaaatgtatttctggtaggagtcacctttttgaattttccacatcactctctatattgctttatagccattatcaaaagatatccattgctgtctggtgtcaacataaaccaagccatcactcttgctgaaaggtgctgttattgttagatttggggtataaatgccaggtagaaggaattatcatgagaagtgtttacataggtcttggctaatttgcacaattggcccggagggggaaaacagtatagaccacccactaataataattcttgttgaaggagggagataacattcacggcataacactcccctgttggtgatagagtgtggttcgtctttggttccagtgtcctggtattcttttttgattgagtaacaataagccgtgaagagagaaatggttttggaatagctggtatatacaaataaatgacggtgtgcttgaatccctctgttacatcaccagggttttctttcccaagataaactctgtgcttttttccagcctctgaataggatatttattttctcccttccctttatttctgtttctaggcctttttctttccactctgatgaactactgtactggagacagactcggtgtctgctgtagattttaaatgctacactttctgttcctcttatcttagccccatgtctggtgagcttttcattgttaactggcagctgcgatggctatttcttcaaaagatgttgttgtttggtagatgttttcttaaaagctggtggctgttgctgaaaataatctgtgttgtgtgagtttataatctattcatgaatcatattctcattgtggttgtagttacgctagggtaacaaatacaacaattaatttttttattcatcagtgctgggtagtctttgtagaaatttcacaaagatcctctttttttcttcactagtaattctgaagtaaaaatagctactgaaggctgagcgcagtggctcacgcctgtaatcctagcattttgggaggctgatctgggagaatcacttgagcccaggaggttgaggctgcattgagctgtcttcatgccactgcattccagcctgggtgacagagcgagaccctttctcaaaaacaaacaaaaaaacagctacttatatataggatttagatagatggcaatcaagaattatgaacatgtgacaaatccttatagctatgtggttgcatacccatttttttttttgagtgccaaggtatttttgaaaagtaattgataacttaaaaaattaagcatcttagacaatacctggtagaaagtagtggtagtaataatagtagctctcattctttgagcacttactgtgtgtgtcacgcactgagtaaagagctttacatggactgcctcaatccttacagcagtagtctgaaacaggtatttatattatccccgttttaaagaggaaactgaggctcaggaaagttacactgtcccaaatctcactgcttatgagtggcaaagctgcgattcctggtctggctcaccccatggccagatggttccctgatttatcaattcagcagtggcttatttctgcatgttgagctgacatttgtggggacaacaggaataggcttttatttattggtaaatgagtaaagcatcaggcgcactccagagagcagtttaaaatcagggaatttgcttggttaatgttttagataatagcagcagtagtgaagttctggtggagagggggaaatggattatgtcaggaccttgggcctaaaacctttgcgaggcttgagtgtgcatattagtccacataagggttcatctaaactctgtagggtatatagtttgtagaatgcatggtggagaaatggttaactctgagaaagcaaatcctaatggttagttgagacaggtgaaaacaattcagaaattaaacataaaagggaaatggcgtatttattacccacttaggacaatgtctacatctgagaagataaacacaactattacaacattttagaataatgcatggaaatcattgtaatccaaagattatctaggaagctttctctctctctctctcttttttttttttttttttgtttgagatggagtctcgctctgttgccaggctggagtgcagtggcgccatctcggctcactgcaacctccgactccctgtttcaagctattctcctgtctcagcctcccaggtagctgggattacaggcatgcgccaccatgcccagctaatttttgtatttttagtagagaccgggtttcaccatgttggccacgatggtctcgatctcctgacctcgtgatgcgcctgcctctgcttcccaaagtgctgggattacaggcgtgagccactgcgcccggcctgcctttcttttgagaattagaattgttaatttttactcgtacccattaagcaaggctctggttgatattaagtaactaagtagattgatctgacctctcattcttttttccccatctctgcttgcccgggtggtaatgctacccagaaaggaaataagttcaaacaacaacaaaggacagaacttttcatcagatattttctttagacttggtcatgttacattactgtggccttacctgtgtgtgtcagggcgggcacaaggccgatgggagtttgctcaaagaccaggccagcttgctctctctgaccgcagagcctgtcccagaaccctgtccttggctcatcacacagtggttcacactgtatattgccagtgagctgactgacaagtagtggagagatgactgagaggctccccgatccatccacaggaactgggaattacctgcccagtagtctttggcaggaatctagggttttgaaatggttatgactaaataggacataatttttttaacatgaaaaatgggtcttaatatatattttaatggttctgaaatagtgccgaggactttgagaggtcaggctttaatgcttgatttggtaaaatttaccagcccctgttcagagacagattttccttgcattttaaaagataagtttttatttttattcccaaatccccaggaaattttaagtgctgtcagttttgtgaaaaggtaactagagagtgagtagggaatataccttgcaagctattggtttggcctcattactcaaattcttatttgcctgatgaagatatcctgtaataggatccctttgtgtgtagcccctccacagctttccctggaaggccttggccatgattctgtctatatctgggcactgtcaaatgaagagagaagtccagagtggaagaatagccacttgatctttttcaaatcccagagtttacaattttttttttttttttgaagatggagtctcgctctgttgcccaggctggagtgcagtggcgcaatcttggctcactgcaagctccgcctcccgggttcaccccattctgccttagccccctgagtagctgggactacaggcgcccacgaccacgcccggctaattttttttgtatttttattagagacggggtttctccgtgttagccaggatggtctcaatctcctgacctcatgatccgcccgccttggcctctcaaagtgctgggattacaggcatgagccaccgcacccggcaagtttacaaaatttttaatggattcgaatgtatctgtactgcttaagaatttttgcaccaagttttaggacactagacaggtggctacttctgtgaagatacaataagaacttgcgcattgattttgttaaatatggctgttgattgccgtatgtggcttgggagagtagaatgatgctgtttcaaagaactgctaagaaaaggtgagacacaaggatctagaagaggtggacccttaacgctggagttaatggtatatacagtagaagttttgtttgtttgtttgtttgtttgagagaaggtctcactgtgttgcccaggctgatcttgaactcctgggctcaagcattcctcctgcctcggtgtcccaaagtgctgggattataggcgtgagccaccacatccagcctacagcagaagtttgctgatttattgtttctagtgctgatcttcttgctgttactaacttgtaaacacccgcccccccaaaaaaaagtagaggagaaagcatgaagcttaattaccccaagttgtattataactctgataaaggttttgtaggcaatagctgtgaatacccatgtgtggaatctatgcttatagtgtgtctggccttgactaggttgtcaggggctcagggagagcccctggaggccatagaggacacttcgggactttctcttgctacagagagcaaactgaaggcccctggctaatgaggccgctacaggtctgatccagtgttctcttttccttatggcctttttgtcttctcttcagagaaaaggaacattattgccatctatttttttattttttcaaatacccttgactgtatttattctgtattaggtgatctcctttgtctccacccataccctctttaaattgccccactgcccctgaaacttttactttaggaaaagagtttacattaaatgctgctctcttttagtgtctcccttgtcatttaggtgacatgggtggcagatgtaagttttaacgataataaaactgtgtcaaaggaaagagaagcctgaagtttggaagtagacacaggaaggacgagggtgtgggctttgaaatcagggattctcaaactggggttatttgagcaatgggaggtccttgcatcacttcatgtatatgtgcaaaatattggccatatttacctgagtacagttttgtagggagagaaaatataccttccaacagattttcaaaagccctcatgactcaatagtgtttagcaccaccaatgaatatccaaagtgtttttttataagatcatcacaaatttccattattattttacttgtacttaaagcaggtgtttgtgcaggttcccatattcaaggtaattaaaaaattttttaatttggtttctaaatgttttgttttgcttagtgcattcactgctgtgttttctgcaatattaattacagaaacatacagtattttggctgcattaaaagttaagagtcagaagtaggccaggctgagaagatgaacctttttttgtcatagtaataccacataggcatgcatcatttcagatagacaaaaaaatttcagtcctacctgaggttttggaactgaagttatttgtaaattaagggcaaatgggagacagactttaggacttgaggtggcagccagggtgatctttctaatactctcatataatagggtcttgtttttaaatgacttcattgattgccattgcccttagggtaaaggtaaaactacttaatgtggctggtggacagtgttgtatttgcctaaggccaccacagcctctaaactccttggctttttcacaggttatgtgctgtccctgtgtaggtacactttcctttttcccagacaatttccctctgctcctttcccgtgacccctttccccaagaaagagaaaattacttctcatctcttagatcggggcttaggcagtagttcttccaggcagcttccccaggcctctggtccagttttatgtctgctccttgctttttgtgttcagccatagggagattgttacatgtcatcacagatagatctgtctaattttattcaactaccacctagtttttggtattatgggtgtgctattcttgtttaaacttgacctttatggatggacatacagactcttggcagtgttgctgcttttaccgacagtcctacagttatttttacaagtttatttgcagtagtgatgcttttgtttgcttgttttgtaagtaaactcagacaacttaagagtgtatctaaagaggtaatgtcaaagtgccctccaaaaaggctctactagtttcaggtgtcagaggtctatctagatgacagagaagtatgttttatggctagggacatgtttcctttctctctgagtctctccctaaggaactggcaggctctacctttttttcctgtgtctccctttcttcaagttttgggctgttgaaattatagttttctgtcctgtagaaacttagagccctgtgattttaaaatgcagtctgaccttcaaagtagtcaatgttgttgttaaaggaagaattaattgtaggcttcctggttataataatgttcttcatccagcatctgaaagtacctaggacattagcttttttaatccacacaaaatctgaggtacagtttttgccaccttgttgttgactttcttcatgtactctgcaagccctggcctccacagtctcaaaagcaaaaactgtttttgcctccctcaagaaagtctgtgatgagtgaactatatatcttgtaacaagattttggggttgaacaggaaacaaaatgttaagtgactatagtttcagctacttttcttttgcaaaaaagggaagtaaaatttccctgtgactgtggtaatgtcccttgtatccctctcaattaagtggtattctctactgggtattgaaataaacctgtgcaaagtagtttgttatataacatttaatgggcaataaaggggtgcgcagtggttcctgctgaatgggtagtcaagttgatgcttcataactgtcgttacctattggagggagtggctagttgattttctcttttctgttgtttttttttttcctaaattagccagtatggttatttattttaagatatgaccctgggttttccaaaacagtggtgattggaaattgcgtagttggttgaatcacaaatgttgtacttaaaaagctacttatgttcatcattgtttttagaatcatcaattggcctaactcctttgcagctaattgctgacactgtattcgtattgagaagccaaagactaattcctccaggagctggggaagtctgaaaccacccccttgtgtcctgtcctttcatacttcttgcctgctggcagcctcttccacctcccacagcctactcattcctgcctactcggaggctatgatagagtctggcctctttggcgcacagtgtcctgatgatttgccgcttctgggaagaagattcacagagggaaagaactgctggttttctgggttcttgggggcaggggatgtttttgtttatgcttatgggaaccactctgagccatgggtggagaaatcatacagtcatcctacttctttccagagatcaaaattgaataggggtggggcactaggaaagagatgttcttggtgagaggcagaaagagaatatttctagatgggaactgaaggaatagagagtgaattgaggagtattatgttgtggtgactcagtttttaaagtacttcctctctgagttcctgtaatcaccaagaattttgtaggaacttaatgtttgttgcacagcagcatcagatttctgggttagagtccctaccgcacttaccacagaccttgggcaagttatttaacacctttttgtttcagtttcctcaaagtgggcatggatttgaattgtgtctcccccatagggctcttacgagaatgctttaattaatgtagagtttctcagtctcaacactgttgacatttgggctcagataattctttattgtgagagaatgttctatgcattgtaggattacagtagttaatcttgctgtgtgttagcagcctctctggcctctaccactggattctagttgtgacaaccaaaaatgtctgcaaacgttgccagtgtttcctgggggcaaaattgtctgtgcttgaaaaccacaactttaatatatagaaagccctgagcacagtgcctggtatgtagaaatgttcttcagtgtttactgcatagtaggtagcttagtaaaggtaatgaatgaatgaatgaatgaatgaatgttgatgctgctgctcttccactattgaaagagtgctagttcctttctcaacagtcacattatggaggagatcacttacggcgattcctgtggccctgcagtaactaaattatttggagtggctaccaaggggagcactgtctccctatcttgagtttcactggtattgcacagtggcacctatgaagttccagagtagcccttgctctgtatagtcttatttccaagatgcctacttttctcttgttttagtatttctgaaatcagaatggattataacatttaagggtacattaaaaaaaaattattcccccaaagctattcacacacactcgatggcagctttgacattaaggaatgtggtatttctgtgaatatctgggctttgcaactgaattggaagctccttatgggcaaaggctataatactgtgcctttttttccccagtagtgagctcagtgactggaacatactgcttcaaacttttgaacagtctgcactttcctgtgttgtgtgatgatgcccttaaactgcctttcgtatggttttggacctttatacagctcaggacaacaaacagtacagtctttcacatgatgatattagtaccaacgttttttttttcaatagtcactgttttgccctttcagcaatgagtttgagtggttatttgatcattttactgcattttgctcattataaaagtgagtatacagcacaaactaatgtccagatgctggggataaacagatatgtcgaaccttatgtagcagggttgcatcttaagtgttgttagcttaggcaaattgtactatatgctgtaaagaaagaaaaatagtgtggctaattttaccagtcattcaatgcatattgttttgaaatatgcttggagtaggaggtatgaatcaactaagatgttaagatgtaagtcccatgagggcaaggttttgctcactaccatattttcatgtagaaagtaccttaaacatagtaaacacacaaataattgtggaacgttagtcgcttttcccttattcagtctcaattcctgcaagtctctcaaactataagcatcacattgtcctgtgattccggtatttaattatatggatttttttttcatacaataaggcctctaaatgcaagccagctatctcacctggttgaaacagccatctgtgctaacatcagtgacacagcttactgtgtaggacttaactggttggcctccatgtggtgtctgtgaaattttcaaggattatattagctgacttgaaaatagccaactgaatgctcccttaaaatggaaacctgctataaaatcaagacggaggaaaatcattagatatacagtaagttatgacctcagttatatgttaggtggtcttacgctagtcaagagactgtcgtgtttacctttgaagtgctggaaatatatcccttcagactgagtcccaaaggtgaggtataagtagaaattttgtgatttgaggtggggcatacaggatcccaataacctcctgtttgactttctcacatatggttttgtgtaggaaagtaggaggaactgcctgtgataggttctaggtaaatatttgttgatggatttaacctcagattgtaacataatgaaagagataatgatctctccttgaatacagcttgatttttctttatccgtgattctactcagcccatattttgtacctttgactggttggtccgttttctagtctgcccctttcagtcccagtggaatattcaagcttatagtaaagaatgaaaatattatcattttcaaatgaccacaatctaatttgtaagtgttctacaactgaaactcatttaaagaaaggcaacaagctcaatgataagaagtctaaaaaataagagtgaaaatgttcctgcctagcctagtgtaattatttttgctgttcagttgcataggcaggctgccagaagatgggggtacgaattaattaaccaactgtttgcagagatatggccatgtaattactgataagcatggacgtaaataaggcagtgtgtcgactgtttttcagaaatgagggaagacagaaatatgttaacaaaaataaaatagaccaaaggcttagtaggggaaaagaatagtttctgttggtttccatttattagcgcataaagttcttttttcttcttgtctttaagtgctgaatgtggggaggaaatgtggattgtcacattagttttttcaaaaatacttgaatggtttatgcctcaaatgaacatatttggaactcaacccctactcaaatcattttcaatataatttttttgtacaccatagtttggggtaatagaggtttattaggccagtggtgaattttaagtagtattatgtgtaaaagtaacttacgtgaatagttttacatacacaagtgtcttaaagtaaacagtatttgtaatgtaagacgctgggtcacttctgtaagagctgaatttttaagttacttgtttactcttccctagagatgaaacatagtaggacccttagtaaatatgtgttggaggaaggaatgaagctttgtaaccagtgacgtatcattgcatgctggttagggactgggatcaggagtcaactagttttaacctttaacactagccccacctcttgtcagctgtgtgatcttgggcaagttacttaatcttgcggtgcctgcctgtttcctcatttgtaaactggggttaagaatggtacctatactacagggttgcaaggattacgtaacataaagcatggaaagtacttagcacactgtttggcccattaagttctcaataaatgtttgacatggtagctgttgttaggttgtattttaaacatttgcctgaccttttacttcagaagcactcgaaacaaatctgggaagaaataggtgttttaggttgagacatcaatctgaattgtagctggtcagggtgttagctgccaaccacatttgtttgcatatggttgtggtaaagtgagctttgagtaccttgttcaggtatgttgaccaggttccccgggaaggacaaatagtgaaactgcaaagtctgaagaagtaaaactgagataagagaatgcatgatactttcttgtggaagtattgccattaggtcttctagtttttgaaacagaaataagcagatgaactaacgatcaaaacaaacttgcatttaagtatttcccagtggtaataaactgcacctaatctgtttaaacagaaaaagcctttgtaatattaagaaggattaggagtagaagtaattaaccagcagttaacactcccctttcccctcttcagtgttgccttacaaatctctcccctcccctttccaaaccagagaaagcagctgtacacatgggttttatgcataaagtgagacctaaggaaaatgcattcaaagctaaaaaggtacaatgttgagagaagttggcattaaaaccaaaagaacagttcacacttacaggacctggtctgaccaagtgctgtcagctgtgaggcaccatgagtatttatggaatgagtggaaaagtgaaggagtctgattgatttgaattgttttcacaagcatcaatgaaagcattaagttgatgtgtatgagtgcaacagaatcttttggacacaggagatttatctttatttttattgtaacttctctttaaataaagctacctttggggaaaactttagttcacttcagtgtaagcaattagtagtttcagatattaatgcatggttctcatcattcttggaaccatattttaaattcctgggtgactttgaattattgatacttagtatgtgtgccttgccttttaaaatttttttaatttttttttttgcatatggaagaaataaagttttaggacttgatttgtaagacatttgcctgaaactaggggagaatcttcaagatgatggcttctttggtatcttggctgtctcagaggcccttagaacttagatgtcccacatatatgggcttcattctcagacctggcattcttccaggattctttctcagagactgatacctcttatccatccatcctgttctgtaagatgggaagcatggcatccttctcttcaccacctttgtatccaggctattacaaagtcatgtcaacagttccttctaaatgtcttggaatcctttctttgtcatctcactgccatccccatgtctttcaccctgtactgctgcagacagctcttgattgacctcctcacttccactttcaaaccaagcacctcccttccccatactatagtcgaagcaatgttgaacataataataaacaaactgatgatattatccttcattaaaatgcttctattaagcactaacgaatgtcagagtaaggacctccaaaaatctgctctgccataaaagcaataaaagcactggcaagaattgtcaaaatcaacttgtttagaattgtgcaaattaaccccaaaggcttgcaaattcagatgagcatatattcaagaaaaatggctgaatctgtaagtacagagaattctatagtgttttaacttgccctatttcaacctctcctccccaactccacagtaactttgaaaaccagcagcttcacaactagggtagccgtgaaagccagcagtctagcagccactggaggggacagaatgggtttggaactcccccaaagccttattttcagagaattgtcactgatgtatctggtagctccctgaaaagccccattctcaggacttgtctttatttgggctagctcagagctcattctgtgacctattcctagggtgttaaaaaaaaaaatcagcagtgattcttcaatgtcacagttgcttgaggtggtaatgccaactggggctaagaagaggctgaccaaaaaagtaaataggaaacactggggaatgagatgtcagttgggggcttcaaagagttccaccatactcctgggaatccagaaaaccacatggatgtgtagagttgtgcgcatgcccagaaaggacctgagaaggccctaatctcacctcttgctaacctggaggctgtatacaagcaggaagtgaaggctaaagcagagtcataaactccctgctggagcattgaggccatgccccatcacacacacacacacacacacacacacacacacacacacacagcccctcagccaaggctgggagccttacggcagacataaatgctacattaaccatttaaaaacgtaaagacaggtcagtagccaatgccatttcataattaattctgttctaagttgaatgagagccatggaatttacacaatatacctgacagatgtggtgttgcaatgaacaaaagaaggaatggtattcttaactgagtcatgagattataatcataaccacaataataataatagtaacaaaataaacactgttctttatcgagcccttatgtgtacactctgcttactgtgtttagacagatatagaccgcaactttttacatgaattatctcattccgtccaacagtccattaaagttgatactatcattttcaaatgtagaaactgtatgcctagatgtgcctagaggttaagtacattgctggagattacaaaaccaagctaagtggtagactcttagagcccgtatcctactctagactacatgcttgtccaaatggtagggatgcagacaagatttataaggtttttggtaggcacttccagatttgggacacatggcattgaaagcttgttttctgacttgagaggtcaggatttgctgacagtattttgaggagtagcttaaggaacccgtgagacaaacctgtcgtgtgtactgccatgttggtcactgttgtagccccacctgccattcctaacgcaggttcctcaggattttgatatttgcctactctattctatccccagcattttatctcaatttcagtacaagcaatgacaatgtaaacactgtaactcttacctgttaggggtcactattgataatattggccatttgtaattagtgagtaattaatattaggaatattttcatctttctagctccttggtcgtctggtgcaggggtccccagtctctgggcagtggaccagcaccagtctgtcagtggcctgttagcagtcaggctatggggtggggggtttgggagagagagaggaatgagcattaccgcctgaactctgcctcttgtcagatcagcggtggcattagattctcacagcagtgtgaaccctattgtgaactgcacgtgcaaggtatctaggttgtgtgctcctagaatctaactaatgtctgattatatgcggtggaacagtttcatcctgaaaccattctctccttgccccagtcccatggaaaaattgtcttccacgaaactgttccctggtgccaaaaaggttggggactgctgctgtggtttttgttgcttgctttttacttgaaacatctcactttattttctttaaatctagtatttattgactgctttggtttacgcagggccagacctcatacatttagtagcttgctgattggtctctcgttggttccatcatttgacatcttttggtcaaagggaaatccagttatctttaattattggagtagacaatatgaatctgggagttgtgcttatggaaggtggaaataaaattctacctttttcctttcctacttgagactaaagctcacttaacagcaatttaaaactttaaaaatatcattgatgctacttttgattaccgactattgagagtcacctgttgaaataaatttggaactgactgtagtaaaacctgttacgtggagaccagccttcctcttctctctggtttcttagaaatatatccaacaatggagccgagagtcctagcatctcaggaaacctatgagcagcggtgagagcagacagtacagaggtacccgcaggagtctgctggcagataggaacagcttgattgacttttcatgaaatgagacagaagagcagggatttcctgggagaggtggagagtaattcaagaagggcactgagtagtggaggagctcatctaataagatggtaaagagcatgtactttggagtagcctaccttcacatcccagctcctctgcttactgactttgtgacataaggcacacagcctctctgtgctgcctcacttgctttctataaagtaggttattgaccctgagaagtcaaatgagttaatacttagcattgtacgtggaacacaggaggcactccataattgtaaactgttttatttttgttatacgtatcaacacttcgcagggttttttttcttttgtgtagggttgtgatttttgttcaccgatatatttacccaataccttgaatagtgcctagccagagtagccattcatgtatttattcagtgcataaatgaatgaatgatgtatttagaatacctgccacaataactgacacccattaagtacttaatacatagtgttacaagaggtagtggctacagaccagtagagattgaagcagtggctagtgtatcccactgatagtaaaaatagaaatgattgtaatagtattacatacatagcacatgctccatgccaaacacagttacaaaagttttatgtgtggtaattctctttatcctcataactacccttaaggttgctgctataatctctattttacaagtgagtatactgagcagagtaacttgcccaagggtcatgctcctaatgagtgataggattgggatttgaactcagttttattccagaggccattctcaaatttttttgttgaaaacctgtgtgtcaggtactgtgctatgtacttgtggcccctgacctcatggagtttaaatcttaatgaaggagatagccacaacacaaataagaaataactgagtgacaagagagaattgtgtgaagccacaggggcctgccttaaattgggtattcagggaaagtctttccaatgaaatgtgagctcaagcctagagccaggcaggcaaagcattccatacagagggaacagaactagcaaagggcccgaagtggggttggcataattgtcaaggatttcagaatgccaaagcggagagttcgaagagagcagtgtgtcttgaggttgccgatgttaggcaggaccctccagtatttgttattattctgactacattgtagaaccactgaggagattaattgggcctgatgacatttatgatttaaaagtatcactgtggttactggggagcagggggagtgtagagtgggccctggtaagcacggccagctcagagaccaaaggacgacagtggagaagatgataaaaatggcttgaatttccaaagtacttactgtgtaggaggcactatttgaagcatttacatatattcgtgtagtcctcctagtagtctgtgaggtaggtactttgactttacccatttagaaatgagaatattgaggtataggctagtaagtggcagggctgggatttgaacacaacttgagttcttctattctgtgcctaacccttcatgtgtttatattagctgcagtaaagaaggaagaaactacagactcatctttggattccttcctctgcctcagcctcacatccatggtctcctgagctctttgcagggtactctagaccatgtcttcagtctggtttcactcattttcattgtatagtctcttcctgtctcactctattgcatcagcctttgggagctgccttccttacctaggtcaatacacattcatggcagagttaccttctggatcttgtggtttccttgctaaaagttgtaggttgcccttggcttgcagtattggccctctgctgctggagccccagcatgcctcccctacctctcccttgcatggccttcagggaggagtgtgtggccagcagtaggagcacaagaccacttgagagttaagctcacattgtgaaatagtcagttgctaattggtgtatatagttgttcccccgtatctgcgggggatactttccaagatccccagtagatgcctgaaactgagggtagtactgaatcctatatatactgttttttcctgtacatacataactatgttaaagcttaacttataagtcagacacagaagagattcacaacaataattaataataaaataataataattataacagtatgccagcatttttattcttgtgctttggggccattattaagtaataagtattacttgaacacaagtactacaatagcaggagttgatctgataactactaagtgactaatggacaggtagtgtagacagtgtagatatactggacaaagggatgatacatgtcctgggcaggatggagtgggatggtgcgagatttcatcctgctgttcggaatggcttgcagtttaaaacttagaagttatttctggaattttcattttaatattttcagaccacaggtaactcacacctcagaaagcaaaaccatgaataagcggggattactgtagaccagacttctgttaattagtaagagccggggaccttgagacaaacatttctaatgtggatcaattttgtgagttatgtttttttttgttttttgttagtttttggtttttgttttttgtttgtttgtttgtttgagacagaatcttgctctgtcacccaggctgaagtgcagtggcgcagtctcagctcactgcaacctttgcctcccaggttcaagcaatcctcctgcctcagcttcccaggtagctgcaattacaagtgtaaaccaccacacccaactaatttttgtaattttagtagagatggagtttcaccatgttggccagggtggtctcaaactcctgaccttaagtgatccacccacctcggcctcccgaagtgctgggattacaggcatgagccaccgcacccaacctgtgtttttgttttcttgagctaactttattgagtgattactatcagtagtactaagcgctctccatggatcattcagtcttcacaatagtattgtgaaacacaggtcctgttaactgtattttagacacagggcaactgagattcagagaggttaaataatttaaccatgctcacatagctagtaagaggaagagtagacgtttgaatacaagtagtctcactgcagaactgcttttagctactgtgctggattcactagcacaaaagaatttgtcaacatgcagatttgagaatcagacattgaaatacagaagttttactagaaactgcctctaggtataaaatgttttcagggaagactattgaacttgaacttctctgtcactgaatggcatacccaattccagcagatgatgaccatgtgtcactaaatgacataaaagcacaattataaccttctgacttacggtggcatcacaaggacttaatctttcaattattattcatcaagtaatatttagcacatattcattgctgctttctgtcagccaggttaggcaccattaggcactgccaccagagcagtcaacaagatagatatggaatgtagtctagtgggaggaagttaaggcttgcacagctggatgaatgtttacaaatgggagatagtgcttggctaggagccctacctagccaagtctctggggaagccacattgaagctaagaccgaatgaagtagagcaacaagccaggtacaggtctgggggaactgagttccaggcaaaaagagcagcaagtaccacacaggattctgtgacgagagtgtggtgtagttcaggaacaaaaccaaggccagagtaaccagatgcagagaggcagggccaagctgttcaaggctggtgggctaggtcagggatcattgcttttatcctaagagcaactgaaagctacagaaaagttccaaatgccagtcatttacttcataaacacacagtgatagggaacttctcaggtattgtgctaggcaaggcaaagagtctgctgtccagacaggactactgaggtttccatttgtaaatttttattcataaatcataaatcagtgagtgaagggctgaaatggcaggcataaagggtatgagtaggagcctagcagagagggcattggggctagttcttgtcgaacggtgggaattgtagaaagagcagagagaagagctttctatgctgtaggagctgttctgtccaaaagaaggaattgtgggccaggcgcggtggctcacgcctataatcccagcactttgggaggctgaggcaggaggatcacaaggtcaggagattgagaccatcctggctaagacagtgaaacccgttctctactaaaaatacaaaaagaaaattagccgggcatggtagtgggcgcctgtagtcccagctactccagaggctgaggcaggagaatggcgtgaacccgggaggcggagcttgcagtgaggcgagattgtgccactgcactccagcctgggcgacagagcgagactctgtctcaaaaaaaaaaaaaaaaaggaattttaggagaacaagacaggttctgagaatgacaggagacttgaggcagaatcacattgactgaggctggagagatgggagggaccagaatgctaggtaggcgccttgttgcagagcagtaggtccagagtccaacccccactttgaagccagcaggggtcttcaagtagagaagtggtattattgctttacaagtttgtgggctcaggcagctgggaggaggaggctacgtaagaggaacaaactgtggccttgttaggagacctgttcaggtgagtagaggccccataccttgaccttgggcactggcagtgggagtggcactggcatagaggaggtgattctgggagaatactggaaattgccaggggtgttatgagtctagcagacctgggtttaaaccttgggtgtgctatatactagtttgtgagatttcaatcctgtgtgccttagtttcctgacaaataacaatcatgacttttatctcatagactgtgggcaaacattgagtgagcacttcctagggccaggtgcatttctaagactggcatgtagtagctctcttagtctttctgtcctttgaagtacccagtgaagtaggtactatggtcatcacggttcaatatgtgaagaaaatgctggccaggcgcagtagctcacacttgtaatctcagcactttgggaggccaaggtgggaggatcacttgacccaggagtttgagaccattctgggcaacatagtgagacccctgtctctacaaaaaataaaacaaaattagctgggcgtggtggtgcacacctgtgattactcctagctactcaggaggctgaggtggaaggatcgtttgagcctgggagattgaggctgcagtgagctgtgattgtgccactgcactccagcctgggcgacagaaaccttgtgtctggaaaaaaaagtgataatttgaagagattgtataacttgcccaaggtcacgtttcttttgattgagggaaccaggattcagagtgatactgacccacactcttagccactctgcttaaaatgccagtgatagtaactaactggggagggggaaggaacagccctttgaagtggtgacagctgagctgagacctgatgtgtgagaatacaccaggcatcttgtgaagtgcaagcatagagtctggctggggaaaaggtttctgggtttgaggagagaagggaggtcagtgtgcctggagcagagtgagccaaggagagagaagtggggaacgagggaacagaggatgagagggaagtgcaggtatatctggcaggaccttgggagccagggtaagggctggagttctattccaagaggagtagaaagccactggagaattttaaacaggggagtgatgtgatctggtggggaattttaaagaatcactctggcagccttgtggaaaggtttgtagactacttaggggacttcttccagagttcattgaaagggtgctggtggcaggcccaatagtggtggccatggcagtggagagaagtggatgaagattttaggatagaacttaactgggtgtgctagtggcctgaatgtgttgagggacaagagagttggaggtgacacctgggcttttagtttgagctgttgggggatgaatagtatcatttacccaaaatggggaaggttgttgggtgaggagcagagaagggtcaagagtgaagttttggacatgcttgttctgtttgaaatgtatataagacatctagatggtaatgtctagtaggcagtctggtacgtgaaactagacagagcttgggagcagtcggggctggagatagaaacttgtgagtggcatgtagaagtttgggatgcgtgggaaaagggagacacgcagggtactgggcaggttaaatgctttgcagtgccattcaggttttcttgttactgaacaaagtcctcaaaatggagatagcaacaccaaagtaaatacattcaccacagtttggggtatggtttctagcagagggacttcattctgcatgtgactgaagtttccatatacatgtgctcaagtgtccttgtgcttaaacctaatcctccctagtatgctggcctggggtctccaaagtacatgatggcctagatgtgggtgctggcccactcactaattggaacataggggtgacctaaatcctgagaaagatttagggcttacacaacaataaaatccattctttcaaattcgtttagaatccattaattcaagtacaatttttaaactttatgctcaagtacataattaatggcctaagttgtatattacaagtatattttgtaaactttttaattgaataatgaattcatttttattaattttatatttttattttctgttgtaaatcaagcttttcacagcatttgagcaagatccctattttaatttgcagacgggttgattgtgaatttatgctttaaaatatttaggaacatacatactgtctctcacacacacattatttcatttctttctgttgccacaacattccacactctgttcctgttgctaaggcccctggaatgtcccagagcagaaaaagaatatagaattccttttttttttttttttcctgaagaagcattttatttaaattattttgtatcctctagtttacttccaaatatggatatctgaaagtgaagaatttagaaagctaaaattaaagttgctttacgttttcataaaatgaactcaatttctttttctttttgtgagacagagtctcactctttcacccaggctggagtgcagtggcgcaatcttggctcatggcaacctccacctcccaggttcaagtgattctcctgcctcagcctcctgagtagctgtggttacaggcacctgccaccacacccagctaatttttgtatttttagtagagacagggtttactatgttggccatgctggtctcgaactcctgacctcgggtaatccgccttcctcggcctcccaaagtgctggaattacaggcatgagccaccgcgcctggcccagggagctcagtttcatagggtagaatgaactgggtttaagtataccatgtttcttcccacagagggggtgtgtgtgtgcatgctttttagagagattcagtgtgctcatgagaaattaagaaccgagttttccggtcacacaaaccagagtcctggttatgccgctttcttgctgagtgatattaaataagtttgtttctccataagtaaaatggggattattatgtagggttattattagaaataaatgggaaaaaccatgtaagaactgcttggcataggacctggcacatagtagtctctcagtaaatgtcagctggttatcattatagtcatcatcagttgcaattgatcttaagttattgaggaaatagaaatttttacagaagtatagattcttggttccttacaggataacccctatctttttagttttactagtcctaagtctcagaaaaggatcaaaggaaccagggcaaaaaagaataattttgtacatgataaacatcatgtgacaaattgaatccttattatttgaaaggatcagtttaggtttttatttctcttaattgctttatttttaaaggggtagagggttagtccacagaagaatctggtatctggcaaagtgatctattttaagcaacagtgctttacattcagaactgagggaaatcacagagaccaccagcagcacattgcagagacctaaaactaaactaacactgtttatttaatactgttttaactgctatctaataataaaactaattgagttgatttcattaatgaaattgttcatttgatatctatctcacactcttcagttgtaaattatgaatgttataccagttctgtaatttagatgtatcagaggcatttagcacagaagcatatggaacttatggtaaatgactttaaattttatttttcagaatgaaatgtcatgtcaagaaactgtaatcttggaaagtgacttattacatgtatatcattgcatagatataacctttccccttctcccacatgtactatatttaactcaatgtgggcaggctttcagggaaaatagcatattgtttggctcttattttttattaaataagcgtagtcacagaagtctgtagtctactggaagcttcttatctaatcagtttataccatcaaagatggtcagccctgacattccaatttattgacattggaatctggaaggactctctagatatcattattcctctggtcttcaagaggtaagaaatccaagccacattataagtcagaattgaattccagctattgaccttagacaaagtactttacctctctgtgagtcagttttctcttctttagaggggggatataatgatgtctacctaggtagttgtgaggataaaaatgaaataatagcttgtagaaactactcggtgctgcaagtacatccccaaatcgtgctagactctagtatatttcggattatagctagctatctgtgcaattcagtgtaatagaaactgtttaagaaaattcaagccatagccatgtgtagatactagatcagtaatttgatattttagagattatcctcacttgacatctccttaaggaattttcttctccctttaaaaccaccaggatctccccggctggagaaagtgtgaaattaaatcttcataggaaagaaagtagatgctaatcagctttttggatcttcccccttgtcctttaaacttggtatttgatctactaaaacttttgcttaaattgaagtgtgctaattatccattcattgcagatattctaaagagtgaatgtagtgtaaaatgctgtttaaaatccactgattttgaaatacttaaaaagttagattctggatctgaacttttagctctgttccccaaattgttgttcataattaattgaatggttgagatgttttagttaaccatatttaccaggtatcaagttactttcagttttcatgtatatgcagacagtttagttttacttttgcatttaattaagttgctgtcttactgttaaaacaaacaaacagctcgtatcctaccctattttggtaaccaaactgattaatatatgaaatgctgtttgtactaaagttcattctgcctttctggtggcattagtatgtaagcaaaaggactagaggttgctatgacttggaaaaaatatattaaaataattttctttatatgacatgctggcaaaccagcagttctattcctctgtctctgctccctttcttaattgttccatagaactcaggaaccagagagctggaatagaatgcacagttaaacaaaagcattagatggtacagctttgtgaactaagcagtttacatggttgcagattctttcccttaactcttggtagagttcatctaatgttgctttattgtgcaaatatattcattgtttgcattttaaaagattgtttcaccacatcataattatttttggtgcactttaaccctttttaaagtgtgtctgtaagcctgatttgatttctctgtttaatagtggtggtgtaccacatcagttcatttgtcctggtatactttacaataaggcaactcctttagaaagtagtttcccaaaatggttttatatcagtcagaaccagatgagtgagtgatgctctgtttctgtgttgcagacatgccaatatttggtttctgtccagcccatgatgatttctacttggtggtgtgtaacgactgtaatcaggttgtcaaaccgcaggcatttcaatcacattatggtaagtgcttaaccatttaaaaaattgttaatagaaggtaaaaggtaaagcaagattaaactaaggaacagtgatggcatgcatgggacataatgtccctcccccaccaggaagtaggctttttaattcactcagtgggttaataactatcagatgttgggtatttttaaatttttattaaaagtgataggaattttttgacttttattgaaattagagaaagtatagtttataaaatgtctcttaaaatgttgcatcagtataattacaagtttgtttccttctggagcccctggttgtgaattcagtggattttaaaattatatacactcacaatatggatgcatgggcctttttttttttttttttttttttttttttttaaggaaatgtgattttgaaacttctctgttcaatagttctaaatattgggtgttaattgttgaagaatccaaatacagttagttggcattgtcataatgcctttaaagtgtttaagattctgattctaaaacttggttttctgcccagtttggctcaatagcaaatcataagtatttgaatacgtaccttgtttcaggcattgagtatgtagtatgattcttaccgccacagagtttacagtcgaattggagaggcaggcaaaactaactagatatactttaaaaataactataagttttttcctcattgctcttactactacaaatgcaagcttgcaatagagtaacattggggttcttctatagatagagtgtttaaagaaagcatcttaggaggtgacactggagctgagtcctaagtgatgagaaggagcaactcgggcagcaatctagaataagagcgtttgatgcagagggaacagccagcacacagaaggcccgtgtggctgaagggtatttagtatttagagaagggaggtagaaactggaggaatccagcattataagcaggaacctgatattcataggccaggctaagaagcagcttgggagcactggaggatttatgtaagagagtaacacagtcctatttcagtggttgatttgctgagaaaaatttctgggagaaggacagaagtagggggaatagttcagaggcaagagatgacaccggactgagagtaagatctggcagtagagctaggaagactgcatagctttgagatacttcttttttttttttttttgagacggcctctctgtcatccacgttggagtgcagtggtgcgatctcggctcactgcaacctccgcctcccagattcaagcaattcccttgcttcagtctcctgagtagctgggactacaggcacccgccaccaccatctaatttttgtatttttagtagagacagggtttcaccatgttggccaggctggtctcgaactcctgacctcaagtgatccgcccacctctgcctcccaaagtgctaggattacaggcatgagccacgcgctcagccaagagacgttttaaagttagaatttacagatcttggctgtcgagactgctgttgttgggttaagagtcacaccatcataagcaacattccaccattttttcaaggaataataaatcctttatttaaccataaaaagattctttgagttcctgcttctaggagaagccctagggtaggcactagagtgggtacagaggtggataagatgtcatttccctgcttctgagttgtggacaatacagacaatattttggaaaaatcacttgtaatgcactaaagatgggaggtgttttactggggatagacagagctgccacatatggctgcacagtttgtgcactgaacaaccatatttggtggccccggattggcaacaaggttgacgtgagcaagcacaggagcaggaaattccaggctctctgggatgtgctgcacgagtcaccattggccagaactgatgtacccacctgtggatgagtggagtgcaaaggcaggctgggactagctcacagggcctcagtgccaatcggagttccctgctctggacgtgttggtgaggacctgttgcagattttttagaaccagagtgatgtgacttagtggtgccccagagaattgatgggtagagtggattccttaggcagaaagaagacctattctaggagcatttactcactggttacagtatacttattttttttttaatcttctcatttccctcttagaatatcagtgtacgggtaggaaaaagtgtttttttttttgtttttttttttttttgagacggagtctcgctctgtcacccaagctggagtgtagtggcgccatctcggctcactgcaacctctgcctcctgggttcaagcaattctcctgcctcagcctcccgagtagctgggattacaggtgcatgccactatgcccggctaatttttgtatttttattagaaatggcgtttcaccatgttggccaggctggtctggaactcctgacctcaagtgatttgcctgcctccccttcccaaagtacagggaatataggcatgagccaccaagcccggccaggaaaatatcttaaaatcacatttttctgtctttctcctttcctgcctttcagtccctagcacggtatctcctaataagatacttgttgaatgacaaagcgttggtgataacttcaaacatgtaaatgggaaagtgtgaattcaagattcatttactccaaggtctcctgtggcttggcaggagatgtgactgacaaagccactaggtaggagggctgaggtccctctagtgacaagggaaatattaaagatatgagagaggagagttcctggcagaaagatgagggccaagtgctctgagagagggattctgctgggaaatgtgtaaggaatgccctctttgaatcagcagtggagatggctgctggtggaattgacaagaggtttagaggtggatgggggtttgggagagtaactgcatgaagtagagggaggcaccatgtggtggccctggagtgacaccccacttacttggagggaaggagaggtgggcagggttcccaggaccaacaacctttcccagtgctgccacagtgtcgtctatcttttggggacaggggttgtgacaggaaagattatttttggtacattttcttttttgttgaaatttttagaaagccagttgttgcattattgttttccacagttaacaaaacacagttttcaaattcagaatctttcacagtgactgttgtagtctatttacgtgccaaaagagggatggtattttctttcagtgatattggtgaaaatgtgtcggcagtcttctgtgaattcatgtattgctgatatccatctgtgacttttatgaacaaatgaatagttcctaccaactccagcaggcagttccgttaaaaccactgctaccaggacaagaaaacatgctaccgtggcagcaagtcttgtaaaatcagtcagtgttggtggtaaaactattctgaattggtgagcagcttattattcggagtagttaagaagccctgtacttttttgctagccaagctgcagttttaggagttaacaattaaccaggatttccatttgagcaatgatggtgaatgattgtgctgccattttggcatttccagttttttcagtctgattgctctcacagcatagtttgctttcttggaaactacatagtaataccatgatttcttgatgttgttttaatgttttaaaatactccagtgtgcctcatatttctcttcagttacttagtatttttaagaataaggtgtgaaaccccgtctgtactaaaaatacaaaaaataagccaggcgtggtggcgtgcgctcccacttgggaggctgaggcaggagaatggcgtgaacgctggaggtggagcttgcagtgagccgagatagcaccactgcactggagcctgggtgacggagcgagactgcatctcaaaaaaaaaaaaaaaaaaaaaaaaaagagtaaggtgtttcttactgctaatttcagatttaaaaatataattcgaatcagtggatcccaaacctgctgtgcatctgaatcaaagaggagctttctaagtgagcagcttcccaaggcccactccagatgctctgagtgggaatttccagagatagaacccaggaatctgcattctaaacagctccctgggctgattctgacacactggctggctggaatgcattgctttcacagatgcagatacagtccactctggtggagctgctgcttggtacatacagtgggagacatacaatgactgacaagagattggtgctcagagattcgttgagccaaccagaatggcaggaagggaggcccctactttttaaagtatgtgtattatgtgctgcaaatgtcacattaattgccagagaacttttaagtaggaagcagcgttgagatggtgacgttccgaaagtcagaagccccattcttttgaggtgggaatcttaagttcttcagttagtttagtgataagtgtgttggtcctatactggctactgaatagcataaactgtgtagtactacttacatgcatttactctggatctgaatggtgggattagcacagggttagcagatgacttgtggggtgtttttgaggctgtatactgagagcttcccaggaattcctattttgtgctctgcagcttcactgagtttgcttatgaagaataccttaatgtttctcttttatgcagacacaggggtgatattacctaggagaaatagatgaatgatgtttattcagcttggacaagtaccacatttagaatctctgtgattaattgaaaccctactcagatgttggctgtttaagtatttgcttcagattagttaggctgatccatttgttcacctttgggctcagcttgagtctctaagcaggttggagcagccactttttcccaaccttaatcaagtgctggttttatcatctgctgacttaattccacttagtatttttctttaaatcagaccacttttatttaaataaatcaatttacaaggaaaatcttagtagaacaataaagggggaaactagtgttgtctgctataagaagtagtaaatgtgaaaatgaatactgtgaaaagaaaattatttaattttatgttgatgcttttgccagtgctggctctgagcctgaggcttgctctctgttaaaatggagactagcacattttaggcaagtgttgtccacacagtagtgtgatattatcaggaaaatggaaagagattggaaagggagtaagttttcacttgtcatttgatgttattaatattagagagtgatacctactccatattgttgggaaataccagctcaagttcttgaattttgttaaatcagatgtttaaagagctatctactgaggccagccttagccctaggaaataacagaccttgaaaacagaattttagaatctcatgttgatctgtaagaagaccacgtaagacaaataccctttgtcacctatcgataatgttatatattgagccactactgatcactgtgaatggtatttgagtctgttggtgaggcttcagtgtaaaacatctgcatttctctcagactgttcacaaacggaagtgtcaaaatttggctttttcatgactttatgaacgtagttttagtagaaacactcctgtgatcttacagctttctctccttgcacatattacaaatcctgtaaaattaacagccacacacattgcttggacttaatgttccttgatatgcattgaggtggtttggattcttttagatgctatcataaattatattttctgaaacgtcattttcatcaggatgaacaaattacttatatattcatatgagaaattactcatacttttttgagctaagtaattggtttcaaagaatgttagtactataagagaaaaatgaattttttctctgagatctgatggactggttctggcaaaaatgctggttctcattgttgacaacatttctcatagttctgaccagcaattgccatcgtataattatcttgcatcacaaagcaaaggttttaccatttaatacagaacacttccctccccttttgctctctgattaacttagacctggaaagtaacaggttcagatagtttttaacatgtcattttatttagctcataactgtttttgataaagaaagaaaatgttttttttctcttaagtatgctaaatttaagtccactgactaatgataacttttaatagtacctggtgatttacagagaatttttgcatgtattatcttatttcctgttcttaacaatccactgaatagattttatgcttagtttacagatcaaagtcgtaaattaaatttcattcacacagataaaatataccaaccagaccatcttttctacctactaacattgatttattttgcatgataaggatgtatagagtaaaaaaaattcggagacaatatgaattgcatgtgtcacaaaactatcattagtgacagatgttctagctgaagtagaattttaagtttgcttcaagaagctggatcagtattgtaaacctgttacctcagaacatttagtaattcaaagatataatgatggtaggtagataattgatttagcgtagtcattggatttctcttctgcctgttctactttatttaattctaaatcatagtcgctatctaaagccaaactcctcctctttttgtatgagactcgtagcattttgtagcttctttagagaattggctgacatgtttatttctgcagtcagtataaagactgaaacttgttgcagagcaaaaaaaaattacctcactcttttgcttggaagacttgtaccaggtctttctccagcagtcgggggatgagccagggatgggagctaaccaaaacaggcacatgaaaacatgaatgatgtcaaggtggacattagtttaactctggaaggaaattccaggttggccttttgccctaaacttcttgtcattaagtaaccatttttggataaagaaagaaaatgttttttatttcacttgtcatttattgttattaatattagagagtgatagcgtgacatacagtgtattcatttttttctctgctacaagtgaaaaaatgctaattaaatttttcagataacttaagtagcattagataaaggtttattctctctcagctaatataaatttatcttttttccttagttgtattataagcaaatatctttaaaataaagttatgtcatttgtaggagcaacattttaatttctagatataaaatgtacttatttttcctcttactgatatctgtgcttttatgaatgtctgtgcctttggggctgctttagaaaggaattaaactagcaatggtattattcatgcatttaacaaaatttactggtgcctaatatatgctaggcattgccctccactgaggtaggaaaacagtgtctatgatttcatgcaccttatattctgacttaatacaatacattgtattaaggaggagagagaaaaatgaaattgtgtgaaatcagattgtttcaggtagtgataaatgctaggaataatgtgagagaaaatgactggggcagaccactttaggtaaggctagttaaagaaagcctgtctctggagttgatgtttaaactcagtgatgaaagagagccagcccatttgaagatgtagaggacaagtgcttcacatagaggaaatagcaagtgcagaggtccttagatggaagtggtcttggcagaaaggccagtgaggaggcctaaggacagtgtgcaaggaggaaaggggtccaagttgaaactggagaaagtgggtccaggaccagatgacactgggccctgcaagccatgagaagaatcaggattggacggcgcaggcaatgggaagtcgctggagggttttggccaggaagtgttatgatcacgtggttgctgtatggaacacggggcaaatgtggaaccagggagaccagttagtgagctgttttatactagttaaggtgagagctggatcaggagagaaagcttagattaggattgtagcagcaggggcagagaagtgtgaacagaattaaaatctgcatcggaaatataaagccagcagggcttgctgatggactgggaaaggaagggaggaggaatgactcatggggtttttggctcaagcagctggatgaatttacttgagcttatggatcaggaggttgttctttcagtttgtatatgggcatttatttttaatgaggtgcactgacctgaataaaaagtgttgatgtattatattaagtctttaggcattttctaaagattatagaagaaaataattattgcagtgatgccaagttgggggtggggggtcattttttcttttcagttttttaatgtttctgtaatctagtcatacaagccaggaaacaaaagatactgtgtgcactttcctgggacttctcatgtattcattgggtaattgtgaaaatttattgactaacaaaaaccactgcctttcaatttgtttttaattattaaaataaaatacattgtaaaagaaattaaacaaccagaggataagtatgcaatcagactgaagaaagctccttcatcttacttttcaggggtacagtttgacatgtactcttggagggttcctagaacctggacaaagtaatatttaccaatgtattttttcccctcacataaaaaaaagtagattcagtgtgaatttacatttttaacttaataatctatctaaaatattttttcatgttaatacatattgttctgctataatctttttaaggactgcctgttattccactttattaatgtattttcacttaacctgactcctgttgatggacacttagatcttcagtgttgcattactgtatacagtgctctaaggaccgtccttctttgggaatgtctgtcagtattttagcatattgattctccgcatggaacctggtcacagtgccctccaggtttgtactactgtgatttgatgaactacttcagcagttctgatttgggttgccacaataataaggcagtgaaaatgtgagtttctggcaatatctatctttatatatatataaattgtttataatgtgtatatggatcaaaacattacactgtactgtaaatatatagaacttttatttgtcatttataccttaataaagtagaggaaaaaacagttggaaattttttttaaaaaggcttaataaaaattaagtaagaaattattatttaatatatatatgaattgttgatattcaccagtgtcactcttgacttgcctgctacatgtagaaatcattagctattataggattgccatgcttcagctttaatggagatatttcgggatataaatccatattttatttatattttctaaaaagtacttttcctgacagtcatttcacaagactaatttgtacgatgactaagataaacacacctgcgatttcaaccccactaagctgtgatcttacatatgaccagaagagggagtttttatcacttcttaatgctgtggtacctactacctgactggaataattcctctgatgtatgtactagtccaagtccataaaacagactggtttgggaggggcccaatagctaaatttagctatttccctcatcccacattttgtatgtagaaatcccactcttgaggtttacttcaaagtaattttataccttttcatcttgtgcatttgaatgttaaaaaagaagaacagataattatttccatttaaaataaaatacaaatagcccctgatcacacaatatagagttcttggtttgtattctcttcaggtcacaaataaactttggaatgaaatttgtttcgttgcctcttatgcttgatatatttattaaaaaggtcgttagaacttctgttttgtttttttgagacagagtcccactgtctcgctcaggatggagtacagtggtgcaatctcagctcactgcagcctccatctcccaggttcaagtgattctcgtgcctcagcctcccgagtaactgggactacaggcatgcaccaccacacccagctaatttgtgcatttttagtagagacagaatttcgccatgttggccaggctggtcttgaactcctgacctcaagtcatctgcctgcctcagcctcccaaagtgctgggattataggcgtgaaccaccatgcctggcctacaacttctaatactgaagatttgtagtgagctttagagagttaagatgttattttgccaaagtggctaataggcctttttctgggtgattcaactgtggtctgttgtgctacttgagtctcagtctgcttagccaaacaaattaagagagtgacaataatcaagatacacttgtttgatgtaataccagaattttgtatttcttttttttttttttttttcttcttcaagacagattctcactctcttgcccaggctagagtgcagtggcgtgatcttggctcactgtaacccccacctcccgggctcaagcaatccttccacctcagcccttccagtacctgggactacaggcacacgccaccacacctagctaatttttgtattttttgtagaggcagggtttcaccatgttgcccaggctggtctcaaactcctgggctgaagcaatccacctgcctctgcctcctgaagtgctgggattacaggtgtgaaccaccacactcggccagaattttgtatttaatttttcttagctaccttcacagtgcatttttgtaacacaaattttttagacctgtttctttatagattttttgattggcatatgaatatatgaaatatatacacctataacgtatttttatataaatacacaaatgtaatcatctcaactattttcagtgcagcctttttcttatttcattggctctttcaacttacctgccttctctaactgtagcagtccatgctacgctataaatcatacatgctgcattcttagtatgtaacttaatatgcatccttgtatatttttctcatgcttctaactctatccaggcacatagaatcacgtattttattagtaggggcttttggtgatagttttacaaaaaagtggatcctattatgcacacttctgctccttttctactcaacaatacctcatgtaaatccattcacagccctggataacactaatcccctctttttaatggttgcatactgctctaaagtgtggctgtgctgtagcttcctctgccaggccctctatggacattcattttgtttcttgctttttgtctgtgtgaaccaaacagcagtacccactctggtacatacatacttaattactggtggtttagtttctgtgggatagagtctcaggaagggattcctgggtcacaaaagactagttatttgcagtgttaatagctgctgctggattgctttccaaaaaggctgtaatgctttatatctctaccagccactatgagagttatctccaaaggagtaggtgttgtatttatttttctaagcttccatttaattttctaaagcctcttacaatgttccttagacacataaacacacacacacacacacacacacacacacacacacgtatgattaattttaatttgaaataaattcctcaaacaaccacaagtctagtaatacttaataatatgagacaaagagatctttcaaaacgagtgattattttaaaaaatatttaaacaattataggcagtttctcgggcgtctatgggaagtttctattcattctgtatggaatttaaggaagaaatctcattctcttatgctaggattcccctgtgcaaaatgtgaggcctcctagaggatcataattttgagtgtgattaattgcaaggccaaggaaaaactatggccagttttgtttctgatctccctatcctctttgcagttggtatgactggtcaccttataaaggtgttcattgtgtgtttcaaataatgactgggctgaggtcacgctgtggttaactcaaagcctgtgtaaatcaggccatgaagatatattttatttgcctgccttacacacatgaagtgtggctgagccctggagagccatcgaccaaaagatcagctggaggaaggctgctgcatggttttagcccccaaggtgaattatccccatttaaatttcatctcccacctctcctaatccagtgtgagtacctaatgagctctggataataacatagcaacatttctaggtgaagctaatctgattctggatagcaggcttccaggcccacagccgaatgaattgcttggtatttccaagtttgaaaatacttttttcccctttcaagtgctccttggcagcaggtaaggaatgttaaagctcctgtaagtgccaattaaggccaattataactcacccggcctgctgagacagtgaagtggagttagtggagacttgtattcctgtaaaatggagaactggctttcaccaatgataggaacacagtatttcataactgccaacagcttgtttattgccctccagagcactgaatgacacctctgctggcttctcaaggattcagtttaggaaatcccaagatttgtaggggacttgactaatttctataatagaaacctcagtttttctgtttctgtttaactcctctatcatccatccagtttctccttggttgtaatcataatagctaacatttgctgaacgtttaacaagtgctgggcgttgcattacctgcattatctcaaatttactcctcaccccaggcttgtgggaggaggcagtatcagtccttagctctcctgagtctcttgcccacggctgcacaactagaagtgctcagactgcaggctggctgccccctgaacccaaaccttgagtgttcctcctagcctcctgcaagtttgcctgtttgctgcgaataggctaatgcacagttcagaactccctttgtgcactagagtaaaattgacatgtgtacaccatccaaaccacagctgatacatataattttcggtcagtgaggcacggatgttattctattaagatgttattttagtctgtagtatttttttagtctgtagtcttaatttttttcttagggaaaaagaaatatgaccatgtccccagacctagacaattaacgtctgagccatcattgggatatttaatatcaaaataaactttatttggataggatatcgagaaacggtttgaagaaaattgtgataatgctttacaagcagaacaaagcagtatttgcttaaacattttattcagggcattaagggggcacatgtgagtgtttaaaattttaatctgagctttgttctcaatttctgtgtatgtgtacaaaattaatattttcctggcatacacgaccattcatcccttttctgatgtaggtcttaaaaataagttaaaattcgtttttctcttgtttatttgtgaacttaaatatagacgtttgtttgtagcatttaagaacatttgctaaaattcaccctggttttttacagggttgcagaacgacttgattcttagaactgtcttggattggctgactctcataacgatatttttccccactgtatttcgtacaatcactgtgtacgaaagggaatattagaaaggcaagcatttgtgctaggaaggccagcaaggactctggtgttctgtcatacaagtacagtgatagggaagtgagatttagctccagaaagatcctcctaccctgttcttttctgctattgatggcattaaggagattccttggctacccctgcagggagggcaggtgaagtagggtgaacaatactaagacctgtggcaatcaggttttacagccatggaattttttttttctagcttaagaaaagcttcagtgaattaacttaaaattcttattttcgcttatgagcttttaaaaagatttgggagatgtatcctcatcctgtgcttctaaggcttgctgatggctcttcccttgcgttcttctagtgtcttctaagggcttccatagttttggattgtatgaacgttactgtaaggaatctgggggaaaaaaagtgggtttcagaaaaccccctgggtcttagtattgttgacatgggttgggatctgaatccttgtgaaaatagggcagtgcagctactgttcttctgttttagagtcaatttagaatttggtctaatagaagccgttttcatgcctctctcagaactcttccccgcacctttcaggctaaatcatttccacatatgtaattcatgacttttgccaaatattctgtatggggtgataggattctgtagaagaatcttttgctgcttcttttgacatttaaaagagttcattttgaactatcaggtatctaagtcattattatcataaaactcagatcacttggcagttttttccatgtcacttgtggggattttttgttgttgttttgtttttattagaactctgtcacctgggctggagtgcggtggcacagtcatagcttactgcagcctcaaactcctggactcttgcctcaccctcccaggtagttgggattacaggtgtgagccattacaccccattctgtgtcatttgacagtagatttgttgattggccagagagagggagtgtgatagggatgatagggaaacaggccaggaagacactgttttcaagggggcactcagtgagagaaattcttggatttaaaagtatgaaagctttagtcagtcctctagtgattgaacaacaaactggacaaatgtggatatgaaattatacatattttacaaatatgcacagaaagtgggttcagatattttgttactagatttaggaaggaaaagtatgcttaggaataataaactttttttgaaaagcttagcaactgtagatagtataggggaaataaaacctggaaaaatgctgcaggtattttatagaaatgtttaactttaagacctttaggtctaccgagacttaaaatgtaggtttttaaataaatcatgtaagttttgtaatatacctggtagtagctttgtcagtttaaaggtattcagaaaaaaaattcacaaaatataagtaatttgcattttagcaggttaaacttataaattccatcttccccagttttgacaagttgcctttccaatagaaagattaatttacaccagccaggacgccttgtatgaccatattagatgaaattagactccaccccctgttttctgttgatctgccaggacctttgtaattcaagtgctttttacagtagtagcaaatgttacataagcccaaacatggagcatatttggagttggtgggcagacccaaatcatgatgcaagcctgcagtagcaagtgtgcaatgaagcacaaccaaattctgtgaatggaaggtagcaagacgcctctccaaagcagcccttctgcgcaggagctgaaagctccactgggtaagttttctgaggcagttttcagagtctgggcttggctcagggcccagctctggatgagcctgtggacggtggggtaggtctttgctaaccttacatagaaccaagcagatttgggaagagtttatgcaggcctttttcctcctggcatttgtcttgccttgccagcaggccaggagggttctgctgctcaagtagtggagggagggagcctgcagagctaggggatcagcgtgggtaatcgcagccacagggattagctgctgcaagctgtccacagaagccattctgaaatgtcatttgagtgatctggccaaagttcagatgcagacgggagccgagtttgttattaactccaacaaaatgctgaggtttgcaccaaacagttcccatatctcaaaacagagagagtattggttacatctctctctaaaaatggaggaacgttgtaacacgctttaactgtttgttttttatcttacttgtggtaagtgaggtttcatgacaggcagtttgcagtgtttcctgtagaatgtgtttgaaagctgttttgtcagatacttcaattccacagcaaagtttcaaacagaacactgcgtcaagaggaagaacaacttcaaaatacaaacagtaaccctgggaagtcattcagtaacttaaattgagtgtataaaaatttaattatggactgactgccagaaaagatgattttttttagttgtgttattaaggtagccagcagagctaagctgattcttgggtggatgtgtggaggctggtctcaatattaccttacctgtctcagaccttctgtcttcatgcgggaagtgaggtgtcaattgagttcttcagttttcaggggattcagatttcatgccttgtgtaataatgagcttgaccggaaggttttaattgaggttgaaattgagctccccagttgtaggactttaaatatgaaaagatcttaaacctttaatcaaattgctgttgattctctataattgatttttctgaaaactcttgtcagacagttttaggttcactgtttctgctttcgtttttgcatgtcacttctgatgttttattagttgacagccctggcatgcaggtggagcagatactgtttctctcttcagaaaaaataaatgtgtgttgcagactcattgaaaacattggcattcctgggtaattaatcactcattccttattaaaagaatgtataatgaaggaatctgtaaggctgtgttcaaaatgtgaggtttttcttatttccatgttctggtcttcaggtattctgccctcccccacccagaataaggtgatataaaaaggatataaaaccagtggaaaatggcaataaggattgtgactggctcagtgtagcacttttcagcagatagttttgtcatttcgttgtaccttgcagagttgctcttgtttgttggactgtgggaagatgatgctccctgttgggattcctacacagaaatttctattttaaaagacaaaacagaaacaaccaaacaaaaacaaggcagctcctctaaattgagttttaccaggttccttttattctctctctttttatgtttttgtaaaaattggattggagtggttaacggcatagttttgttttgtttttttaattgtcttttagcattttggtaatagcccatatgtttcatttgggaaaacagtgacctagaccaaattgagactatagagatacttgtgtaaagactgagtatgtttgatgcttgaactacagatagtataacaaattggaaggctatccttataaaggtaaattgctaaaattctaaagtgttcttttccctaacacatagaggattgaatcaaaagtagctagagactggtggattttcgttttggctctctcttttcttctcacctgtatacctgaggtatagaaacagttcaagtgaatgatggtgtaagagggagaaaggggagtgaaattttacaaaatgatgtgcatcactcagatagtgaggtcaaataaatcggccagggtgatttattgctgtactctgtcagcatcatttgggtaacaccgtgctctctgaggatagcagagagaagtccttatggctgttagcaaagtagaagtgtcagccagcatgtcattcattgtgtggtatctgtagtcagaaacagtgacataaagatcacagaggtggcataaacagttggatggttgtgttaacactcaaaagcaacagcatccttttcccaaaatgtactttccctaagtgttgtgtgtatgcatgtgttagagaggatgataatcctctggtcaaaagtctgcaccttgaacagggttgcaggagcataaaaagggcgtccttcaggaactgaactgatcactcagaccactcagttttatgtaagacaagctgttttttgaaagacaaaaaaaaagggtgttatactcatagctgaggtgatcaactgttgtgacattctgtacctcctctttttccctatcattccgtatttttcaataaaatatttggattttttttaaagcccttttacaaatgtttgcaaaaagcaacaagttaggcagggaaggagtatcccccagatattcaataactttttcatatttctcacatacttgaaagcagagtttagaaagaacagtccttttgggaagaattcctggcaagaggattatttgaggttgccatatttctgctcctttcttagcaacattatttacaatccattcacgcctgtcccttcccccactggagtggagtcgttctcccttgtaatctgccctttgtgatctgttctctttcatgcagccagtgtgaatgggtatgctgcagtgcgcgctctgcccagagacgtggaaatgccaggagacccgaatactttagtggggcctttatttatgtcataaagcgctgacttcaagagcttgataatttgattaggacctttggtgaaaagttgtttcaagtggcccaagtgctataaatgactctcttttctgcactttcccgttaggttttaatttaaaagcacctccgcattagggggaggagagatgcctttggcagaggtagcagttggagactaatttgttagggcagccagtgttgaaatcatccttttcagttaaatctctctagtggaaatgatgccgagtgctttgtggcaaggactttttctttctcagtgttttccagtgccatttgtaacccacctaagcatgctctggagttgcctcccagccccaattttggctaattgtcctttgaggcactgcatgtcagaggtcagttctgaattccccaacttgagatttgaatgttccagggacagtcccaccgacttgcttccttttaagcaattagactacactcagctctctctggaatagtttcatcaagtgcctggggaacataaagaaattggatcaaagataaagcagatttaggaataaaaaggacctgggactacaaagagtggatggagtaggaccatgtttgcttgtcaggccatatgtgagtgcttttaagaagaataagaaaatttagagggaaaagttgacaacaatgaaagtagtgaggaaatattaaatgctcgatgttcatgtgtagtccatggtgtgattttcaatggtatgccaaatattttttaatattcgtgagaaaaaatatatacatatatatataaaaaactcctacatcaaatacaaagtcattctttcagagatattattgcttaggataatgctaaattagtccctagtcagccactgaattttaaaaaatatattaagtaaataatggtctagatattgtgcagatttggaaaaggatccaaaatatggtttagttgtgaataacaaaagtttagggaaaacactagtctggagcaaagtagatgtgtaagaaaaaagtgctgagttttttttgtttttgtttttgtttttgttttatgcagtctttatttctagtttgcctcaggtcctgctcttggatgttttcttaaggagttataatccttgtgaaagacacatgatgccaattgacacctcacgagttgtgtttggtggcctggaaatggattatgacagtttggattaattgggagctgtataatagcaagctgcagttatttttcaacctggacataaaaataaacaataaataattttgtgaagggacagcttaatgaatgacctgaagtttttaaactgagcttttgatacatgcgttgttacttactgtgactggccaaagactgtgtgcatgtttacctatgttttacattttatagccatgtataaccttcattattgaaagtccttgctttaaatgggcgtcattatgggatgtttgtggaatggagctgtcagaaggcatgaagtcatgcattccttgaagcatgcattggtatttctcataaggcccatccatgcagagtgcacactctgtttaaccttaactgagtctatctgaaagtgtgagtgagtttcatttaaagaaaaatatgtgggttttacttagaaaatctgcccaaaatttccacctttggatctgtaaactgaatttgagacttgatcttcattttattctacttgcagttcttcctgagtgtcttctgagttctgtgaggaaaatgagccagccttttatttgtaaaataactttagcttgaatgaatgttctttttgtttggtgtgaatttgctgatttttaaatgaattcttaaagttgctcccctgagctcctatcttagaagaggttgatatcttcctgaaatggcacgtaaaaatatgtatactaaatccttatcacactggagaagataacttacagtaaagagggtttgatttgttcttaagtgatttctacctcctttagaagtcaggaggtgttatttgtgagtacttttctgtctaaataaacaagcctgtagctggtatcagccaagctaacagggggcctctgtcttatgtgctgatgtgttcccagtacttggtccacagtaggctctgtgctgcaggctttgcaactcttgatcgtttaatccacagcagccctgcaaagtaggcttggcaactgaagacgctgccaacgaggatggagtgagctggttgcccagggtcacccaattagtaactggcagagcaaggatatgaacccacatatccctgactctaaagttcttgcccttttcaggtaatcttttaaaaagtgtttttatttgatttggattctattcaggctgattactcaacccatacatatcaagactgtgcccagcagtcctgagcctctgctgggaaggtgaccataaacaacctgagagtgactcgaagcatgcatattgtgttgtgtattggttggtgggtccagccttaccctattgagcaggtgtttgctgatggtcttttgtagagcatcctcacctggaaactgtgtaagttgattctttttagccaagctataaagacagccccaattggcacattctgtcacagttcactcttcaaactgatgcaggatttttcttcttggtcactctgcaaaccagggatgcccggccagtgatacgccctgcttgggcctccctcggccacgctgggtgtgccgcagcttgcctgtgttaaggttgtacctgcgtttggcagttcctgagctcttgaattgcacccaagaagaatgaggatacgtggaacattggagggtgagaagagtggagaagaattttattgagcaatgaaaacggctttcaagcagagagaggattcagggagaggggaataattcccccatgtggctggttctggggccctttatggactcagaatggggagtgcctgctgattggtttgtgagtatgcaaaaaagtttaaagggaaggcacaactcaaaggtgggcatgacagtgtagaaaaaccaatttggaaagggtaagtatatataaaaataggtgaagggtggggaccagttagaggaaagcatcccaaatgggaagacaaattcttaatccagtcctaggatttaacctgtagcttggttttcaggctttaaactgtcttcgacttggaggtggggtttcgtcggagaccctcccctgtctttctaggcatttgtctgcctctatcaaaaccatcttggatgctttaagaccctccaagcagggaattgctacactggctgacacacccatagctgatttttagcttagcaacttccaaaatggaaagatgaaatcgaaaacaatctggatttcccttaaacatattctggatcccaccctgaatataccaaaaaactgtcatcgatgacaaatgttcagcctatgcagacttgtacactaacaacctgattttgcccagcacttagggaagatgggcttcttactgatttatgccccagccctcacctttatccctgcccctccatcatgtattatgacttgctaataatgccatttcagagcaggcaagttgccttgtgctttcacccaggtgctggagtcagcctgcctgggattgcacccatctttgcctcttaagtaaccatgtgatgttggacaactgacttgagtcctttaaaagccttggcttcctcatctggaaagtgaggttaataatagtatctactttgttagaaagatggtcaggattgaatgagataatccatgtaaatcccgtagcatggtgcctggcatgtggtttctacacagtacacagtagcagctgttgttgatgttgttgttcttgaaggtgagatttctcatcagccagttgtttggattataaaagattagtaaaatgtttaataagttataagaaaagagccctgaataaagggtatgggaagggttgcagcttgtgagttaccatgagatggtggaaggaggttatctgaaattgaatgaaaaattgtagcatcagatgtgtttgggtgtggttaataatacacgtggtggtgaactgaggtagatggtagaagtttgagggtgtacattttgaatcttcccacatggctcatttcagccagttacagttttctgtgttcacctagtatttcttacagacaaaaatcatgaaaaagtaaatgcaaaatttcaacatgttcgaattgtttcttagtatatcggtggctttggaatgcattttcattctcaaaacaagctttatagcagaactgaagatatttaattcaggttctgtgggggtttcttagtagttagccacttgcatgatacccgttgagaatgggacaaattgatactatgctcaggaatgatagtatgccttgctttattttggcatgtgtaaaattgaaaccagaacaccaaatttttcttctttagaagtatgtatttgataaccaagtaaactgtattcattatagaaaaacaatacacaaatgttttaaaaaatagagccataatcctgggaataaccactttttaaaaagcttgacatatatccttctagattattttcgagtatgaatgttagcatttggagttacattttgttttgactgctttttagatttgtgccctaattttgacagttgctcactgtaaattatttttagttgttttcaaagcaatatttatgatataaaaagatctaattatttgctttgaactcctttttggtgtgtacctggatgttaatacttataactttaaaaaaatctcagcgtgaattcagaattataagcttagtattggttgcattctattttggaagacctatagagagctgtccaccctcctacaccactactaatatcctgtccttgccatgtgacgtactgaagccacaaggggaaagagccccatgaagctctgtctccctctcttctccccagcacaacacacacatacacacttaggcatgtttgtctttctttgtctctgctcttttcttgtgtctgtacttgtctgtcagtcggcctgtctctcccttactggagccattcatcatgccctcctcattcagggacagagtgtgctttctctgggctggtgccagatcctggagagaggagcgctttgaaaactcaacttggactcctcagcagaccacattgcagttgtgctcagcatctggccaccactttgtccacttaatatagggtccctaaccccacctataatttgcccacttctcttctgatctgggagcaaacacttttttagagctagatgcccagtttaaaatcctgtgaaaaataagagctcagtgaaaggataaggggagtccaactcaactacaataaatttggtttttccttcttgctttcttgtggggggaaagccagatgctgtccttttcacagagtaagttaccagtccgtgataattcagtagcatgacaagaatttgagctggcacttttcagccagaatctcagttacttacacacactacacacacacaatctgtttcaagttttaatgaatgaaaaattcacatgatagattgtcattcttagtttttaaatagtttttattgttattgaagtagaaaatagacttttttgggatattatcgatacatcagcagacttttaacttaagaagctttgaaccttgatttttctagtggaattccatattaagagttaataggcaagaaaagaagattttaaccaaagaaaacggggaggatggacagtgatgggaatggaaaattgaaaggacaagcttaaagttacagtcagttctgctatagcacaacatgcattcctaaaaaattactgcacaatgcaaaattacgcaacaaaaaccacatgaggcttattgggaaaacagggttatggcacaacactcaaagacctcatcagtgacacacacagaaaaacataggaacctaatgaaaagggtagcacagtcttacaaatgttaaatggtaaaaaaatacataaatactagaataaacatggcagttaccttgaaaagacctggcatttgcttgtggaaggcgtgggaagggttgcagcttgactgtgaagtcatggaaggaggttatctgaaattggatgaaaaactgtagcatcagctgtgtttgggtgtggttaataacacccatggtggtgaactgaggtagatggtggaagtttgaggggttgtgcattttgtgttttcctacgtggctcatttcagccaggtatagttttctgtgttcacctggtatttcttacagacaaaaatcatgaaaaagcgaatgcaaaatttcagtatgttcaaattgtttcttagtatatcggtggctttggaatgcatttgcattctcaaaacaagcttcatagcagaactgagggtatttaattcgattgagaattttatctaatcatttgatcttcaaagaaaatacatcacacatttgctctgagacaactgcttgagaattctgatacctagagtgtacttcttaaaagtcagagttctagttgagggttttctctgtcttcttcatatcacagacatgctgttcctttagtgcactgtttcagggggtacacaaggtgatttttgtagataaacacggatgaatattttaatgttcagtttatataataagcttattgaacttactgtttcacagatactattgttttggaaaaaaatctatctcagctgagggtagaggtgccctgcttcactctggggcccatctggaaatggattagggggtggtttcaggttgtctttggcagacgggcactactggtgaagaagcagtaggagagtaggaatgctaaccatcctgaaatcctgtatgaagaattgtcctgtctgaaataccaatgatgtccccatgagagactggctagtattagagtaaggaggaggagatgatagaattgataaagtaaattaaaatgttgagttttaaaaaaatagtattttatgtagctttggtaagaacgatgaaaatagtttgcagttgatgaaaatttggaaaacactaattcaagacaagtagtagtggtgagcttcatttgacaaaccctttagtgccttgtagcaggcagtattctcagtgccatgcacatgataacttactcagctgtggttaatggttcttgaggcattagcctggtctactgtagtgtctcaaccgtggctgcacagtagaatcagacagggaaacttgtcaaaaatctggatgcctagtccacaccccaaacgaattaactcagtctctgagggagggacctatgcatcagtgtttttaaagctccttacgttattccagtgggtagccaaggttgacagccactggtctagggccttccaaaatcactccttttcacaagaaaagctttactagtcatgcagaagttaattgaagacctctgtcccatgccttacagagaaagacaatggagacatggcccacagaagctgtatcgtctaaggcaggtgacaaaactgcaaacacatgtttacaatcctggctgacaagtgctgatgcttaaaagtatgttcagagtgtttgggatcataaaagagagaaaaactaaatttaaaaacatcttcagatgccaaatttggaaaactgccgaactgaatttattttagttttttattccttatacacagctttcattttggggtgaacaaaaagcaaaaggcacttataaatcactatcaatttaaccttcctaacttgattgtagcctttgtgtagttgagttggagaatagaaatttgaattttgtctgtagatagctaggataataattttgtcctgatgtggaacacacagttaagtactttataagccatcattgaagtaatgcccttccaggaataagtcaccacagttttaccaagaagctcaggactgctataagaagatctttggaaataaaccattgaagtcttacttgtggtcattgatcatcatgtgcttaatgttttaaatacttatatagctcctgtattgtgataaggcagtgttggatcacatgcattttaaaacttagagttaagcaaatgtgtaattttaaattaattaattaaaggcagccactaaggtactcaagcggataaagttaccaaatgatttacttgtttctgatggtaacattcttcaacagctcttgatttatattagtatggattaccttactctaagaaaacctgattctccagtggatagatttattttcagctaaacctttgtagtctgtacttaaccatgaattacttcctggtttaaaaaacaggcgtagctatttgtggtatttttgtcttgcgcctttggcatcttagcggtgtgaaccggagctatgccatctgtagtcaagtgagattattaaaaaagggggggtgggaagtgaaatgattcactggaaaatttcagcacagattcttagggaacgataagataaccctagaaacattcttatttggtgtcatctgctggtgggtagtgacagggaaaaaaaagaaggtacaacttgtttcttaagattttgctattttgaaaatcagagaggtgcggtgttagaaaggaagaaagaattgcttgcagtgtcatttagcagagctctgcagatgaatgaataattttcctctctcttaatgcaagttggagccaatgaggttcatttttagcacgcaaaacccaaaaggcaatattctcatgtttacgatggttgtctaatttcctgatgggtgtatgtgataaaactctttatgctgagatacttcagaaagagaaggacccgttcctagaatgctaagtaagtctgtggggcctagatgagccatttctgaagtctgctgagtttaacataccttcacttaacgacacgtgttttaacctgaatatattgatttcagggaattcttccagaattacatttgagattcgcctaaaacatgatgtctttttttctttgctttcgttttcagaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatgtgagtatggccaagagggtttttaaagcttacctgctggaaatgaaactgtgtacactagtggcatgtgagagtgcctgtgagtaatataaaagagagtctacttggggaagaattcaaatgtatgttgtattgtttcttgatgtttccctgtcatgtcataggaaacttttcagagtagtaatagcagtgataataaggttactaacatttattgatccattcttgtgtgctagctactgaaacctaactctatgtgtgtactatgtcacttatcacaacaaccctatggaataggtactgttactatcctcgttttccagatgaggagaaggaagcttcgtgaggtgggggagttttgtccaaaaaggcctcaagtcacataggcctggatttgtgtcccatttctgtcacttcttagctgtaggggtttgggcaaggcactgtttctgtctaagaataacagccactatgctgggttattgagaatattttagttaatatatgtctagcacctggcatagtgtctggccataggggacggttaacaaatggatactggcactcctgctactgctgctgtggataatagtaatgataaaaagatgcagagattcccagatgctgctgtagaatttttgggggtctacggagcaaatagggaagcagtgcttcctcccttcagccttaggttcacatcacagcagtgatgagggaagactgaaggaagttcacacctgccaggcatggctttggcaagtttccatggtcactcagtagattgacaggtttcttgaggtcacgtgagggagcagccacgcactccaataggaacatgcttcgccttgtcatggcatccctcagcctggtgacggatggcttttcttgggccagcctgcttttggagggtatagcacacatcgtaggtccaagatccggtaacctggttaatctcagggtagggtccagcacctgctgctgcataaggaccttgccagctgggagaggatgtgacatcttgcagtctctctactgctgtcaggctattccaggtacagttgtttggggctgtttgtcctggttgctaagcccccagcccctgttcttctgtcagaagtacagtacagcaagcttggtttttgttccgggagcagtctgaaagccacaaacggtgccagtgtagtgtgtaagtcactggccagcttaacagctgttagagcactgactccactgaacaaagtttatacaacctcattgattcaaatcttctttacttagagctaggcctttagataggaaccaggccagttgttagcttcctaccagtattttcagttttaccaagcaaaatgatagtgtcagtaagattccaagattcatatctttgttaatggcacaggtattccctaagctcctgtcatagaaacatttttcaaggactggagaattaccactttagtgacacaacatatatttattaaacactagtctcccttattgacagaagcaaagaacctcttcttggagatatgttatttagcatgtttgagttctcataagtctttagtgacatttattggaaatatttgctcactcagaagtttactttgttttgatgaatcctttcgtacaaatggcagtcctcaaaagatattctccaagggttctgcaaatagtctttgtttcttttagaccttctcatgttttgcttcttatagaaattgcattgcattgggtatcaggtctgagtttcccattgcctcatgtgtaaaattttttgaaatgatgaaagaccaggcaaatttgatggtccactgagggttttgcctcaccagaagggcttatagacttaatcagtatgaaccttactaacaaaactcataaggagccttccaagaggctggccctgtgcagcgcttgggtaggcccaggctctatcctcatccctctggctcaccattcacctgggggctgctgaggcactcaggcactggttttctcacttcctcctgtgacagcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcaggtaacttcaaattttctttcttcataatgcttctctatatattaaatgggcattcgtggggagcaaatcaactgcaatctagaattcctatttttaaaactggtcaacttcagctttaggaggaagttccttagttaatatgtttgttcttttcactcttgggttttaaagagcatgagtgtgtgtgtgtgtgtgtgtgtgtgtgtgtgtgtgtgtgtcatgtaaaagtagctttctagtggtgtatttctgaaggaagtaatacagacttaaacaatatcttttctaccatctgatggcagtagtcaccccctgtcttagtgatgttgctgctttgttgcagcactcacacgttgtatattttttattttattgataatgtggcttttattccagctataatttatctaactgttgatttcttctattttcttgcttaaaaaatacatggaggagagtttgtcaggccacatgtaatgcctgtgttcttttgacagaaagagagtttgatcctgacatccactgtggggttattgatctcgacaccaagaagccctgcacccggtctttgacatgcaaggtaggtggactcctgaaagtcaagtcgaccatcctgataaacatgggtgactgggatgtaccacactactcccacagtctctctaacccagagaagatgctctgtggattgttgtgaattgtgtaggtgaaggaataacttggttctgttgaagaaagcctcagattgacaaaatgtgaagtgcgttgttataaattataatcttgacagaggttttgtttctaatgagcagtgttgtatccacaggaatagtgttctctcccagtctgttatttttaaaaacttttaatatttccatataggctacccttgactgtgctttaaattatactggcttaaagcaagtgcagaaatttcccttgcgtgtgtatgaacatttaaaaaatgtgtcacccatggtcttaaattttaaagaaccactttttaaaaaatctgtgattttgaaatatccctgttttctagtttaaaaaaaaaatactgcaagccaggcatgcctgtaagtcccagctagtggggaggctgaggcagaaggattgcttgagcctaggagtttgagtccagcctggagaacattacgagacccatctcttttaagagaaaaaaaaaactagataaaatatattaataatttatatacaagctaagaaaatgtaatggtcttcctttttgctctggggtcttccttcttttaaaatgccagtatgctaataaggtatatttgctgaaaagtgtgggttattgatgtggggtggcttcaggtcatcagtgaacacctctacataaatgagcttgtatgttgatgtgcatttctctggagggtgtccccagctaccccccagataggttcaagaagcattcagagtcactgctttgaagtatgtaattttaaaaccttagagggaggaagtaaaaatgataaaagttagcattttcttctaaaaattaataaaattgttagtgttttactttaaattttattaaagtgtatttgaataaaggacttcaggccctgtcccatgccccagccagtggaggcatgttacagtcttctggagtgggaaatttttaagtggttcttactttaagcttctaatttaattttagtatatagattttgtcttacaacagtggttcagaacctttttggggaaaagggttggtcaagagtacctttaaatatctcatttttaaaaaaaaaaaaccacggtccatcttccgagaataaaatagtgcatacacatacacattctgaatttttctatcttggattaatggacacccccaccccaagcccatccttggatttctaggttaaaaactctcataaaacaaactgctttttttttgtatagggtactaattggacacacagtggtgtattggtggtggtgtatgaagatagccacctgagttctgtagaattatgtcagtttcagctgtccctaagagaatgtgtgaaagcatgcctcagccctgtccacatcatgatcacaacttgccattctccttctgcgctcttcctgcctacctgactctcagtaacatggatttctcagtaatacagtacctgtgggcaatgaggtttgcttttttcaaacccaagatgttctttttcagtcatttacaaagcgtggcagggaaccacacctttaagtgtgcaagacagtattgttgactgtgaaagaatattatacagcagatgtctagaacttgttcatcttgctataactgaaactttatgctcattgattagtaactccttatttcgctctcccttcagccgctggcagccaccactctagttgttgattctgtgagtttgattatagatctcatataagtggaatcatgcggtgtttagtcattatgtgactgggttatttatcttagtataatgtcttcaagcttacctcatacttgttgtagcatattgcagaatttccttctttttaagggctgaatagtattccagtgtatgtatatactatgttgtcttcatccagtcacctgttgacagacatttatattgtttctacatcttgtctattataaataatacttcagtgaacataggagttctaatagctctttgagattctgatttcagttattttggataactacccagaagtgaggttgccaaaagttttttttcaactcaaaatcttcaaggagcttgactggcattcttcctgtgcctttattgctaggtggagtgactttgaatgggtctgcatttttctcacatcttccttttcaaatgatatatgctccccttgtcgtccttctttaagggtgtcattactctccgtggcattgggctaagcctgtcattgcattaataagtcttgagacccagcttgtcatgagatcagcatagaactggcagaaaatgcagcatccaccaggcctgcccttttacaggatgacttgactttttttcattgttttgtcagttcttttccttttccttgccttcacgttggtctgaatctattaagcttggtagggctaaacatgcctgcatgtccctaccctgagtgtttcccaagttgctgccaggtctcttctgtcttagacttagaacgttatctgttctcttcaccgtcaggggatttgctgctgttcattcccattactcattctctgttgtctgtctcccatcctcactgcccctcctcacttcttcatctgtctaatatcccgtcgaaagtcctctgtgccttccacgcggagagatttgtgactcctgtagcctttgtccattcactcattgtagaactttttattacatacatctgtgagcacaggcctcactctttctaggtcgcagggaataaagggtttagcacaataaccacgtgttccctatgcttgtggtgcttacagtctaatgaaagagatggagagtattaatcaccaaaataactgtaaaattaccactgatgagttataaaaagatgagaggactacattatgaaagcctgcaaaaatgaagtttttccagggaaggctttcttgccataggaacattgggctgaaatcaatgtgatgatttatctgggcttgagagggatgggagaggtaggagaggtggaggaaacaatatgtgtgaaggctctgtgacaggggcagagcaaattccttagaaccttaaagccagccaggtggctgaacagaaagagggaagaagaggtacgcgggaccaaaggagcagggagcagtaagcaagggtcttagagtgtgcagggttccggagcctagttatgcagtcagtctttatcctgtgagccttgggcaacccctatcggatttctgtttggaatgttcttcacagctcagtggaaaccctacttaggcttcaaactgagctgggaaaatgtatctgcctgctttcttcatttggctgtactgtgctaggcaccgggaacattcaagctgaggagaggtttatacatctgcttggagagacaggcaggtggaccggtaatattatatgttcattcgttctttcaacacacgttggagggccattatttttataaactttttgtttgaagcatttgagcgtcaggtactcttctagatgctggtacaacacaaacaaaacaaagttcctggtctttaggttactttcttagggatattttccatattaaagaaaatcaagtaaaaatgtaaaaagctaaacacatttgtctgtgccaggttagattatttaggtagacatagtttgcagtgtgtctcgtaaggaggtgggttgtgttattcaaccgaaaatggtagttagaagcataattccctttttaagtccctaaagttgtaccaactatgccaatacatttgtattatgtgtaggggcatgcacacacacatttacaatattttgtaatataaaagaaggaaacgtgggtgaattcatttatgtttatggatatgtgattaggggccactgtagctcatgtaaactcatccactcctcaggattagcatctccttgcatttttacagactgagatctcagcagtatggaatggtcaggtttaacttgagtgattggactcaactgccaataagatttgcccaactctgaccagttcacacttgtacattcaactttatcttctgttagcaatagtattaggcttatttgttttgttttgttttaatgccagtaactatgaaatgcgtttggactacagacacattttcttatacgatttgcttcaaccacaggtgtgtgtattggttgccttaagacaaacactgccataatttgacttttctttttcctctgtgtatccatttcttaattctgaaattagacattgtctgaagacccaggggtgttgtccatcccatttccttaatttccatagccagtgtctatctatagggattactttgtctcccttcctgttcatagcatttcttctcagcctcatcttctgtccagtgctccttggctgtggcagtctgtctgcagaatgctttgggccactttctatttttgcatggcattttcattggaatagagggacgcaattgtgtttaatttttattctgtggaagttactaaaagaacactttctgatacatgttttatggaatgattgtttcttccctttacattaacattcaaaattttaaatggtccaaagagggtttttctaatggagtcaataagagcccccaaaaccaaattgctgttgtgtcacaaaacatgagtacttgttatatagcgctaatggttgctcttagttacataccaggtgtcaccgctcacatatcttttttcttctgatggaaataacatttccagattcttctgcatttagagcctagaacgtatgcttctagtctagctagggagaaaataatgggctcttaaggtttttagcttatcaaatgctgagtagcctttcactatgcttatggtctagattgcttatttattgggagtggtgttttgggatataaggcagaccaaaaattattaatgagattcctcagtttctgtatttttttggtccacagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggtaagccaggccctccaactctttctcccaccttcagagatgagacttgcagatactgtaaaatttcagtatggtcatgctgttgagaaacatatctcaggctcactgtggagatagttttttaaggagttttactatgaaaaaaaaaaaggaaaggttgagttcagtaagtttcaaccagggctcctcttggttgtaaatgcaagcagcaaaataaagctagagttatctgctctatacttgctgaacatcaagtgtctcaactctgttgagcaggcagaaattgggtccttcctgcgggttagtgacaggaactcttcacatggctttggcagcagtttccctttcatttgtctttatatagcagtgggaattcttgctagggacaagccgtttagcctgagtttttacagcatccgtttatcaatgtgttttcattcattcatttggggctttggcccaagcatgtattagcactttagtagcagagtaaacagtggatcagagtgttttaatgagaacttatacacatacctcagagacagtgatggtggaatatgtgtgtgtttgtgcttacatactgaaccaagttgaagtaaagactgtacctagtttccagagggaagggaaagagaaaggcatagagaaagaggggcttcagtgttggccgttcatttattgggagcaagagcttctgctgaggaatgtgccagtcctcggctgctattgcttaccatttcaccctcacatgtctgatctttaaaatggttgcataaaggtggaagcatctccctcgtggaaacccaggtgcctgttagagcctgtcccaacgtgagctttgtggtttctgtgcagtatgctggaggagccatcagaggaggctcctcagagtgtggtcaggacctggccagagatttcctccccaagtcctttctttggtcatcttctcattgaagtttttgcatctagaaaaatgtaagcttaattccagagaccattgtaggtgtaggaaaaatacattactgcccttgagtaagaggctgtaggctatccacataaagtggtaataccaccttattcttgtatcacctcctgtctctcctaggttatcttagagcattttgcaaattacagtcagccctctgtatccatgggtttcacatccgtggtttacaccaattgcagattgaaactatttggggaaagaaaaattgtgtcgtactgaacatgtataggctttttttttttcttgtctcagtattccctaaacaatacattacatagcatttacattgtattaggtactaaaataatctagagattatttaaagtatacgggaggatgcgcataggttatatgcaaatactacaccattttatatcaggccactttgtacatttgtggatttgcagattttgctatccccaggaggtcctggcctcaattccccatggataccgagggacaactatgtttcatttattgtgtaggtaaaccaaatccagttgaaatttgaagaggaatcaaagaattctgttaaattccacatgtatttccccttctttgggggagaatagaagagggatctgaaccacccaaatggcaatagaaaggattcgttctaagttaccttgattgtatctggcaaacagctgaacttaacatcctgcagttcaggagagaggttcctttactcccaagccacctggatcagcatctgttttcccccagtgctagaggtggaacccaggcctctgctaggttgttttggacacactgttgtatctcagttaaggtggctgattcccaggtgtgtgatctgatccgtgctgcactttctactcaccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctgtaagttccacgtccacccccgcgttgaccctccccacacagcatggacagggcactgcaggggggcgcgccagggatcttggcatgcccgtatgtgtgggacgcggtcaaggtgtgagagaagttcaaaacagggtgccccagaggcagcacacactctgtacgggggacatctcgtgcttttttccctttctcttccatgacgctcagggctaggcattgtcactctcatgcttcacagcctccggtactcagaggcagttctgtctttcctgattagctcctttcctgaaggatctagaaccctgactgggcatgccagtgtgggagtcagcaagcacgcggctatgttttctcttgcagttttgcacatttgggagccggcagataggaagaggctattacgtgtttgactccaggtggaatcgacttcgctgcgccctcaacctcatggtggagaagcatctgaatgcacagctatggaagtgagtgcctgttgttcttgggagaggagctgactttacacagtgctgcattgtcttttatttcctgtgagactgatgttatgaagatatgcttatctaaacaaaactggcctttggccctgagaagaaggtgccttgtcattcattcattcatttacccctttaccccacaactacatattgttgtgggtgctggcattcaaagcagaaggactcccacatgtatggagctcacagtctagttgggattgggtaaggggagaaaaaaactagtctacagaagaataaggagatgatagcttgtcctaagtgacagaatggaaacaataacaatcagcaagacttagtgagagccaactatacaccaaacaacttaaatatacttaacattcacaattctctgtcaggtgaccatgattataccctccccccacccctggttttttttttgttttgtttttttaatagatgacaaaactgagatacagtgtcatgcagcaagttagtggtagggccaggaattgaacctagaggtaacatgttttcaagtaaagagctgaaaatacagaggccagagggattcagggaaagcctctctgaagaaagaggcagtccttgaactgagaaggatggatgagaaacagcagtcactgggacagtagggaggagtgggttctgggcagaaggaagcagctgtgtcaaggtcttgagtcagaaaagacagtttgttgaagaaatagcaagaaattgagcacagtacaaggatgaggtccaagaaaccagcaggggccaggtgacactgaaattgtttcagtgttgaaggttttaggtagaggagccatgtgctccagtttgcaatttaagacaccttgtgtgatattatgtacctaatgcttcccaaacaggattttaagtggaagaagagttccatggccaaaaaggtttaactcagcctttcctgtaaaaaaaaaaaaaggttctgttttttactgcagaacttgtcagagccttaatgggcactgtgctttgtaactcttgaagcagggaatgtcacgtcatgtataatgtggaacatgtcccaagctcttttcacctcggaaccttttttaggggaacatcttggagaactagtattcggtgggagtgactttggtgaatagtaagctttgctaaagtgactgtccagtaatccccaggccatcccagatcctctgtttgggcattatttactagtgcctccttaaatggactctgccagtacattcatttgactccctgccttggtttcctaataaagtcagacgctagtcggaggccttggattgtctgcaacccaaagaaccatctccatgatcattagcaggacttacatccgtttccttagaacaccagattcagagcactgttactctgcttttctttttcatatttctttctggttcttgctggataagaggttcttctttatgaaggaacattgtccctggctagacacagaatcaggggactgggtttgggggttctgcaggggtttttccacaccagaactccctaagatacatgaaatctcaacttcatatttcttcagactacccattgggagttggaaagcacactgagctcatgaaactatgggtttaatgtactcctaagagtttagaatggatttctgaatgttttatccacattatgttggtatgtggctcatgaccaacagtttgggcaaagatagtttcagttcctagtggcttgtatagtgagactttcctcttgatgtgaactttttaaaaagtaagatcataaggtcgactctgctgtctactctgttctgtctgaaggctgcctacttgcttccggggagaaggaaaccaaccctttccattagcatgaccattggtttttaaaaagtctacagcaacaagggacgtgttgctcagtaatgagctgacacataggcttggggcagaggggaacttggtgcatgttgcctcccaacataggagtgctggcggccttttcaggcagcccctgagattttctctggggagctcagcacttctcatccagagaactattctcacctggcatctttgaagccctcaaggaaactttcaaagtgatccaggtcccaccctaccggctcagcccaaaatccttccttacagggttattgtggtaaaattgaaggtaagtgaggtgggaattgagtatgaaatgagtaaacttcagtttgtggagtctcaggccagtggtgaaattagaccagcactttctctgcagcatggccataacctgaaaggccactgcccaccttctatgatttctgtgaactacttgtcctctgttgatttgggaccagtatcccatattccctaagaaggggctgggatggttttcaaagatttttgttggtgtattttttttttttttttttttttactttttgaaatggtaatacaatcactgggcttaaaaaaggaaaaccaaggctgaggcaggagaatggggtgaacccgggaggcagagcttgcagtgagccgagatcgcgccactgcactccagcctgggggtgacagagcgagactccgtctcaaaaaaaaaaaaagaaaaacgagtataaagaggcatacattgaaaaccgagtcctcctgtctcctacatgcttgttttccacctagcccccacagacatttttattattttttatgtatctctacatagtttatttatgcaaacacaagtcagtatgagtacatattgttactttgcctctttatacacaaaagagtaattaactacttaaaagagcttttctaagaggaacttgtgattgcctcccggagagatccacatccttccctgctctagaaggcttttcctttcctcgagatttggttccaggcagcctggtctttaggccctggcttcctgagccacctggtggtcatgagaagccactgctcccagtgagcagtagggcctggacttcatttagagcagggcttctgaatgctccagaatcacccaggggccttgttgccatgcagcttctgatgcatcattctagggtggggcccaggaactcagttttcctaaccaacctctcaggtaattaatgacactgcctgccaccctcctctatgagtagtgcggggagagagagcctagcctctcaatcttggctccacattagaatcccctggaaagatttagaaatgactgatgtctgtccccactccccgcagagacgctggtgtaatcgttatggatgtggcttaagctccacaggtgactgtaatgtgcaacagctggagttgagaagcactaacatcaggccagagctgtacccttgaatggggttttgggtttttttgtttgttttgttttgtttttgaaacagggcctcactcagtcaccgaggctggagtgcagtagtgtgatttcagctcactgtgacctccacctccccggttcaagcgattctcctgcctcagccttctaagtagctgggattacaggtgcacaccaccatgcccggctaatttttgtatttttagtagagatggggtttcaccatgttggccaggctggtctcaaactcctgacctcaagtgatccaccagcctcagcctcccaaagtgctgggattacagttgtgagccactgcgcctggccgaatgggatttttaaagcatttgcaaatacttgcagtcattaattcattttattaataacagtagtctttaaaagcatctggaaatcacctgggcagcagtctaggccagctctctcactggggtagtggccaggtcagccagggctaccccttaagtcaggatcaaggcaatcctggcacttgccttccagtcaggcctttttgtcttctgccacctcggtttaaattctgccaaagaagtttttgaaattttgttactgtcacatttaagattcagagctaaaataaaaggagaccctccctggtttgaatttagatggtttccgcatcccctaataaataccttgcccacacattcttaacagaatccattgttacaacaccatgctgaatatcccttgatactgtggggctttattcccttgttcaggccaatagttatgacctagcagttgctgttaattagctgcacccttccttttctctcattcattcctgacttctctcgacatttattcagtgccttctgtgtttcctgcactgtgctgaacactaggaccacaacggtaattaagctggggatgactctctctgcagaggatttggtgattagcaatccgacacttaaaggatgagcagaagctggggtattgggtcatggcattttctcagaatataaggaagtacagtggctggaagcagggaacgggggcgttgggggtgggaggtggagctagaggctggggcaatagcagcggggagttgcacacatacagttctgtaagaactgtaccaggaaggcattaaagaatttgaaggagagaggtgacaggattggctttgtagttcagagtgattgctttgatgtggatggtttctctttgtcacaagcaaagagggtggtgccatctgaaagtctctgtgaatggctgtggtcagtgtcattcactgtcctctaatttttttcaggaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcaggtaggaaatggactgtgagccccatgggaatgcccatttcttctcccttaagatcttttgtcagctcagaaatgtgtttggttgggttggttggttggtttgtaaacagatattcagcttcatggtgtcttcttaaaaaaaaaaaaaaaaaaaaaaaaggttcacggccgtatgaaggtaaaacaggctcttctgccagaatttctggtgcctttggaagatgttcttcagtaaagaaactacagtaatgcatttttagtagagctgcagaaagcatcggttgtgacagcaaaatcataattggagggtagcccctttatgaaatagccagtaatgtgttatcccagtgctgtgaagtgtgtgccattcgaggctttaaggaaggaagcaggcattgtttcctggatagtggttctttagtatgttccgctgaggaaagctgcgctaaaatcaaactgatctagaaaggggtgatttaagatttaaaatgaggctgggtgcagcggctcacgcctataatcccagcactttgggaagctgaagcaggtagatcacttgaggtcaggagttcaagaccagcctggccaacatggtaaaacccccgtctctactaaaaatacgaaaattagctgggtgtggtggtgcacgcctgtaatcccagctactcaggaggtggaggcaggagaactgcttgaacacgggaggcggaagttgcagtgagccaagatcgcgccactgcactccatccggcctatgagactatgtctcaaaaaaaaaagagcatttattatttttccctctcaaaagaatttcagatattctggttaaatctcaccccatattttctcttcccgtttttgagggaggcaggaaaacaggattcagtatgggcatagcagaagactgaaatctcattccaagctcatagttaaaaagaagtctgcatatgaacccatcagtagagaagtggctaagtggttgtgggattcataattaaccatgactttctctcttaggctgtatttttgtctcgtcccagctcttctgcctgttactgacctcacctgtagctgtttcttccagcttcctttgctctaacttccagctcatctctcatcttgttattttattcatcaggatatctcctcaccttgcttacgaacaggaatttcagcaacatcaccccagagccctgacttaaaatgtgaggctctttttcatgattttttttccccttcctcgtcttcagaacttaactcaaatgccagccgggttaggactttttcagaaaataccaagaagtttcttagtattttcgtagtgtgatataattttcctctaatatttgggtgaattaacacccattgccaaaggtatggggaaaatatttgtgaatttaactagctgcatgcattatgggttattatatgttgtttggcattctgatcatgggattcctggacaaatgagaagtgtgcttttccttcttggtttgtagttactcattacagtttataagcataacagtccaatataaacacagaagacatggtgtgccgattcttcaacgcaccgtctttgagagagacatgatccccacggaaggggcattccattgtgctgtaatgtccatctcacatctgtattagtgagcacactgtcttcatttagacaggagtgtagatcttaatgcccacaagtaacaaaaaggacagaaggggggggggccaggtggggcacagcagagattgacagtgcctactagaaattggggggacatggagcagctgcttccagacatttgttaccagttttaaagagaggctgcagatctggacttgcatgtgaaatttagttgagatatatgtgtgtgtgtatatatatatgtatacacacacgtatacacacacacttttttttctcttcttaaatctggtatagcctatgtatctgtgggccatctttggctcatgacctgccattttgccacctttgatttttaccatgtagtggcactatgtcttactagaacaacacagacagcctaactttgggctttttccttaaaatcagttaaaatcagtttccacttaagtttgtgtttgagagagattttctctgtgcagaggaatactttttattatgctacacaaatcctggggcaagagcaggggtgcttgcttagagatcaaaggatcattgaaccccaagaagtattgcacatttttatgtctttgttcatttatcgtatagctttcataagaatctcaaagggactcgtgaccccaaaatgctttaaagaatgctgctgttacaaaagtagggacctctacttgctgttccttgtggagctgccattaaaacaaaaataactgggctagttgaagttttctaaacaaggggatgaagagtgggacatgctgggaagcctaggagatgatggggttgggtaggcacccccaagagtctgttcatggcctgtgccaccaaagatgtaaaagcccactgtgaatgccagagtttcctcctccccagcatgggcactgccttgagtgcgaactgtcacacctgtgtgtgctagcccttgaccttgttcccttctcagttaacaacctggaataccttcaaggacacaaaagcactggaataccttcaaggacacaaaatcagtaaataaaaccaaaaggcaaacataagagccttttctctaagttagaaacccaggcctgcaactcttctagccagttggctagaagtgaatctttgcaatgattgtgcccagtagtagtgaaggcatttgaaagctaagaacaaaatctatagctgactgttcctggtgtcactcagtcaatggagactttagtagcgtgcagcctttggaatattcttgtttagaatcaatagagtgcagtgtacaaacgcttacttaccatttcattatttccccaccccctcttttttgaaagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacag

SEQ ID NO: 13452 - DNA, 30868 bp, Human
  misc_feature (1)...(30868): n = A,T,C or G
tctgaccttgtgattcgctggccacagtctcccaaagtgctgggattacatgcgtgagccaccacgcccggcctgtattttttttttatttttattttttgagatggagcctcactctgtcgcccaggctggagtgcagtagcgccaacttggctcactgcaagctccacctcccaggttcaagtgattctcctgcctcagcttcccaagtagctgggaatacaggcacccaccaccatgcccaggtaatttttgtatttttagtagagacgaggttacactctggcctgttggccaggctgattgcaaactcctgacctcaggtgatctgcccgccttagcctcccaaagtgctgggattacaggcatgagccacagcacccggcaactccatcttaaataagaactgggtaaaataaggctgaggcatactgggctgcgttccaagaccgttaggcattctaactcacagtatgagacagcaggtcagcatgagacacaggtcataaagaccttgctgataaaagtttacagtaaagaagccggctaaaacccaccaaaaccaagatggcaatgagagtgacttctggctgtcctcattgctacgtcttccactgtcagaggcggttgaaccagggcaactctatcttgagtaggggctggttaaaataaggctgagacctgctgggcagcattccctggaggttaaggcattcgtagtcacaggatgagacatgaggctggcacaagatacaggtcataaagaccttgctgataaaacaggttgcagtaaagaagccgactaaaaccgagatagcgatgagaacgacctgattgtcctcactgcccaccagtggccatggcaacgtcaggaagttaccctatatggtctaaaaagaggatgcatgaataatccaccccttgtttagcatatcatcaagaaataaccacaaaaatgcgcaaccagcagccctcggggctgccctgcctatggattagccattctttattcctttactttcctaataaacttgctttcaccttatggattcgcctcaaattctttcttgtgcaagatccaagaaccctctcttagagtctgagatccggacccctttccagtagcaaaaggtcttagactgaagtactgactccacagtcgttgttaagaatcctagttgtttaatagaggcggtcttgggctcttgctgggccgcggtgtgttctgggaagtgtagtcacctgagtctccagttccttgtctctgggccgtgtgtgcacgccagcgaagcactgtgggagtcgtagtaggggaggaaaaccctataccctctggcgtgcggcgcaggagtttgggggaatgtagtcgccagagctctgcgttgtcttccggctttgggcgtggccacgatgcactctgggagtcgtagtaggggaagaacgtcctccgctcttttgcgcacggtcgctagaggttctgggaagtgtagttgcctgaagctcgtgttctttgtctttcgatgatgtgcgcttggcctcaaagcaccctgggagttgcagtggggcggggaaagccatatgctctctcgcgcggggtcgcggttgtttctgggaagtgtggtggcctgagttccacgttcttcgtttctccgctagttgtgcgcttggccgcgagacactctggcagttataggaacacaaaggtctgtgtactcttccgcggggggccgcggttatttctgggaaatgtagttgcctaggacccgggttctttgtttctcggctctgggcgtgggaggatagcccctatgctctggcgcaccgggccgcgatggctctgggaattgtagttgtcgcaggccctcgttctttgtctcctggcgttctgggcacggcagcgaggcgctctgggagttccagtaggaacgaaaagcccttgcgcgcagggccgcattggtttctgggaattgtagtttcttgaggccggcggcctggttggggtgacgtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtgagggggttctggggaggcgcgccgtggcaggaagagaaagccggcgccagtggtccaagcgcgatctctcagggcgccctgctctctacgtgggaggcgcggagcgggggccacgggaatccccagtgcgggaatctagtgacttgggcgcggcctagctggcctgttcgctcagggctcctttctctctctgccaggtctgccattttacacttttctgatctcctccttcccttctgtgagctatgtctcaggtaagctaatgattgataaatatatatatatatatatatataaatttttattttttttttaagagagagacagggtctcctcctgtcgcccaggcagtggagcgatcatagcatcctgtaacctcaaactcttggcctcaagtgagccaacccacttggcctgtttccgcttttctttgtgaagtgcagccgtgtttttcaggacttgggacgtggctttctttctcctacaaccacctgcctggcagaaccccaggaccctgtcccttgttcctccttttcaggtgcttatacttaagtatacatgaagagagtgacaggaagctatccagatgtgggcggggtttctgacctggctggcatgttttagggtgagagggtagggtgccagctgttacatcgcctcctctttcccacagtgttagaatgaggagtgctttacgttactccagcgcccctttattcatttattcaatatgtttttactgaacctctactttcagtggttcccacagtgtgatccttggaccagcagtatcagcatcatctgagaacgtattagaaatgaatattcttgagtcctaccccagaccttctgaatcagaaactgagaatttggcccagcagtctaacagtccttccaagtgattctaatgtgcaactcattctaagtcttgaggatgcagaagtgaccaaaacaaaatctccgaatcctcagagctcatttttcagacatgacataaggaacacatttttattttgatttggcctaagggcttggctggtaattgtgcttcacagcagtggggataacagggtcaactattcaaaatgagtccctcatttcagttccacttctttatcctactttttgtcatacttctctccaaattcagaggttctctgagttttgctggggaatccaatttccacctctgctgcagatcttgctgtgtaggaaacagctgctttattagtcaacagtctttaatcacttttttattaaacttcaaaactgtaaattataactgccatccatctgggactgctactagtttgagacattttaaattcccattcatgccttatagatcaatgtggatcactcaagtggtgcaaaaccaggctgcaaagcaagggcttatatattattccccctaactctgagggaaagtgctttaggttctgtcctgggaggtattacattctcttcttgcggaatcaagattctttattgcttatcctccttgttctgtgacattgctaaaattaccactaagtttcacaggtatttctttaggattagggataactgtgacaaacttgagactgtatgccccatttgaagggtggtgctgttatctgctgtagccaattattaccctgaagaaattctggctgaattatattaaaataggctggtattaaggaaaatatacattgtttattaacataaaggaatactgtaaaatcttaagaatttttacaaccaatgccaaaaatccatattgttcatgtgtataatcctttattttgaataaaattgtaaattatctcaggacagataatttatgtttttctccttttctccagttatacaacaaaacacaagagctaggctcttcattatataattactcagaattctgaaaactctcactgttactacttagacacattgcctaacctccacagtgagactcattttattccttgatgagggagtttgggggcatgcgtgctggtcatgcaaatatctgtccgtcatttcaggggtcagtgacattcagagatgtggccatagacttctcccaggaggagtggaaatggcttcagcctgctcaaagagatttgtacagatgtgtaatgttggagaactatggccatctggtctcactgggtaagtattcttcttcatctccctcaaggcaaaatttgaccgttagggtggctgttataattatctggctgaatattcccaagagaggtatggggtttcttaaaattagttttaagatggggacgtaactgcaccttatttttagacattttaaaaacttacatctgacatttcctttgtggcccctcttaggattcaatgactgatcttgaatttatttcattttctgcaagcaggtctttccatttctaagccagatgtggtttccttattggagcaagggaaagaaccctggctggggaaaagggaagtgaaaagagatctgttttcaggtgagtgagttggaagctgatggggaaattttttaaaaccactcaattagtcaatgaaaaaggaatactttttaatatgttgattggaaaattttcccttaaagatactagagatacgctaggcacggtggctcatgccggtaatcccagcactttgggaggccgaggtgggtggatcacgacgtcaggagatcgagaccatcctggctaacacggtgacaccccatctctgctaaaaatacaaaaaaatttgccgggcttggtggcgggtgcctgtagtcccagctacttgggaggctgaggcaggagcatggcgtgaacccgggaggcagagcttgcagtgagtcgagattgcgccactgcactgcagcctgggagacagagcaagactccatctcaaaaaaaaaaaaaagataccagaggtataaagactgaagtttcacttacaactccataaaacactacttcatacccaattctgttttttctatattacctaacagctgacatagtcgaccagttctcaccttatactttcttttctttctcacaggtgtcttttttgttcccgttgttagttctgtctggtctctgaatttcatttctttttgttttttctttcctttctttcttcaaatggacatacatttctattgcctgaattcaacctgagaaagaaaaaaaaaattaaaagtacatattttgctgttctatttaatcaccttgaaaagattaattcattactctttgattaattgatatttatttattccttcacatacactcttaatatttacagaaattttaatcttgtcaaatctttctcaagactttctattaagtgctacagagactagagagtgtgcaaaagtgtaataactatcaaggaattcatggcctagtgatgtgtctaaatagcttgcattagatatcctcaaattagcagtacagcagtgaaaaaaggaatttccagttgtcgttttaggcttgggtaatttggatgcagatagtactagagaaacaaaagacagaaaaagggtcagttttggagaaaaggtgatgaattctgtaagttctgtaaattctatagttgcttctatagcacatgtttaatggaggtacactgatttttagagagaaaaggaggaatgcgtactttttaggaggcagcagcttaggactgatgaaacagatgtcatgaaaactgagctgtagctttaaggaagagtagtggttcatatgaaatgctgcggagtcccttaggagaatgtccagaaggatttgcaaaggaggtactaatgtgggctgaagcagtgagatggaacaggtgcagggaaactttgtttagtgggagcaaatgaggaaaaatgtcctttttgaattaaaaaataacaaaactgataaaagcatgtacaaaggaagtgaggaaaaaggaaaacatggaagttgcctctaattctactactttttttttttttttgagacgaagtctcgctcttgccccctaggctggagtgcgatggcgcgatctcagcttactgcaacctccgctgtctgggttcaagtgattctgctgcttcagccccctgagtaactgggactacaggcacctgccaccatgcctggctaagttttgtatttttagtagagatggggtttcaccatgttggccaggctggtctcaaactcctaacctagtgatctgcccgcctaggcctcccaaagtgctgggattacaggtgtgagccactgtgcctggcctaattctactactttaacacagttcttgaagtttttatgtattccttccaggatcttattttgaaaatttttttcattgtgaaatatcacacacagacagaagtaatgcatgaacatacatgtacagcttaataaattattataaggcaaacagccacgtgaccaaggtcaataaacacaatactgctaggttccttgagagccttctgtgtgctcatcctaaccctccaataaagctaatcatctctttgcttttatggtaaagtagcttccttggttttctttattgttccatcagctctttgcatttgtgttcactatagttgaggttcatgtgtttgttaactttatatagaaagatttataatgtatttattgatttgcttctcaaaattatttttaaaatgtttttggctgtgcatggtggctcatgcctataattccaatactttgggaggctgagttgggagaatcacttgaggccaggagttgaagacaagcctgggcaacatagagagaccctgtctccacaaaaaaattttaaaagctagctaggcatggtggcatgtgcccatagtcctagctacttgagaggttgaggtaagagaaccacttgagcctaggagtttcaggctgcagtgaactatgattgtgccactgcactccagcctgggcaatacagcaagaccctatttttttaaaagttaaaagaatttttaacgtaattgctctaatagtttttttcattgtacgataagtataccacaatttattcgttctactattgagggcttcttaagttttttgcacatttagagatactgcaagcaatgctgttactgtgcatgtatcctgatacatattggcacaagtttctctgtggtttatatctaggactggaattgccaagttggaggataatgcacctctttatgttattagataatgccaaaatgttttccaaagacccttgactgacttatactcccgcaaacccaataagtgaatgcctgttgggcatcgtaattttcatctatcagaagggtgtgcagtggtagcttgtggtttaaacttgcatttgtcaggccattaataaagttgagcaccttttcgtatgtttattgaacatctaggtatccccatctgcgaagtgaatcttgaagatttttctcttgtatctattggattcttttattgatttgtagaagttatatattttagatagaaatcctttgctaattgtatgtacttcaaaatctttcacatgtggcttttttttaaccttcatagcttcttttgatgaacagaaattcttaattttagtgtagtcagatgtatcaatcttttcttttatgtttagtatttttttagcctgtttaagaaatctttccctcctaagagattatgatgaagacatcttcctatattttcttttaaaaaagcctacttattttgccattcacatttcgatccatcgttcactttattttgtcatgtgagttagtagtcaactttgctatcttctgtatggagatccagttatcatagtaccatttattgatagatcaaccattttcctcactgttttgaaattagttaaatgtcaatttttgtgtttgtatgtttctaggttctcaattctctttcatttttctctttgctcaaatctatacagccttagttacagatttaatgattaacattttattgtatttgtcttacccctgcccctttttttctctgaattattttaagtaaacagggctaccatttaagagttgttgctgcaacctagtgtagatctaatcattacctgaactatgtaggcatccagggagctaagggaggtagacagattggaaataaagtgaagaagtagactcaaaaggacctggcgattggctagatgacagacatgaagaagactgagaagtcgtggttgacattagtctttttggtggtatgattgtttccttagttaaaaaaaaaaggatcagcaagtttgtaggggagggaagattatattgagacttgttgagtttgggtctctgtgggatacgaatatataaatccagtaggcaattgagtatcatagtcaagaggcttcaaatgcatattcctaggccccaccctggaaattctaaattggtaggtttggggtggaaccaaataatttgcatttctttctttttttggctagtcaaaaaaaaaaaagcgggagtggaggagaaacaaagaaatctataactagttgttatcaatgacttataaactccactgcattcagaccagccagaatttgcatttctaacaaatgaccagatgatgctgatgctgaactaaagtagacatttaggagttacctgcacagcttcttaaaattttgaattttctttgtagaattgttgcatacctgttatttcttcttaagcaactttccccagtttcttttctatattgcttctctataggaatgctagtcaatttgtatatttatatctctttatctttattatacaaataatacggctgagtgtggtggctcacacctgtaatcccagcactttgggaggccgaggtgggcagatcacctgaggtcaggagttcaagaccagcttggccaacatggtgaaacccgtctctactaaaaatacaaaaattagccgggtgtggtggtgtgcgcctgtaatcccagctactcgggaggctgaggtggaagaatcgctggagcccaggaggcagagggtgcagtaagttgagatcatgccattgcactccggcctgggcgacagcaagactctgtctaaaaaaaaaaaagaaagaaaaaggaaggaagaaagaagggaggaaggaaggaaggctctaaatctttctagattttttcctgcaaataccattgttgtttatagaataatttcactgcactaaaaattctctgtgttctgcctaatcacccattcccaacccttggcatccgctgatttttgttactgtctccatagttttgcctgttccagaatgtcagagagttggaattaaccttttcaaaatggcttctttcacatactaatacatagtaatatgcattttagttacatgtcttttcatggcttgatagctctttctttttagcactgaataatattccattgtctgcatgtactgcagtttacttatatgttcacctacttaaggacattgtggttgcttccaaagttttgacaattttgaataaagcacatctgtgtgcaggtttttgtatgggcataagttttcatttcatttgggtaaataccaaggagtgtgactgctgggtcatatggtaagaatatatttagttttgtaagtaactgccaaaatgtcttccaaagtgattgtaccattttgcattcccgtcagcaatgaatgattgatattatcatgtgattttatttttttatcacgattggttgttggattttgctaatgcttttattgcttctattgatattatgtgattttacttctttagcctgttgatgtgatggattatattttacattaattgattttcaaatgttgaaccagccctgtatacctgggataaattccacttgggcatggagtataattccctttatacattgttggattaaatttactagtattttgttgagaatttttacatttatgttcatgagagatactggcctgtcattttcttttcttataattcctttggttttgatactaggtcagtgctggcctcatagaatgagtggggaagttttccctccgtttctgtcgtctggaagagattgaggggattggtataatttcttccttaaatgtttggtagaatttaccagtgaatcctgatgctttcatttttgaaagttattaattattcatttgatttttttttttttcgaggcagggtctcactctgttgtcaaggctggagtgcagtggtgcaatcatggctcactgcagcctcaacttcccccggcccaggtgatcctcccgtctcagcctcccaagtagctgggactacaggtgcgctccaccatgcccagctcatttttgtattttttgcagagacgaggtttcaccatgttgcccaggctagtcttgaattcctaggttcaagcaatctgcccaccttggcctcccaaagtgctaggattgtaagtgtgagccaccacacgcagcctcatttgatttctttgctagatacaggcctattcagatagtttcctccttattgtgtgagctttagcaatgtatgtctttcaaggaattggaccattttagctatgttatcaaatttgtgggcagagttattcatggtattcctttattatcctttttatgcccatgaaatttgtactgaggccccctttcattgctgatattaataatgtatgacatctttttttcttaattagcctggctagaggcttattgattttaattatcttttcagagaactaggttgatttggttgcttttctctattaatagcctattgtaaatttcatcaatatttgtgcttttttttttttttgagacagagtttctatccttttgcccaggctggagtgcaatggcactatctcacttactgcagcctctgcctcccgggttcaagcgattcttctgcctcagcctcctgagtagctgggattacaggtgcacgccaccacgcccagctaattttgtatttttagtagagatggggtctcatcatgttggccaggctggtcttgaactcctgacctccagtaatccacgcacttcagcctcccaaagtgccgggattatagatgtgagccaccacacccagcctatttttttgagacaggatcttgctctgtcacctaggctggaatgcagtgccacaatcgtagctcactgcaacgtaaatttcctgggctcaagccttcctcctgccttagcttccaagtagctataagtaccgacacatgccaacactcctgactaaatattttattttttatttgtaaagacagagtcttgctatgttgtccagtctggtcttgaactcctgtcctcaaatgatctacccaccttggcctcccaaagtgctgggattacaggtgtgagccactgcacctgggtcctttgctctgatttttatttcttttcttcttcctttgaatttaatttgctctttttaaaatttcctgacatagaacgtagatgattgatttatgaaggggtggcctgcccctccacacctgtgggtatttctagtcgggtgggacaagagactgagaaaagaaagaagacacagagacaaagtatagagaaacaacagtgggcccaggggaccggcatcagcataccaaggacctgcaccagcaccggcctctgagttccctcagtttttattattattttcattatttcagcaaaaaggaatgtagtaggagagcagggtgataataaggagaaggtcagcaaaaaacatgtgagcaaaagaatctatatcataattaggtttaagggaaggtactatgcctggatgtgcacgtaatccagatttatgtttctctccacccaaacatctcagcggagtaaagaataacaaggcagcattactgcaaacatatctcgcctcccaccatagggcggttttgctactatctcagaattgaacaaatgtacaatcgggttttataccgagacattcagttcccaggggcaggcaggagacagtggccttcctctatctcaactgcaagaggctttcctcttttactcatccatctcagcacagaccttttacaggtgtcgggctgggggacggtcaggtctttctcatcccacgaggccatatttcagactctcacatggggagaaaccttggacaataccctgctttcaagggcagaggtctctgcggctttctgcagtgcactgtgccctggtttattgagactagagaatggcgatgacttttaccaagtatactgcttgtaaacattttgttaacaaggcacgtcctgcacagccctagatcccttaaacattgattttatacaacacatgtttttgtgagctccaggttgggtcaaagtggctggggaaagctacaaattaacaacatctcagcaaagcaattgtttaaagtacaggtctttttcaaaatggagtctcttatgtcttccctttctacataggcacagtgacagtctgatctctctttcttttccctacatttcccccttttctttttgacaaaaccgccatcgtcatcatgacccgttctcgctggtcgctgtctctccggagctgttgtatacacctgtagactaataatagaaaggacagacatacaaggattaatacaaaatttgtaatagtggaatttccagtggttttaacccaagtgacagggttaagatttgtgaggctatcaacagcttttaccattgtctcagtttctggcaccagatttaactgggttttgatgtttcaaaaataatgttctttcaatttggaaatatctaaagtaagattgtcttctcttccttgtagacggcgtttaaccatgtcccagtgatgttcagattcattataggctcgaggtgtaatacaaaaatctgacgtagtccagtcacactaactgaaaaagatattccaggctcatgagcctatctcccatccaaatgacagtttgtctaagatcattaatttgatttgctaatttttgatctatttgagtctgagaattccacagtcttgaggaattcttttgccaattattcacatattttgtagtttgaacagagcagtgtaaagcaattccagcagccacagcagtagctgtgactgcaataagacccataatcactgcaatcaaagtaaaaatgaatcttttagatttagttagaactccttttaatacttctgttaagatatgtacggatggagaagcctcccacggtcggtccatggacacagggatcctcgcaccctctcttgccctcactaacagaatacgatgctgccaatcaaaagttgaatcaatgcaagtaaacaatctacaattttcacaggttatagtttggacatctggtttaataactatgtttcctacaactagcatataagggggttttacacaactttgcaaaggaattgtcagattggaatttaggttaatagtgtaatatggcttgtgatttcttgtttccataacttgatttccataccaaattttaatgtggtaggagaccacagtgagcttccataattttgggtgttcaggaccaacaacaggactaactaactttggtcggggtgatgaaattcccttttcaccccatttccatggatagggtgattctagccttctgtaaacctggtctagccttttagttaaatcaccatcataggccggattagtgggccagagagatggagcctgtgaacatgagtgggcctggcccgtacaatcataatataattggcctcgaggggcccagtctataatagttccaaatttattgttttgtagtaccactgcagtatcagccgcacattgttcccaaactaagacttctgggtcttttgattcttttggaatttccttggggcatggttttcccttaggcctaaattttaatgatctttgataggaagaatcctgtaaattattcatttgtgacccgattgacattccacttaccatgtgataagtaaatttactggtggcattgacagtaggtacttataccaaccaattttggattgtaggcattaagcatcctggtgctttttccaggcaaataggaggataatgatacccaatggaaatgtttatcatcattccttcttcaggttgggcagggccacggtcatccatggggcctggtacccatgcactgttattaacgtatacttcaataggattatctatccaagtaattgtctgaattaagggtgggaaaggcacataggcccagtaagtatagttagttgtagcggctcctgcagacatagggagacttaccaccgttgatacaatcattaaagctgcaagcagcatattctctggagtttgtgttactcttgtgttttccaggctttttttcagctaactgtgtcagcttctttagctgggcccatgtcgacggctccgctttcttggtagatggaaacttcttttgtaagttgtaagtatccaaactggaagctgatttattttctggttaaacacaagcaaaatctctcccccatgttatcaccttccctatttcccatgttttatttttgttgtctttccaccaaattagttttccctcatgtgggctgttctttttaccagtaaaatgttgttctgcagaagtagtggtctgatttctatatatgtttagaaaattcaaagtatagagtgctagattaagttgtatctggggagtgttatattccttactttttgtctcccttctcttacagtctctctcttcctctctctctctctcacacactttatctccagtttcactttctgtgtctctctctaatctctgtctcttccttttacacgatctctctcgccagtctcactttctgtgtctttctctgatctctgtcttttccagtctctctgtctgttatcccctgtgtcctctctccttcacacttagtctctttttctttctctttttctccccagttttacttttctctctgttggtctttcccaaataatgaaaaggagtggaggtctgaattttatcagatgatattgtcaggcctgcgtttgcaacctctgtctgcagaaatgtgtaacagtcaattaatttgtctctggtttctggagcacacaaaatattatcaacataatgaataatacaacagtctgaaaacttgtctctcattggttgaagaacttgagctacaaaagtctgacaaatagttggactattaagcattccctgaggcaacactttccactgaaatctggtggctggttctttattatttacggctggtatagtaaaagcaaatttttcaaaatcctgttttgccacaggaatggtaaaaaagcaatcctttgaatcaattataattaaaagccaatctttgggggtcatggccggagagggcagcccaggttggagaggccccatgggttgaattgctgcattaatggctctcaaatcagttagcatgcaccatctgcctgattttttctgaattacaaacacaggagaattctaaagagagaaagtgggtggaacacatcctatttaaaatagttttttaactattttatgtaacacccccaacttttccttagagagcggccactctttgacccatacaggaagctgcagggcaagtctgaattgctccttcaccgtagtgaactgcaggttgggcaataatgagtgccacgagccaagtcgcagcaagcgtagtttcaggctccctcccccagcactcactcggctgaggaggaggtggccatcgtgcttttaaccccaacagccctgatggttctggactttttccttttaattttaatgtttcaggatatattacctcctgtaattgattgtagtcaacattttgcgttgaccgagccattactggctctgctacatttttaccatgtgaactttctgttcctttcttgaactctgtttctgcctcttcacaatctattacacagctttcaggggcatcagaaactgaaactctaacttcttctgtttgaaatggttctaaagttgctttaataatagcccaatcattccatactgcacgtgggatgattttaccttccctagttgcttgttttaattctttgccaattttttcccaatcttttaaatctaaagttccctgttctggaaaccatgggcagaattgttctattgtttgaaatagcgtaattagattttctgtagaagctttaactccccctcttcttaagagaattttaatgaagctgagataagaggcatatttacttgcagtttgccccattgttaccctggattcctccgagcgcacaagcttaccgcaaggctgactgtggatgtactcgggaatctctcgtcggctgtcctcaatgctcacgttcttagcataccttcaccctagagaaaggcccccacatcgggcgccagatgaaggggtggcctgcccctccacacctgtgggtatttctagtcgggtgggatgagagactgagaaaagaaagaagacacagagacaaagtatagagaaacaacagtgggcccaggggaccggcatcagcataccaaggacctgcaccagcaccggcctctgagttccctcagtttttattattattttcattatttcagcaaaaaggaatgtagtaggagagcagggtgataataaggagaaggtcagcaaaaaacatgtgagcaaaagaatctatgtcataattaggtttaagggaaggtactatgcctggatgtgcacgtaatccagatttatgtttctctccacccaaacatctcagcggagtaaagaataacaaggcagcattactgcaaacatatctcgcctcccaccatagggcggttttgctactatctcagaattgaacaaatgtacaatcgggttttataccgagacattcagttcccaggggcaggcaggagacagtggccttcctctatctcaactgcaagaggctttcctcttttaccaatccacctcagcacagaccctttatgggtgtcgggctgggggatggtcaggtctttctcatcccacgaggccatatttcagactatcacatggggagaaaccttggacaataccccgcttccaagggcagaggtccctgtggctttctgcagtgcatgtgcccctggtttattgagactagagaatggcgatgacttttaccaagtatactgcttgtaaacattttgttaacaaggcacgtcctgcacagccctagatcccttaaacattgattttatacaacacgtttttgtgagctccaggttgggtcaaagtggctggggaaagctacaaattaacaacatctcagcaaagcaattgtttaaagtacaggtctttttcaaaatggagtctcttatgtcttccctttctacataggtacagtgacagtctgatctccctctcttttccgtacaatttacattttttctaatatattaattcaatgctataaattttcctttaagcactgctttcactgcatcccactgattatcccactgaaataagttgtattttcattttcatttagttcaacatatttttaagtttcagatttcttgtttgtgttacttagaagtgtgttgttcaatatccatgtgttttgagattttccttttaatctttctgttactgatttctggtttcattccattgtggtctgacagcacatattatatgatttctattctttgaaatttgttaagatgtgtgttatgactaagaattgcgtctatcttcgtgaatgtcttgggaattggagatgaatgtgtaatctgttgaatgaagtagtctactgatatcagttgattgatggtgctgttaagttcagctgtgttcttaacgattttctgcctgctggatctgtccagttctgaaagaggggtgttgaagtccccaagtgtaatagtgcattcatctgtttctccttgctgttttatcaggctctgcctaatgtattttgatggtttgttgttaggcacatgcacactaaggatttttatgatttctttcttggagtattgactcctttatcattatgcaatgctcttctttaaccttgctctgaagtctgctgtgtctgaaattaatttagctacgtctctttcttttgataagtgttagtatggtatacctttctgtactcacttattctaaatctatatgcatcttcatatttaaactaggtttcttgtacacaacatatagttgggtcttgttttgtgatgcactctgacaatgtcttaagttagtgtatttagactgttgaccttcatttttaaaatttatttaatttttggctgggtgtggtggctcacgcctgtaatcctggcactatgggaggccaaggtgggcagatcatgagttcaggagattgagaccatcctggctaacatgatgaaacctcgtctctactaaaagtacaaaatattagccaggtgtggtggtgggcacctatagtcccagctactcgggaggctgaggcacgagaatggcgtgaacccgggaggcggaggttgcagtgagccgagatcacaccactgcactccagcctgggcaacagagcgagactctgtctcaaaaaaaaaaaaaaaattacttatttctttagagacaggatctccccatttcccaggatagagtgcaatgatacaatcatagctcactgctgtctcaaattcttgggctcaagagatccttttgcctcagtctcccaatgtgctgggattatatgcatgtaggagccgaacgcgaagcgaagttccgttaagaaccgctaaatagggtaggtggtgtgatgctgataggtagcgtannnnnnnnnnnnnnnnnnnnccagcctgggcaacagagcgagactctgtctcaaaaaaaaaaaaaaaattacttatttctttagagacaggatctccccatttcccaggatagagtgcaatgatacaatcatagctcactgctgtctcaaattcttgggctcaagagatccttttgcctcagtctcccaatgtgctgggattatatgcatgaggcaccacatctaaccgtgtgtgtgtgtgtgtgtgtgtgtgtgtgtgtgtgtgtgtgtgtgtgtgtgtttttgagatgaagtcttactctgtagcccagactggagtgcagtggcgcaatcttggctcactgcgacctccccctcctgggttcaagcaattctgcctcagcctcctatgtagctgagattacaggtgcccaccaccacacctggctaatttttgtatttttagtagagacgggatttcaccatgttggccaggctggtctctaactcctgacctcaggtgatctgcccacctcgacctcccaaagtgctgggattacaggcgtgagcctacgcacccagcccccttttgtgttttttattgagcattttatatgatttcattttctcttctttcttagcatattgattatacttctttttctcatggttgtcctaaagtttgcaatatacattcttttttttgagatggagtcttgttctgtcacccaggctggaatgcagtggcatgatctctcctcactgcagcctccacctcccgagttcaacagatcctcctgcctcaacctccatagtagctgggattacaggcatgcgtgctaccatgcctggctaatggtctgcatttttagtagagatagggttttgccatgttggccaggctggtctcaaactcctgaccttaagtaatccacctgccttggcctcccaaagtgctaggattacaggcatgagccactatgcccagcctacatttataaataatccaaccctactttcaaataatactgtgccacttcatgtgtagtgcaagtaccttataataaaatatttctcattttttcctccagtccttagtatcactgttgtcattcatttcacttatatgtaagctataatcataaaatacattgttattatcattatttttttgagacagagtctcgctctgttgcccaggctggagtgcagtggcacgatcttggctcactgcaacctctgcctcccgggtccaagcgattctcctatcagcctcctgagtagctgggactataggtgtgtgccaccatgcctggctaattttttgtattttattttatttatttatttttgagacagagtcttgctctgtcacccaggctggagtgcagtggcactatcttggctcatccgcctcctgggtttaagcgattcttctgcctcagcctcctaagtagctgggactacaggcgcgagccaccacgctcagctaatttttgtatatttagtagagacggggtgtcaccatattggccaggctggtctccaactcctagaccttgtgatctgcccgcctcggcctcccaaagtgctgggattacaggcgtgagccaacgtgcccagccttgtattttattttttgagatggagtcttgctctgtcacccaggctggagtgccatggcatgatcttggctcactgcagcctctgcctcccgggttccagacattgtcctgcctcagcttccttcctgggtaactgggattacaggtgcacaccaccacgtccggctaatttttgtatttttagtagagacggggtttcaccgtgttggccaggctggtctcaaactcctgacctcaggtgatctgccggccttagccttccaaagtgctgggattacaggcatgagccactgtgcccggccaatacattgttattattttgaacaagctgttatctgtgaggttaattaagaataagaaaactaaggctgggtgcagtggctcacacttggaatctcagtactttgggaggcttgggtgggaggtgcttgagcccaggaatttgaggctctagtgaaatataatcccaacactcttctgtaacctgggcaataaagcaagaccctgtcttttaaaaaaataaaatatttattttacttttacttatttcttcttaaatgctattcctttcttcatgtaggtctgagtttctgacctgtatcattttccacctctctgaagaacttctttcaacatttcttgcagggcaggtgtactggcaacaaattccttaaaaaaacttttatttttctaagagagtaatttctccttcacttttgaaggataatctcacaggctacagaattgtgggcttgagagttttttttttttctctcagcacttcaaatatttcactccactctccttgttctttttcttggtttctgagaagatctgatgtacggtaatcctcccctatcttcaggggatattttccacaacctccgatggatgcctgaaaatgcagatagtattgaacctcattgccattggttagagtatgtttctgttcatgtcttccatccaaaaatttaatgccttttccgtttttttttttttttttttttttttttggcagggtcttactttgtcacccaggctggagtgcagtggtgttatcatagctcactgcagcctcgagctcctgggcttaagcgatcctttcacctcaacctcctgagtagctgggaccacaggtgcataccaccacacttggctaatttaaaaaaatttttttagagatgggtgctccatatcttgcccagctggttgcaaacttctggcctcaagcacttaggcaatccccttgtcttggcctcccaaaattctgggatgacaggcatgagccaccttgcctggcccttttacaccttaactaagcacttatgcacttgtggttgcaactttagcagtttgaggtgcaacagcgaaactagctgagttgctttttttcttcttcatatgaatagaagactcattctgctgtaatcttagcaacctcagcatatgagagagtttttccttattgagtggagaagaaatttcacattttcccattaaggaagcactttgtagcttctttttggcatatctgaattgtcagcatcactattcttgtgctttggggccatgattaagtaaaataagggtcagttgaacacaagcactacgatactgcatcaggtgatctgacagctcctaagtgactaacaggtgggtagcattcgcagcatagatatgccaggacaattcacattcggggtggggtggagcaggatggtgcgagacgtcacactactcagaatggtgtacagtttaaacatgaattatttctggaattttctatttaatacttttaaatattgaacaaaggtaactgaagtggtgaaaaactacagaggagaggactactgtaattcccagccttgttcctttataggtaaggtttttttcctttgacttcttttttctttgtatttgattttctgaaattggaatataatatacctaattgtaggggtttttgtgaggggcgagagggcacttaccttgcttggtgttctctgtgtttcctccatctgtggtttggtttatgacattaatttggggaaattctccgtcattatttcctcaaagactgcttctgttcttccttcttttttagtatttctgttatgcgtatattacatcatttgtagttgtcctacagttcttggataatctgttccttttttttccctcaatattttatctgtttttcagttttggacgtttctattgagatatctacacagaatacttatgagcccattgaaggcattctttattttcattacaggaattcttttgagatggagtctcgctctgtcacccaggctggagtgcagtggcgcgatctcagcttactgcaagctccacctcccgggttcacgccattctcctgcctcagcctcccgagtagctgggactacaggcagtcgctaccacgcccggctaattttttgtatttttagtagagacgggtttcactgtgttagccaggatggtcttgatctcctgaccttgtgatctgccagcctccacctcccaaagtgctgggattacaggcgtgagccactgcacctggcccattacaggaatttttatttctagtatttccttttgattctttcttaaaattttcatttatctccttacattatccatctcatcttgcatcttgtatactttttcccagtaaaactgttagcatattaatcatagtttcttaagttcctggactgataattccaacattcctaccgtatctgtctcagattctgatgcttgttcagtctgttcaaacttttttttttttgccatttagtatacctcataattttacattgaagggtggacatgatgtactgagtaaaaggaactgccttttgtaatgtagtggtaaggtgttgagggaagagaagcattttgtaatcttaaaatcatggtaagcctgtgcttctggactaagaacttaattagttcttaattttttttccaccttatgtgggataggatggctagaaggggctggagtttagtttgttcaacttttcacttgtttttaggacagagtagtgacttctaagatccttgtaagtcagactggaaactgcaagtctccctgtcataattttccataatttccttcttcctgtattgatcttaaataacattggtgatagaaggtattaggctgttttcccaagaaaagagtgaatacatctaaaaaatttccttggagtatattagttgctggtttatcaaaggaatcctttattacatcaagaatgaaaccttggtggctcatgtctgtaatcctagcactttgggaggccgaggtgggcagattgcctgagctcaggagtttgagaccatcctgggcaacacagtgaaaccccatctctactaagatacataagtaaataaataaataaaataaaccattagccaggcgtggcagcgtgtgcctgtagtcccagctactcgggaggctgaggcaggagaattgctcaaacctgggaggcggcggttgcagtgagccaagatcgtgccactggaccccagcctgggtgacagagcgagactccgtttcttaaaaaaaaaaaaaagaaaaaagaaaccttctatctataggcttttaataagtactgagtttcctcaaatccatttggcatctactaaaaagagtatggaggtatagtaggagatgggaagaggtgaggtgattgaggaagggaagtgtgtgaagggctatgtaattagcattctatttttatatctcgaacattgttttgattgtgttttttactctcattgttgtgagaaatatggcaaatacactaaatctgtgcaattaaccccattttttcttctttttaattgacacaatgactgtacgtttatgaagtacaatgtgatgtttcaatacatgtatacattgtataatgatcatataaaattaattagcaaatccattatctcaaatgtgtatcatttcaaatgtgtatcatttctatgtgataagagcattcaaaacttctctcttctattttgaaagatacattattattagctataatcaccttaccatgcaagagaacacctgagcttattcttcatatctaacaataacatcttacctgtccaacaccccctttgttttaagacagggtgacattctgttgcctgaattcctgggttcaagcagtccttccaggtcactctgtcaagtagctagaagtacagatgcacagtaccgtgcctaagttttaatttttttttttttttttgggtaaagacaggggtctcactttgtcactatgttgtttaggctggtctcaaactctaggactcaagtgatcctccagcctcagcctcccaaagttggattacaggcatgagccaccacacccggccccaacagctttctatttttttttaatgtccaggttcacttggtatatttcagttcccagtaagtttccttgaagcatttctagatgaagcctttatttattggagtggatttttaaatcttatctctggtcttttatacaatttttaccctaagtataatgaacttgctcttgtgtcttatatcaatattttcttctgtgttctctttccctatttatattctcagttcctgaaaagaattactcagttcacatctacagagttcttatttaggtactcagtagatacagaattggtttaaagaagaggcaagaaaggaatttaatgttttatctgcattgacacaattattttaaaagctgtttcactgcctccccatcttgatctttcatgtattttgtatacctaccatataggtacagatcttgatccattattgagatatgaattaaatatttcatcaaagaaacagtctatttacctttccttaaaagcttactgtgagagcaataacagataacatttttcccaaagtgccaacgtatgtttgactgaaatgacaaatgcgtttttagatgttattgggaattttaagcttatgtaaaagttataagaatagtacaaagaatgttcacattcacctttgcttgtacacatttgccttatcatttggcatatgatttttcttctgaaacatttgagaataagttctatatattatggccttttacctctatacacttaagtgtagatttcctaataagaatttcctaaagatacaatttttttttttttttgagacagactctcgctctgtcacccaggttggagtgcagtggcgcaatctcggttcaccgcaacctctgcctcccaggttcaaatgattctcctgcctcagcctcctgagtacctgggactacaggtgcatgccaccacgcctggctaattttttgtattcttagtagagacggggtttcactgtgttagccaggctggtctcgatctcctgacctcatgatctgcccgccttggcctcccaaagtgctgagattacaggcgtgagccactgcgcccggccaagagtatgaatgtatttttaaggagacacttcatattatttcaaaattctgttccaatttaaaaatgatgaagtccctcgttaaaattcagcatggagaaaattagggcttatatttgtcaaacacatttgatattaagacactttatttttctgtccaactttcattttaggttaaaggttactcatgttacatgagcaaattgtgtgtcatgggggtttggtgtgcagataattttgtcacccaggtaatcagcataatgcccaatagtcaggtttttaatccttaccctcctcccacattccaccctcaaataggtcccagaaaagacataattataccaaatatgagcttcatactagttcagaaggtagagttggaggatcataggcaagttttcagagaaaccgctttttttttcatttagattattataagatgttccagaggcactaagtgaacagaatctaatgtctttgtgcaatctgacgaacacttagtgtttagtagcagcattatgaaattgccatttttagataattctggcagtaaataccgtttaaatggtggtgaagaagactagcaacctatccttcacaaatatttcctgatagctctattttccctgctctttcaattacttacgtttacactttctctttatttacctatatgtctatctctgtttgatcttttctgaagttctgggcatactactcagatttcagtcacagctgtgaaagctgctattgataagattttttgaaacttcattctgttgctaaagaagggagaaatggccttattttattcaatacaggaaaaagaaacattcactttttttttggtatctttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacataacaaagtgtttttaggtgttttatgattttaactttcagacagagtttggatttaaggtaatgctgacagttatccttgaatctgactatagacatttgttattcagtgtgaaacaaatataagatacatcacagaaaattaccaaggtattcttcctgttttgttccatgtacggtgaaaaccgttcttttgtaagcaggtatttaaaactgttctggcattaccacctgcccagctgacaaaggtcacaccatcagggttagtttgccttaatcaggaaggtaagcaattttattttgtagaaagagaggtagagaatatgaataggaatgaatttagtgagcattaatgtaatggctgcattgagggcacatttgtaggaggtgttattagataaatataagtaattttgtaagaggtgaaatttataaaagttttagcccaaaaacaccttatttacatgtactagagttctaaatacattatcagaagtgtatttcctcaaacctgccattggcatgccatattggtacatacatttagaagcttctcaagtttccataagagttgtttcagagaggctgatttatcttacaatagtgtacagtctgactcgaatacaagcagcatgccttactacgtatgggtatctaatatctgatttgattttctcaagcagcatgccttattacatatgggtatttaatatctgatttggtgtcctcaagcagcatgccttattacatatgggtatctagtatctgatttggttttctcaggcaggaatggtttgtatcagggtaaaaatcaagttaccctgtcagcaaaattaggatatgaaaaattcattatttatttatttaagagtatactcaatttctcccattatctgctccacatccactttccttcctactgtttactctgtggggatgcacctcatgaactatatcagaggtcatcaagctacagcccatgggccaggtattcatttacatagtctatggctccttacctctataactgaagagtttaatatacagccataaaggttaaacatttactatctagccctttacagaaaaacttggccaacccctgactacatcaaatctttgccctctagtttttgttgagtgcagccaacattgagaacgtttactttggagcaatctccaattaaccaaagtgatacaaacacagtgatttgggaatgccttcaattacaatgcaatacttaaattttaatactcttgtaggagaaaaagcaactgtataaatgaatgtagagtgaatttctgcaatatttcaaacctatatcagagaattacactgtgggaaaactaccattgtaataagtgtagcaaaatcttcttagatatctgaaaagtcatactggatggaatccagtgtccaatcttttggcatccctgggccacattggaagaattgtcttgggccacatataaaatacgtgaacactaatgatagctatcagttattgtggctcaagaaaattcttcttctggtgtagcccagggaagccaaaagattggacacctctgctttagagggagatgtaactatcaatgaattattatgttcattttttcccttagccagagaaaggccaaaagacattcccgtcagggtattaagaaatacattggtgaggagtttaccaccatccttggacaactctgtggtacccaccctctctagactgtagatgatgcagaacttctataatgaaagtaagatcccaatttcagtagagatcataggatcttggcatgggaggggttgggtaaaatctgcacaagagtccaagggatgcactgttaatgagaattttaaccatataggtggcaa

SEQ ID NO: 13453 - DNA, 119801 bp, Human
aacttcttcttctaactccttcactcacttctgaattgacatatttgcattttaaatttaaatttaaatttaaatttttgcagttgatgcagccattcatcctacaaatacagtcctcccttagtattggcagggtattggtttcagcatccccatggataccaaaatctgaggatgctcaagtccctcacagtcagcctgggtatctgcgggttctgaagcctgtggatataaagggccaaatgcatatatgtatgtatatattttgagacagtcttgttttgtcacccaggccggagtgcaatggtgaaaatgcacctcactgcaacctcgacctcccaggctcaagggagtctcccgcctcagcttcccaagtagctgggactacaggcgtgtaccaccatgcccggctgatttttgtatttttagtaaggacggggttttgccacgttggccaggctggtctccaactcctgggctcaagcgatctgcccgcctcagcctctcaaagtgctgggattacaggtgtgagccaccgccaccgtggccagcctcaaatccataaattaagctctactatgtgctgggtgctggggtggaagactggcacatctgttgttcacaagacagtgcataacctaggagaggtttatttgctactgttcttcggaaccgggatcccatagaggagcctgccagaacgcgaggcctgctccttcccgggcattagcgcgtttagactctcctcttactaagcccagggaaaggagtcctggcaggtggcaagcagaagttagagctatttagtcactcccgccctccatcctcctccaatgacaataaggttttgtttgtcaggcataaggttaccggattggcctgtgaagtccagaagctctttccgcgctcggctctttgagcctcagtttccccatctgtcaggcgtgtgtatgtgggaggggggtacggagtagatttacctagatcactcggggttgtcccttccagttttgagggtgatgtcggggtgtctgtgaggaggagggaggaccctgccacgcgaaggtagttttggtcgcagcagccagccaagtgtgcccgcggagaccggcagggaattccgggaggccccgctgtggagcggtccccagagcccgagggcgagctagaagagttcctgcggcgaggcgggaacgctcggtagcctctgagagcagttcgctggcgagaaaccgggttcctgcagggcagggatcagccgggtcgcgccttgtagggtggggtggggtggggcggggccggggggggcggcggtggagtcgtgaaattcccaagaaattcctttccattgccccactccgccccctttcctagggtgccgacctgcccagacccaggttccctgggaaagagaaaatgaatgttcttcgggtttcctcgcgtcctttctccagccccctcccaccccggggtttggagcgcgcgtgggagcgcaataacggtggcggggaacgggtccaatcccggcggctcctggggttcccaagcgcgctgccactcagtccccgagctcggggaggcgtctcccggcttcggtcccgttcagcttaagctggcgtcacatgagccgcgggggaacgggcaccgcgggagtgggcgggggtgtgcgcgccgggagggggccgcccagtccacctatatgcgccgcagcccggctgacggatgccaggaattcccaatgagaggcgatggggggaagtttgggcaactcggcctggccaatggagagcctcgggagggctctgccccttccccccgcccccgcccgcctcggctcccgcagcgatagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaaggttagcagccgcccccgcccgctgcagcccccagcccccagcccccagccccgacccgctctgcctgccgggctctcggctccgggctctgaaccggttccgggcgcgcacgggagggggcgggggcggtgcggccgttgcgaggtggggtgttgggttacaggcgcctggcggaagcgggagcgcccctgccccggttagcccgggaacgccgggccggagcgcggggaggtggcgccgctggcgggcaggtctccttgggggtccgtggtccaggccaccctgcggctgttgcaaccatccccgcgtgggctgtgctcgggggcggtggtcttcaggctggggctgagaccccggctcggggctgcttgctccggatcgattttcccttttcttccgcccctggccacctctccatatggcgtgcggtggcagcgccgcttcctgggccgccctgggttcaacctgagcggcgggcctcccgggaccctgctgccccttaggcggaggggagagcgccggagagatcggcggccgcctccggatctgcctggagaaggaccagctggagtgcggctggggacgagaaaactggggggcgtacgcgggctcccccgcgggccctgtgggggcggggtcaggacagcagaccgttttattgcttaactcagtgggttggaagctgtaaccccgacatgggcttgcgctacgtcctgcccctccgacccccgggaaaggtgggcagctcggttcgagttgaggggctgcagaacgagggtcagtcttaggggatatttggggccagtcactggggatccctacttagccacggagctgcatcccaggcaggcgcggtgtgccgggtgcgcgccccgccacgggagctgggctcggagctggcgatgggacccgggcacagtggccagtggcaggaagaggtcagaaaccactcgtggtggtggggggagggcgcctcaaccctaccgctgcttcctgcctgcgcggtgagcctgtgcccccaggcggccacgtaccctgaatacccctttccctccccctcctcccggctgcccacttccatccggtccctccccgtttcataccctccccacccccaggctgatctgggaatggggttttgggtgggggggggacaggatggcgcgtccctttggatagtgcggttagggctgggcttgagggagaacgctcatgtccaaaaatggtaacattcattcccttttttaaacttaaaaggggggtagtttatagagccgactgaagttttttttttcagccaaaggcatcctgtattagctcactcaggaatcctaggccctgaaacggagcccttttactcacttcatcagacaggcagaggtaatctaaaacacacacaatgggcttcctcaaagcaggatgacctgggccgcggtgcccaaggcctatgcagggctgggccctatacagcgacatcggtcatctacatcggacatgggaaggtcccctgacttcgaactgacttctttgtaatgtgccagttgcttaaactccccctcttcctgtcatcttcctagtaagagctgaagactgggggctgcagacagtcccccactcacttggcttatttcctgggaccatgggtgctgtgggtggaactgaaaagtgagtgagtaatttggagatccctatggggcaccaggcagaaggctctttaataatttcagggtgaagccttcttgagaatggattttaaattagaagtgagattagggtggtggattggggtcttccctgggggttagaatcgaaggagaaatccctgcttagggagcacctgctttgtgcctgggaggggcaggagtaacagagctgcctaggaactaggcccctgaaaggactgtgagaccaagttcctaggggacagacactgagcaccggcctgaacatcgtatttaatatttctgaatgaatgaatatattaaacgcagtggggagaagaatatagattcccagggctctgacctgggtggcagtgggtgtgccccaggcctttgggcagccaggtaggaagaggtggtctgggaaactgggttatcctggaggcaaactcaacagtgccaagaactggcatttgctgatatgtgccaggcacgaacaaggactaggaaaccagggccagagaggggaagtaaccagctccaagtccagactgtgtttggtggggctgggatgcagccatgtttgggactggcagcttcccctcacttgtccctccttggcaagggaggcaggaaagctgggcctcgcagccagagccagagcatctgggaaccaggagagccgacacgtgctttgggcggggttgatggaggggccatggcagaaggagctctgggcctgactctgaagattcagatccacattttttgtttgtttgtttcctgttaattctctagattatctttcgtgggcctcagtctgcagaatttctggcctgcctagttctcagtagggtgatattaaggaggtggtattacaggtgagggataagacgtaaggtaaacgtgttgcttttgacactctttctactgactgggaggcggggtttgtgtgggaccagagtccacaagtggacagaggctgatggttccagagggaggcaggggagtgagtgtgaggaggggaagaggaggacacagtgtagagggatacaaaggtcacccggtagaaggcagaagaccctctttttagctttggtgcagccatagctatttctgagactttgggcaagtctttccatttcatcgagcttttattagatcattcagcaaatactttgtgagcactcattctgggtcagacacagttccaggtattagggatggggcactgagcaagacagaccaagttcccgttcttgtggcatttccattaggtttcctcctctgtaaatgggacacatttctgcccgtggagccctcaggactcttctggggaatcaggttaaatgatgcattgagaagtgcttccttggtgaaagtatggcctgatgtggaggcagggagaagtctgtgcaggcaggaggcatgactcaagaagctgcactggcttggccgaggcttgtccctctttcaaagaatgcttcggtacggagttcatgggctggtcgccatgcctccagacacaaaatgcagttatcttccagacagagcacgtggattagaggcatttcctctacttttccaggtttcataaccttcctgatctttgaggctgggctctgaagtcacttttcctaggagttgctgttattttcagggtgactgcagcccccagttttctcccttatgtaatttcgctcacattcttaggtgtatgtgtgtacccagtcaagctggaggtaggtcaagctggagagagcatcagcttggtgtaggatcctggctctattattttcaggcttgtgaccttgggcaagttcctctctgagtctccaattccctacttataaaaaagagctaatacctaccttgctggcttgatgcgagcagatatgtaaaatggcagcttctgctgttaaattttattttctctcttccttctgaagtcctagagattatggtttaatgtgtgtttccacaggtgccagcctgtggccttttacatgtaggaacttaatcaatacttgttgagcgaatggatgttgaaacagagaggcagcgttggcaagtgcatagaggtggttgtgaataaggcccacatcccgattctgcagacaggtgaggctaggtcacaggaagaggggacacattgtttgcacttccttctggacagcaaggccattgcaggagctatagccaaggccaccagtcaaggtggaggactacagagagaggaaaatctgcaggctgtgtcggacttggacaccccttttcatcttctcgaggaaggcatggggctgggcacctggctgggggccataaaccatcagtctggctcaaagacttgtcacacaagacctgggggcctggagccagggtggggcagctggagcctgagatgtggcctagtcacagatgtgctatgtcgggtctctaggaaagagcccagcccttaacagggtgagaatgtagacagttccttctcatgaaggcaatcagtagatgttcattaaacccctgttaggtatcagatgctctgcttgctgtgtagagtgtggaaatgaaggtttaggtagagagggaaccagaaagatgcagagttgcaacaggctctgccaataatggccattggcaggagctggtggaattggaggtgcatctcaaaggaaggcggttctgctgggagccttacctttccctggcatttcagccacgtgtgtgtgtgtgtgtgtgtgtgatgttgtaggacagaggtggggagaggggagatgcctgaaagggcagagcagagcaacagtgactatccatgctggggagcaccccctcccattctcccttatcattcttctattatagtttaaaatttttaaatttatgttttatagagatgggggttttgctatgttgcccaggctcttggcctcaagtgatcctcctgccccagcctcccaaagtgctgggattacaggcatgagccactatgcctagcttcattgttcttttccatttgttttgcccctcccagagctgacctctcacctttctgcgagagacggccaggccatctggacaggtcacagaccagattctcaagtccacacctctctacagatattgttgggatcatcccagccagttaaccccacctgagctgcctccatgtgtaacccacctgtggttttcctggacttggtatggagccaaagggtaccttccccactggccctgcttttatgccctctttagagtgcatagagagatgttggtaggcccatgtctctgctagaggggcctgtgggttgggctgagttactcgccatggacagtggtggggtcctggaacccaccagctgagatggtttgggcggttctagtctgcacctccccagagaggtcatggcagagaggccaggcacagaggaaacccgctgagcctgcttccttagttctggcagatgggtcagcccccacaggactcaggattcaatttagcccggggttctggctccatctcccacagtgccggtgccagtggcctcctaagtactgtttggccaaacctggctctgactgagacaaggagccttaggagtagtagggacaggagacacagcaaactagggctcagagccaccctggaaccccttcttcctccctcttcatgcatgaccaaggtttctgtatttgtccattctcatgcttctaataaagacatacccaagactgggtaatttataaagcaaagaagtttaattgactcacagttcagcatggaggcctcaggaaacttaaaatcatggcggaaggggaagcaaacatgtccttcttcacatggctgcaggatggagaagtgcagagcgaaggtggggaaaagccccatataaaaccattgtatcttgtgagaactcactctcacgagaacagcatgtgggtaaccacccccatgattcaattacctcccaccgggtccctcccacgacatgtggggattatgggaactacaattcaagatgacgtttgggtggggacacagccaaaccctatcagtttcccacctatccccaggctgggcatcaagtccaggctcccaggaatccttctcttctcagcagatggggggaaacgcatggagagggttgcccaggctcccccttctctgcctctcctgctttccctcctttcatgtcgtaccagggggttatctggcgggcaagtctggttatctgggcatggtgagtctggtctagtgatgggcaggccccaaagctgtgtgtggcaacgttcatgaccccaactggccccttccgcatgcaccattctgccataaagttaacaagattccttttctcataataattatagtggctcgccctttttgagcacatggtaattatcagcaattgtcctaaggactctacatgcatgagcacatctaaccctgtgagatgggtcctcctgttatcccattttgcagatgagagagctggctcggagcagctgcggaactcctccaggcccacgcagccagcaaatggtggagctgggatctgaagccaggcagtcgggctccagcatttgcactccttctcaactttgctctgccgcttatacaacaaatgcttgcgtgggtagaacatttaacccaagacaaacatatacaaacaaaaccccggtgatggaaatgttctggaattggatagtagtggtggtttcacaacctcacaaatatacgtgaaaccactagattgtacattttaaaatggtgactttatggcatggaattttatctcaatttttaaaaacctaagaaattattaactaatataaagaagaaaatgacaattgcctgtcatcccacctcccagaggtaaacaagcattcacaggatttctgatggcttctgccatccttgtccctcttcccctgtttgtgtgtccccttctctgtcatgcccactttttagagctggggtccaggtttatgatgagtgagaggagtttagaagaggaagataagggcgggagcttttgtagaaagcgggatgaaggatgtggctctttccttggaaactgaccaggaatagatcatagatatgcacaggcaaacagaagactgggtgggttggggagagggtggccttcattttccaagtctcagtccttggggaaaatttctccctaacctctgtctataaaccctcttggcctgggattgcttctctccgtgtgctctccccagggttggcagggtgggagtccaagtgaggcagctttccttagggttgtaggcaggggaaggggagggcagggccagggtgccccccaaaggaggcagctgtaccactcttggaggttgcctagcaatcgtggggaaaggtgacctagcccactacagaagcgggaggagaataaaaggcagccaaagatggaaatcgggcgtacattgcagaggaggctgttcccctggaaactgcctccttggtccttggctacagcaggctacttctggggtggggatctgttctccattaagagggagtggggtcttccctaggcctgccacccacaggtcagggctgggggacctagggaaacccttcttgcacatggagtgtatgtcagatgcgtttgtcagtggcttcatttaacgttgacaacagccttgtaagatatgtgggatgatgacacttcatagatgaagatcctgagtttagagatagagaacaacatgttcacagccgcacagcgagagaggcctggaaatgaaggtgctggcacccttgactcttaaagggagccattcattttgcttcaaagcatttcacaagcccaaggtactcggaggtaaatgtaaacactgtccacctcctgggaagggaacagaagatgagagagggaaggctggaaaggtgtgttacctgttttatatcaaccatccaaccaaccaaccaaccagtacttattaactatgtcttggttttccaagtaagtacaaagacgaatagttcacactgattaaatgctgaatggtttggagtacctccacatgtcaaacaactctttggggaagggactgttagttttcttggtacagacagggaaatggaagcccagagaggttaagaaacttgaccaagattaggcagattgacctcagaactcggcttttaaccagaagtacagacacactctttgctattaaggagtttatgtttgaattgggaggcaaggcttatatggaattgaaataagagaacaactcattgtggcgcatttttaacatttgtgcttccatgtgtggctttctcttcagtaatcatggtgagcaaacttgtgaggtcttatccccattttacatgcagggaaagtaaggctcagaaaggttaagcgactttaccaggctttccgtagcctggaagtagagttggttttcaatccaggtctttgacgggagggtctgtgaggtttaaggggatggacataggcctcagtgaaggtacttttcttggttttaaaggtagtgaaggatgcaagttgtatttctctgtgtttttcagttgaagcagtaactgtcaggaatagactcaaatcccctgaacctggaggcctccccagtcccacgttcctggtggcctcttctggtgctgaccccagcttttgggagctagcttcccctgctttaagattcagcagcaccctccccttctctcttgttttggttccttcagtttcacctgttctgtctgtccttccctttgtttagagagtctcttcctttgtggtcaccacgggaaccaaacaggctttgaaccaggcagccgaggctcaggtttattttgattttaaaagcctgtgcacgtgaaacccgtaacgtttgaggttcttgtttaagccttgagacgatttagaaagttgatgagggagtgggggacttaggttggcttttggtgttacagggctggggagtttttgtgccaggtcagagatcagcaccaagtggggggcagtgccatttcctgacccccagctttgaaccttccaggcctaaatcagaggccccaaatgttcagctccaggccaaagagcagtcggctgggggaagggagcctcctctctgttaccttgtttttcctgtttcttggtggtgggtgatcgtggggctgttgaaagcatggtcacaaggcctgtgatttgaggccaggccagggcttgtaggggagcatttttatgggcctgaagatttattttttaaaagccatctgcaaagctgattataattgatgggagtgagacagcatctgagctctattttcaaatcatctgtaggtgaaatgacgggaggggaggcaacttcaaggtgggtgggctccttcaggccggtcccctaatggaacttggctttccaggctggaagaggcaccaagccttgcatgtgggtgggaggggttcttaaaatcagactctatcttttctccttatgtctgatgtggagatgtccaacgcataacagcctgtagtttggggatagagaagtggagcttttaattcttctgagtcaagtctcgacacccccaatatggggtcttggtccaggaaaaagagggcagcctccaccgaggtcctctgtcttaacacttgtgtctgtcgggtctgtgagcaggggtgcctgtctgtcagcgtttggctgcatgtgtctctctggctccaagaagcccctctgttgtttttggccacctccttgaccttggcagaggagtggctcccttttaaactccgcagacatcctccagataatagataatggcgctttccagtcgagttcccgatattttgtaagggcctttctttccaggaacccaaagtgcttttccagacttggccctgggagctgggagatgcaggaggtggcttatgaattgtgttttcctggaggcagggaaatggggccagacccctggtttcctgtccttcatctcggatactggtggctggggctgcatggaggtgtttttgcatgcatgaagtcctgaggcctcttattagaaatctgcatattttcccaactttagctccaaatgaagttttgctttgtagctttctttttctcttcttctttttcctctttctctcttttcttatatttagaggttcattgtgtatagtttctttaaggaatgccacattggggtctcagttatatagtgggcccgtgtgccaccccctcactgagtctgcttggcatgggcaaggaggccacagtagcacccaaaggtgcctggctggggggcctgtacctgatgccttttccccagaagccactggttcggaagcaagctcagcataggcccacattgctggccctgggactgttctgggaatatggagctgagcatccctgcgtcccgctgccctgcccccagcagcagccagccctggtactgtgctttgggccaggcacatgtctaagtgctttgcagctattaatgtaatcctcacaatacccatatggatggcttagtaggaggtaaaggccatttgagggtatttggaaagacctgaaaggttcaggtggttacagcaagtatttctagattttctgaccttgaagccagttcacaaagaccatgttggcttcagatttttattttcaggaaagagtaccttgtagagttgcgaccgcagtgttctccctgatcccgtaaccttccctcaccggagttaaccgctgttccaagtttggtgtttttgttcctatacatttcttgcctatatagctgtctgtatctttgtgcctgttttaaaactttgtgtagatggggtcatacccaatgcatcactctgttcattgctccttttgctcccacatctcctttgccctggagctgtaaaggtagacctgtgggagctctgccatccctgttttgtggctgagactgctgagttccaaagcacttgcccaggtcacacagcaacttgtaggtggcaggtgggactgaacccggcttcctgcctctgcggtggcgttcgtatgttacacctgccaccctgcaccccgccagtgttcaaagacttgctgatgtttgatgagggagggcaggagacgtcagtctcagtatcttactctctttccacccacacgtgtgtgtggcatctggtgtccgtacctatgggtccctggtcccttgcctgctgccctcttttcctgggcttgagattcaggttcctagggacctatgccacgttgccatttttttcacctcccagggtagtagttgtgcttttattacttcttgataaagcaaatgtgtcatgacgaaaaggtgcgtgaatttgggaatgcttctaaatgagtttatattttatggctcagcagcctcttgtgccatttggaagctggctgtgctctgcaagacaagagactgctctggatatgaggcttgggctgcatgtagagttttggaagaggccagatgtggggagccacgatgagccccactccgccaggaccattcctaggcttcaaggacaacaagtggggtcccagttgagtggcctttgtccctgtctgatttccctcctcttgccttcttatcttctggctctcagccactcggccattgccttgcccagttagtacctgggctaggagagtcagaaaggacagatatgtggcagcctgcctgccttcattacactttcttggggcactgttgtgaaactcctctctaaagacatttagaggattctcaggggatgtcactgatctgtaactgatctgaggctccttggatgatcaaaggtggatttgtggagtctcctggggtccccctagtaatggactttcaggagctccctgatgagctcatcccagcaccccaaagagcaggtaagcacgaatcaagcttgcacatactaggtattcactgagtatccagtgttgatgaacagtggtggtgagggcctttggacaggagtgtggcagctgtagtcctgcaggagacaactgacagatgctgagggcctgggtggtggtagtctgagtcaccaaggaccaccccagagatgaggttgattgctgggaccagggcagaggcccagttggctcctcaggactaagaggtgtgtcctggaatcagaaggaggacaggggccagggaagctggccttgtcattgggatggggtcatagcctaggatgacctcagcccctgccatgctgctcagcgcccctctctgagctggtgcgtccaatggtaggctggttggaactggcacagacctcccagctccctaccagccagcctagctgcgttttttctttggctaacagcccatcagattccaaggtgctggccatactgacatgtccctcttcatcctgccccttcctctctggagggtggggttattgcatttggctgagccctgcttcagaaaatcacagggaatttctggtccttttgtgtgggtttgtggaccttaaaggaagtaaaacctgggtcttggttttccttctccttccagtccctctgctgagggttctctctggagtgttggacgtcagcagcccactgtctttagccacagtatcccgaggggtgtggatctagataactgtggggcctcagcaaagctttcacctgcctcctgctccctttctgttgggactttgggagtggcatttgggagtggggataggtgtgaaaagactgtcttctttgatttattaggccagagagttgtttggcagaaacctatcttgtcccccaggaacaggaagaatggttgtgtgttaggtaccggggcctcaggagacccgaggtcttgtcctagtgctgcctgtggccactttgtgatgctggataagtcacacctgaaaccacctataaaccgagaaattggatggtaggatggtggtggggctctgttctaaaggctgtacttggattatcacatgcagatgatctctggggtctgcggtgatgccaacattctgtgtttctgccctcttggacactcagcagagttaagcacttctttttttaaaaacaaaattagttacttttttattttttgagacagggtctcgctctgtcacccaggctggagtgcagtggcatgatctcagcttactgcagcttctacctcctgggctcaattgagtctcccacctcagtttcccaagtaggtgggcccacaggagtgtgtcgtcatgcccagataattttattttttttgtagggacagggtcttgctgtgttacccaggctggtctcaaactcctgggcttaaacgatctcctgcctcggcctcccaaagtgctgggattacaggcatgaaccaccatactcatccgagtcaggcacttctaaaggtgaccttgcagttgactcctgggctttgtagcctggccctgaagttaactattcggcgaacacagcttctttaggagccctctgtgtcttcagctttgaggagtttgttctcaccctctagggaggatgcaagtggggccaggtgaatgtgcttcctttatagacagacccagaagccagtgctcttgtgtgtcctgggctctgcattcactctggctctggaaatacctgcttagggtgtggtcctgagtgggaggccaggtgcctggggaggggagaatcagggaggcactctcccttgtttggtgttggtgaagggtaacttagctctgccttctagtctgggtgctccaggtgtgtctgggggtggggatgctggaggtggctcaggagaattgcaaggtggactgatcataattggtcctttgtgtagacttggctgacccacaggcctggtgtgaggaggctgcttgcctgtgggctcagtgggtctgaaacactggctggagccagggagcaaggctttcagcctggaatctgcccaagggactggtgtcaataggtggccttgtctttcacttgtttatttgcagagcccagctctggcccttctctcctttgcagcagtttgaagaaatcaatagaatgcccaagccagaagggacctgcactgtcacctacccctcttctccctcagataaagggatgaggtccatagtggtgatctgatttgtccaaggacagtctgccatgagttcattccttgtggggctagatttggtaaggattctttattctgggtacacgtaagccatcttctgaagttatccttgcaggtgggctccagaacacctgcagatagatgcacatggggcgggcctctgtattctgaaggcagatgaagctgctggggttctggctagtgtgtgggtggtcaatttcagatgaatttcacacatgcaggcagctgcaccctgccaagttggaggtagtgatccacatgcgggcccttacactctgatgttcctgggactggctcttgcgtttgcagttgaggagggaatggagagatgagcctgcaggagagaggcagcctggtggcggcggtgatcttggtgttaacagccagcacttattaccgcatgtccagcactgtgctaagtccattacgtgcattataccaaggaatcatcatagccgccctatgaggaaaaggtactgtgacatttttagtcccactttacagaaggaactgaggcttagagagattaaatattttctcccaactcacagcttttagtggggcagttgggctttgatttcagggctgcctggccagagtccacactgctaacccctgtcctagttgcttcctctctgctagctcattccttctggtagcaagcaccagctgtcagccctgactggagaagggaggcccctcatgagagatggagctgagtctccaccctcccgggccccatacacttctctcctgacccgtacattcctgtgcaccagggaagtggcccctctctggtcgtggagactgaagtccccgtgctgtgttgagcagtggaggtgggggtggctcaggtagaatggagggtacttgactcctgttttttgagggaaagttgcctttaagttggagggatgctgttggcttcctgcagctgcttgctgccttttgatgacgcccctgtgcatgggggccttcaagtgtaggtggaataggcagggttggaaaggctcttttctccccacagtccaggagaggcagtgctggagccccttatttgctgttcatcctttgatgggtcagcataacctttatgttacaaatgccaatagatatttaattcctggggtggcataaggtagcaagcaatttagaatttaataaaattacaaattcttggggagatgattctgatttctctctttatccatgatgcatgctagttgcatgaataaatgaatgaatttttttaaaacttatggaaaattcacacacaggagtagagagaatagtatagtgatttcccatatacccattactcagcttcagcaattagcaacagaattgcctgtaatatttaatcatctgggctattttattggcactgagattagtgtgctagtgtgaactgctaggaacttctcaagtgagaaaggacaagcggagaagaaatgatatcatagtatgaataaaaactcatctttgtggtgctgccatgctaggcaagttgcaggtgctcaccggagggtttgaactaactgctctggataactggccaggtggtgttgggttccagccccaggtgggaggaaagtttctgaagggtgagttcagctggatacgtgagattctcaaacacacactggggcagaaggcactgcagccagccctagttcatctactcaactcatgtttactgtggatcatctttttttaaagttgacatttcaaacataagaaaaagcattgagaatcataaaatgaatatctacctgcttgccacccagacttaacaaacataaagcagacattctttccagatgagggacagatgcatggtctctgtctctaaggaggcctgtgagtgagagacccagggacgggcaatttccttgtcatatacaaagatatcacatctggtatagagaatggagttccaaggaaggctccagcccatcctggaggagacaggtaggacttcctggaggaggtgatcatgtgagctaaaaatcaaatctggaatatgtgagtcaggccaagcgggtgcgggggcagggtcaaggggaggtgggcctgcaaagggtgtaaccaaaggtaagaaaaagggagtgcaaagttctggggagggaggggcaggaggtgagtgaggagtgggctgggtgcagctggagtgaaagatatttgggagtgggcaacagtgaggactggtgaatcagtgagggacaagctctgggcatctttagggcagtagcaggcaccaggcttgtcctgagacctgctcagtgcgtggctgcctgaattagactccacacattgagaggattatagaccaatataatcccatgcaaagaaacccacacagcgggtgcggaagggcagaaactgtatcaggactatttgattgacctgggctgcttagagcaggctccaggctgtcatttgaaagaggggatgtgttgggttgacccaatggggagaagtaggacttggtgagagttgtgtggacatggaatctggctcagaatagaatttctaacagccttccaaagaagggatgcatggttgggcgagagtttcatggtcttaaatgtgttgaagtagtctcaggttggaagcaggcagggctggggtgtggagggaggagggctctgcattgcctggccttcaaggcctctccttactctgagttctgagatttaggctggggagggtgggtaagtgacctgtgggcacaggcaaatggtgctcctgggaaggcggctgtggaggaggtgctggcccgttgccatgggaaccatcactgccgtgggtttccagttccaaggatgccctggaagggaatgagctcactccacctgcgagctggtgagtcagccctgcctctcctgcttgctcgccaaggctaggcgggaatttgagcagtggaccctgcctctaccccctcctcagaccacccaggcgcccgtgccctggatgtgggctcttgtcgtaaaagatgcagggcaataaaggcagctgccagccattctggcatcagtggggatcctgactcggggaagctgctagcctagttggctaaaccttggctgtgttgcagagggtgagccattctctctgccggccactcagctgatgtgggctgcacaccagccacagctgtactgggccagggcttgtggtccagggggtagatgggtgccgagggcaagctttcagggtgtcttgtgaaggagaagtacaggctgggtgggtgtgaatgcctgtcggtcgggcgtgggggtagtttctggaggtggatgaggaatgcttcccgtggggagtggcttctgatctggtgctggagggatgaggagcaactagtttgcccaccaagtcctaggcatctgaggccagccagggtcatggctcctgcctcctccttctgtgcccctccccagatgcccagttgtgagggagtgatcagaacatgtcgggggtattgcaagaatctcaaacagctgtgacttgagtgtacaagccatttttatccaagaccctgtgaaatccatggcaccacccactgggggctggtccctcaggatccacatagggcctatagcccacccccgtgcccccgcgccctgtgccccgtgtggcggcctgtgagatgcatcagaacacccaggggaacactgcgtttctagcctctgcttgccttacttgcttcacccacatgggcctctgtttccatttgagaagatagataagttaggggagaaaaatgaccatcttagaccctttctcctaaacataaccatttatattttcagaaacctatttttatttttaatcttcatgcctgcattattctgatagcggtaatcatagtgtacataaaaattagctctgcttttttatttccccacttggcattttatcaaaaacactttttcttatatagttacacagcctttatgttccttgcctggagaaagtgagatccaagtatagagattgtttcataaatacatgtttatttgtactttcctgcctctttccaaaaagcatttgaggtggatatattaaaagtctcgtgtataacagggttttttgttatttcgttttagagacagggtctcactctgttacccaggctggcgtgcagtggtgctgtcatagctcactgcagcctcaaacttttgggctcaagggatcctcccacctaagcctcctctgagtagctgggactacaggtgcatgccaccatgcctggctaatttttacattcttttgtagggtcttgctatgttgatcaggctggtttcgaactcctggtctcaagaagtcatctgacctcggccttccaaagtgccaggattaccaatgtgagccaccacacccccttccttcagaagttttttgttgtttaatttttttttttttttttaatagagataggttcttgtcaagtcaccaggactgctctcaaactcctggccttaagtgatcctccccgcctggcttcccaaaatgctgggttgacaggtaggagccactgtgcctgggccagagttttaaattaaagttagaagatccagagctatgtcatagtggaggtgagacaattgttaagaaaacaatgttaaaagaggttagtttttaagaaattttaatgtaattcccccagctttattgaggtaaaattgaaaattttaaattatatatatttcagttatgcaatgtgatgatttgatagacatgtacactgtgacatgattaccacaatcaagttaattaacacatccatcacctcacatagttgtcattgtttgtatgtatgtatatgtgatgaggatactaagatctgctgtcttagcaaatttcaaataaacaatatacaaccgacccttgaacatcacaggtttgaactgtgcaggttcacttacaagattttttttcataaaagttataccgactgtgcctgcctctcctgcctccccttcctcctcctccacctcttctgcctctgccaccccgagacagcagtagctgtcctccttcttctcctcctcctcagcctactcaatgtggagacaaccaggatgaaaactttcatgatgatccacttccacttactgaatagcaaatatagtttctcttccttatgattttcttaataacatttttttctgtagcttaccttattttaagaatgcagtatgtaacatacaacatggatgtcgatgtgtttttaatcaaatgtttatgttataggtaaggcttatagtcaacactaggctacaacagttaagtttttggggagtcagttatatgtggattttctactgcatagtgggagtgtgagggtcgttgcctcttacccacatgttctggggactcaactgtaggattattagaaatagtaactatcctgatggaaggtttgtaccctttgaccaacatttccccatttcgttcaacccccctggctctagtaaccaccattctactctctgcttctatgagtttgatttttttagattccatgtacaagttagattatgcagtatttgctatgtcttgcttatttcgcctagcctaatattaaaagaggttagtttttgtaagtcaaccctgaccctggttctgagcttcctggcagccgaagcaaaaagagaacttggaagtatcaagtgtttatttcttagtaaaagaaagtataccagttcacgagaaaggggcactttttgtaagcactaaaagctgagttttaccattttaggagagtggtgcagtaaacagtgctgtcagtattagtttcatggaacacacagaaactttttgtatacttgtttcttaaatcagctcccattgaaagccacaggtatggtgttaaatcacacttgtaggaaggcatttctgtggggagctgaggcaatgaactcgagctccactgtttccagaggtttaacctcagagaggcacaagtcctttgagatactcttgagcacttcttggagactctgtcgtggcagttgtttgacaggagctggagagcaggctgtgtggactcctggctctgagttcagaggttttctgaggtcttcacagaaaagagagctaataggttggtgcaaaagtaatcgcgggttttgccattaaatgtaatgggaattttgcaccaacctgaatatttgttttgggtgctaagcatgtgaagggcaaagctgcttttttattatgaaaatgagagcctggcccactctccctttccagaaggatggctgtcgaggccaaagttgtcttctagaagcagtttgggatctgcccacagaactgggatgaggcccttcaggaaggaaacagtgtggtcagtcggggctgggcctgggcaagtcccccttaccagctgcctcacgccctggctgctggcatgtcctctgctaataattcttccattattggacacttccgtggtttccagttttggcctatcgtagataatgcctctataaatattcctttcatgtggatgttttcctgcatttttggataatatccaggagctgggttttttgatcatactcggaaaggatcatttctgagtccttttccatgtgaatcaattgctttcaaaagactgaccagcttaatgtgccacctgtttttttttttaattgaaaaggaaagtaatatttattgtggaaaatttggaaactacagcaaactacaaagaagaaaataagaattagcagaaattctaccaccctgagagcacagaggtgtgtggcctggtgcacacacctggttcactgctgcagtgaactcgtctcttgtcaggcaggggtttgagcctcggacagtcccctgctagtagtctgtctaggtgcatggggcacctgattttcctctgcctcaaacggtcttctcagccactaatttgtctgcctctgagcatacatttctaaggttttgaaggccctgttaacctattaatctgttaatcatagaaagcggtttagaaaacttttaaatgtctaaatgtttgggaggaaatgttaaattatcactgattggcttcttagtagattcctcaacagctaccacctgccaggcgtgaaacccaagaggtcgggaccccgggctgatgcgcttcggtgtgagaagtggtggaatcgcctgggaaagttttgcccagatctgactcctgaccacgttcctcaagttcctgtctggctctgaggcttgtctggagagccagggtgtttggtaaaatggaagggaagtgcgagcgatcataaatgagaacctaaacctgccgtctctcacttccctctcttcacttcgctgaaccagacattctctgggccaggtagacacgcccctctactcccctgtcattaggaggaagcttccagggcagggagaccccttcccatgctggccagatgccttgctgaactcttgaccagggtactggttgtgggctgagggttgctgaccccctgcaacccacagagttgcttctgttactgggtagctccaccatcacctaagcagttacatgtcagactgaatttcccagaatatggggcaggaagaagatggtccattcgtggaattacttgacctcaaatagagagcgaggcttcagtccttaggaactgtaatgactgatcaaagagttcccggatggctttaaatgccagaatgggcatggcaggtgtgctgggcactgtgcacacagcagtggcacacctgatggccgagtcattgttcagcatataggagctgatgcacagaaggccccctctcctgccactctagcagtttcattgagttgggtgggatctgggcagggaccacagctggaggtcacaggtgtctcttgggggaagaggggatgaatgcctaaatgatggcatcttatccaaacccctcttaccatgcatggaactctcagacagactctgttagagatgtgccttcaagatagatgctcgatgttcttagagctgtgtatcctccggccagcccatctgacacatagttgcaaacagctttcagttttccaatttccaggggctgtggatgattagaactttggaaccatgggattcaccagagagaatcttggtttggggatgtttccttggggcagagaagggggaagccactggaatgtctcagctgctgtttgtgttgtttgggtgaagagctccctgttgggatctcgtgatgcctccagcttgtggccatgtggatgggctgggattgatttgttctgtctggtttgttagacactctacccgctttgtctctccccacccagaaaaccacaatgaactctaaaggctggtccaactaagattcatggtaactgggagagagagagagagggacttgaggagacaagagtgacttgtgctttggtctgtgaaggagaggttcctttgcgatgaggattggaggtgggtcatgcaatgaggggcctcctgcctaagctgtattcagtgatcattcgctgcaggtgaccacaacttccttgtagatattctagctcccctgggtatgtccaccctctgctacccaagtggagaggttcactccaaggctatattccttataggatggcccgtggaccacctaggtttgtgtaaaactgtagcttcctgggccttttccagacctcctgaaccaaatgctctgttagagcccagaaatctgcatttccagcaagcgccctacttaatttttagataaagctagataaccctatgaaggattatctggaggaatattattgcttcagtctgaatggaaagagtttagctaaatgaactcaattcctttacattttttccccctttaatgtttttcactttttatgaaaatggagacagggtctcaccatgttgcccaggtgggtctcaaactcctggacttaagcgatccccctccctctgcttcccagagtgctaggaatacagaagtaacccactgtgcagcctctttttttttgtttttgagacagggtcttcatcgttctgtaacccaggctggagtacagtggcatgatcatagctcacgacagccttggacccctggtctcaagcagtcttcctgcttcagactcttcagtagctgggactatagtgtgtgcgccactgtgcctggctccagctgcttcactcttatttactcttcctccaggaccttcttaatgaagctttgtctccttgtggcttagaccgtaaattcactagccacccccaaatgtgaatcaagtatttcttctggacgccaaacccccatgacttagagcaaaagtgaagaaaggaaaggcaatctgttattgctttcctggttgtaaactgcttttggatttggagcacgtggtctggttggctctctgcaaggctgctttaaagcaacactgcagtgctagcagtggaggccctgctgatcagtgattcatcccagggattctgaggggccatccatatcaggcaggtggcccaccctgcccactgatccctctcaccctgctcagcaggtcctcccctgccaccgagcgcaaacatctgtgtccttcaatgacctgcccaactctgtttggtttcctgcggagagagggctttttaactttctgcttcctgcctcgccctgcttccctggttggcccaccggagtgacctctgatcctctagtctcagttgagccaaattctgactgtggactgttgtctgggttctagctttctttcaaaccgcgtgacagtaggggtttgggttggctctagacacggtgagcgcctagtcattgtcatgagactggatcatttcagcctgggggtctgccagcagttgtgtgttttgctgggatagactcagacagctcccttgagacattcccaggcaatgggaagcctaggaggcctgcaggactcagtttacatgcaatctcctactgactccacacctggggttcattttggaggctctaggtcaagaaaccctctggctgcttccctctttttccctgtgggagcttcatagggtagatgtggaggccacagtgtatatggggaccaggaagctcagaaatagagggaggctgatgatgggggagcagaattgagtgtggcatggaggctgccaggggagctgttacaggtctgcttgcatcagagtggactaggttgacgagaaggattagtaaagaggagctgggacttgaagctaagatttaagaaaaaggatctccaggacacttcatctggaggcccagagaaggcaaaatcttccagtcaaagcaacttagctgaggaacaatttttaaaaagaaaaaaagtctgaccagggcaaggttctaatagagcgagtgatgtgttcatttcttaaggtgttgcacattggcacagccttcaggttagcatcatggctgttgatgcagcaaaagctatgaaaatgctcagaccctttagccctgtaatttcaccccccaggagtgtgtcctaaggaaactgtccagctgaaagaaagacatgcttaaaaatattctctgtatgggccgggtgtggtggctcatgcctgtaatcccagcactttgggaggccaaggtgggcggatcatgaggtcaggagttcgagaccagtctggctaacatggtgaaaccccgtctatactaaaaatacaaaaattagctcggttcggtggcgggtgcctgtaatcccagctactcgggaggctgaggcaggagaacctccttgaaactggaaggcggaggttgcagtgagccaagattgcaccactgcactccagcttgggtgaaaagagtgaaactccatttcagaataaataaataaataaataaataaattctctgtgtgtaacagcaaaactgggggaaaaaagtgcttccatatctaactaaccctggggaaggaatttaacaaactatccatcctgatacatcatggtggtgtagtatttttgcagcctttaaaaatgataattaggaagattatacaggaataaaatattcaacagactgttgaaagtcggagaacactaaagagtaatacattataattgatcgtactgtaaataaggaagatagtgtagtaagtagtgtaaataaggaagataatatgtaaaaatacaaatggctatgttaaggctagaggattcattattttaaaaaattagtatttaaattttatggcaagtcagagaatttctatctgaagcatcattcctcttcaaatatttttctactatcacttgtcccttttcttttttttttttttgagacagagtcttgctgtgtcgcccaggctggagtgcagtggcgcgatcttggctcactgcaactccacctcctgggtttaggtgattcttctgcctcagcctcccgagtagctgggagtacaggcgcatgccaccacgcctagctaatttttttttttttttgtatttttagtagagatggggtttcaccatattggccaggctggtctggaactcctgacctcatgatctgcctgcctcggcctcccaaagtgctgggattacaggcgtgagccaccgtgcctggtcacttgtcccttttcttaaggagtcatggcaactgggtgagattgaatgacccactttgagcatctttagtgtgtgttgtgcactgccaggctctgcggagtacgcacagtgtaagatgtggtcctctgagcttaagggcagaggatatgtgtctttgctggggagataagatgtccctgtgctgggcacgctgattagtgctgaggctgatgcatggctcaggcatggagtgggggacatggaggctgagggtagggagtgggtggagtggtttgggcctttagctggggctggaagaaggaccaggagagctttcaggacagggaaacaaccagcccggcattggggaaacctaggaagaccaggagagttgagtttgcctaagagggattttcagatcatcacagctgtgagtgagctcagagttaaataagatgtctgttattcaccctgttttctagagattggaaactgaagtccaggaaataagctcttccaggaatctccagagtcccctggggacaggggtgggtgcgcaggctgactccctgtgggttggctgcgttccagtggcagatgcccctagggatgggaaatcatccccccgaccctctcaggaaaccctttccatcccttctgggttggtggcgtcactggtggtggaggatcagcattccttctcctttcaaatctgcccgtgccctgcttgggtgtcaggccctcctgggggctgctccatccacactttccatttgggggactttgacattttgtttaagtggagatgtgattgagagtgtgtgagggtgagaaccggaggctctggctctttaaggctcggccttcaagtgaggtttggcagagaagatactgaacgtttaattttagggccaaggtagggggtgggggaaagtccctaccgcatctggtttgtgttaagcctgtgccttcagaaaagggctgtgtttatggttaaaatccagcagggatggggggtgggcgggatgccgctttcccctactaggcattgcggcacagggacagggcacatatctaccttccttctcattctttgaccccatcccaagcccgacagttacaacttggagaaaactgcatgtgacatccattttatctctgcagttaaagccagatgtttgctttcaggcagcctccagcagctggactttgccaggctgaagctgtattctttgtgccccagaactccctgccgttggccgcctgtcacttcgacctgtctgcagcccgcagggtcccgggtgggtcattgctgctgcggagtccaagctggggcctgtcagaagctgcccagggctggcctccagcaggcctccctctggcgatcccaggattgagaagttgagtcaatccctaggatgtctagactaccagcgctggaaggtcccacagaaaccagagccagccccctctgtcagataaagaaactgaggcccggaaagctggagactgaaccagacctccctcagctctcagcttggctcactgctcttttgccagcttcatgtggcttcccttttggctactgtttgttttgctcttccatgctctactcccttaaagggccggccctggggacagggagtagggtgaaagatcttcagacccaatgggaagttcacaaggctgcgcttgttcactgctgtttgccagcattagtatagtacctggcacagggtaagagtttagaaaatcttgaatgaatgaacgaacgaatgaatgagtgaatgaatgatggggttacttggcctgagggtggggacactggtgctgcacttagagccattacttctgggaggggtaccaggcacgagtctccacacccaaagctctccctgttccaagaccacgtccagtcttctccaggccttcctcagtcccagcccatcacccggcttttacaggagcctggagtttcagagctgaaaggggccttggatatcaaatgttgcatcaccttcacgttagagttggggaaacggagtcaagggcacacagctagtcagcgggaacgtcaggaccagagcccaagtctgtggggttgcagagcttccatgcatccctccttgggcatttatgttgggagttgaggttagaaagagaaggccctgtcttgtccattgtgcctccccttttctgtatcttcctctgtgggatgagctgtttcctctttctctccctcctcactctggcttcctctcctgtagtggaggacggtggggtggtttctccataacagtctgagtaaaaaggctgggcccctgggattgggccaagtcattcccttgtgtcttcctagaaagggaaaaagagagtcggctggctcacttccttccggggaaaccagcgcctgagtcaccctggagtcagggcccagggaggagcctgcccgtcaccccgttgcctctggccatgggtggcgcttccctgccactgtttctcaaagggcggggggccagggaaggcctgtgctatccagctgccctgccgttcgtctgccttcgtcgcttcttgggagagtttcttggccttctgcaggcaggctggtgctggtggcaaggagggcaggcaggtgataacattgcccccctctaactggaggtcttaaacaccctcctgaatcacaatttgaaatgtttttgatttacaagtcttcaatatctgttttgttttatgataaaagtttgacatgcttagggccggacgtggtggctcatgcctgtaatcccagcactttgggaggccaaggcagccagatcacaaggtcagtagatccagaccatcctggctaacacagtgaaaccatgtctctactaaaaatacaaaaaattagccaggcgtggtggcgggtgcttgtagtcccagctacttgggaggctgaggcaggagaatggtgtgaaccagggaggcggagcttgcagtgagccgagatcataccactgcattccagactgggcgacagagtgagactccgtctcaaaaaaaaaaaaaagtttgacatgcttgtggtaaaataaaaaacaactccccacaggtaacactgttatttttctataccacagattttatatgtttgatttatatatatatatatacacacacgcatatatattatggtaaaagatacataatatgatatttaccattttagccattttgaagtgtacgtacagttcagcagcattaagtacatgtatgttgttgcgtaaccatcaccagcatccatctcctgaactcttttttttttttttttttttttttttgagacaacaactcactctgtcacccagactgggagtacagtggcacaatctcagcttactgcaacctcctcctctcgggttcaagtgattcttctgcctcagcctccccagtagctgggattacaggcacctgccactatgcctggctagtttttgtattttcagtagaaacggggtttcattatgttggctaggctggtctcgaactcctgaccttgtgatccgcccacctcagcctcccaaagtgctgggattacaggtgtgagccgcagcgcccagccccatcttctgaactcttttcatcttgtaaaactgaaactctgtacccatgaacaattcctgacccccagtcctgataattccattctactttctgcctctatgaatttgactactctaggggccccatgtaagtggaatcatatagcatttattcttttgtgtctgggttattttcacttagcagaatgtcttgaaggttggtccatgttgcagcatgtgtcagaatttcctccctttttaaggctgaatcatagtccattgtatgtatgaccatgtttggtttctccgttcatctgttgatggacatttgggttgttccccccttttggccgttgtgaacagtgctgctgtgaatgtgggtgtacaaatacctgtttgagtccttgcatttaatttttttgtgtatatgctcagaaagtagtactgctatattttatgctgttactggttgtgcttctcaggcaccttgggtcccctgggcagtgttgacaggtcagcagagggctttggataccaccccttccccctgccagcgccaggcctgccacagtagctgtctgcagaggctagggctggcctggccatttgggtccccgagggcacactgtggagctgcagagctaatgaaaagttttggaatcttgtggtgcagaagggcctttttgggccaggtccccacccttccttcctcctgacctcctcgtgttttggacttggggaagggggatgcagcttctgggagccctggggaggcacggggaccccgagcttactttgggacctagaggcccattcttcttatgacctcccccacccctgcctccagttcttcctgtcctgggctgtttttctctccgaggctctcccagagggttagtgtgaaaaagatttttggcccgttaattacagagactaatgcaaaacttcctagcttcctttggaggaaaattctatttcttgctaacagagcaggagctcctgtcctgatgcctgctttcaccaagttgggccccagagcagctcctcgctagagccctgtgcacagctgactggtctctgtgggctcactggttcgagcttcattatgagctgctttgaccccctggcagagatctgcacgtggctgtcttttgggtgccccgtgcgcctcaggaggcagtgtgtctgttctgtcagctagatcacagctctctgagagcagagctgctggttgtttttctttgtggcctggtagtggctggtctggtagcctgtacttcctggatgcccagttacagagaaagagaggccatgaaaataatttgggatttggcattggagaactcctggcttttggtttggggcctgctctttgctagccggcttacttaaccctctcgagcctgtttttccgtctctaaaatagggatcagaaaaccttacttcttttttttttaagatggagtcttgctgttttgcccaggctggagtgcagcggtgcaatctcggctcactgcaacctctgcctcccgggttcaagccattctcctgcctcagcctcccaagtagctgggattacaggcgctcgccaccatgcccggctaatttttgtatttttagtagagacgggggttccaccatgttggtcaggctggtcttggactcctgacctcaggtgatccacccaccttggccttccaaagtgctgggattataggcgtgagcccaccgcacccagccagaaaaccctacttcttaataagcttgttgtgaagagtaaatggggtcattgttataaagtgcgtaggtaagtgtcagtgaatgtcagcttttgtcaccgttgtgcctctgctaagtggaagggcctgggggggactccctgcagaaggccaacttcctaggacctctgtgtgctttctgtccatccaagccctactcccctgggagaggctgcgtgtgaggttgtctggttgggtggcagcagcttcccctgcagaaggaaactgcttcctccccagggagatgggagttgctaaactctggcttgggccggctgtgtgctctaagcagggattatgtgcgtgtgtgatgagggcggtgccttgggcttcattccagatacaccgtgttctctgacctcgcactcccttccttggagcccctcactccagcaccaggcattgtggctcagaactcccactgctccggattgctatttgacagtttcataggtgggtcctacttccctttttagatgataggctccaggacctccatattcctcatatttggggacagaaaataagagcttctctttccatgcagtaggatgcccctttctcctgtgggatgattgggaccggcctgtccaggcttgggggagggaataggaacgggaaccctgcttggagctgcattctgtgttcggcccctccctgcagaagacttcaccttgcagagactgcagagtgttagggagaacccagctttggagccagcagcactggtgtggaggcaagctctgctgtctgacttgctgtgtccttgagctggtccttattctgagcctcagtttcttcctctgtaaaaagacaatctgtcttgcagagttgttgccgagactaaatgagatgatggatgtaaaccacccaagctggcatcccatacctggtaggctccctaagtgtgttgttattttgtgtgtggatgggccaaggggtgcttttagcgaaccattcttctccacacagaggtgtggtgagacagacttcctatatacatttctgtagcccagagttgcccaaacttgcctgattataggattcacatggagtacttgttacttgttaaaataccaatctgtgagtcccatcccagaactcctgaaccagaatggtggttgttggggtgaggggtctctacttttaaccttttttataatcgggccagtctgggaaatgccgtttccctcagattgctctgccagttgctgtgtcattccatcttcacgggggcccattggaatgagacaagtatggccccttggaaagtgggagactttgcaggtgagactgaagcttgaaggggctggcctgaggccctgagctccttgtggtggaagcagatttagaactgagatctcccagtgatgtgtgtccattgtgcctgcaaacattccactaaagcatggaaaaggtgaaggtggggatggagagagatggagtgacaggaaggaggtgagggctgagggcctccatgatggccttgggaacctgcagagactaagtgggggatggatggtgggacagagccctgagccccactaggatgcttccccaggtgtgccttctgaaaaccagggccccagtgagcatgtggggccttgggcttcttagaaccactgggaatccacaggtgtcagagcgtaggcgcggtcttaggcagcatggacccagcgggaggggctgggactcctcctcagggctgctggtggagtcctggaagtcctgtgggtaggacttctgccacttctcccctcttcctctgccttttttattgggctgggaagttttctagaagcacaggcagggctggctcccttgttcagatagggaagttgaggaataggtatttccagggtcagctgatgatgccaggaactggggtcccactgccttgtctgcttcctccttctcaaagttggcctggtccattagagaaaaccccttttaggtccttactatgtcatcctttccagtttacccttaagaggcccttaaggaggatttcaacctctgctgggccccacccccagagggtgacttgattggtggtggtgaggtgggctggtgggctggtgggctgtgagcggaggggccctgttacggacagttgtgagagtgtggccggggcacggtgacctgctgccaggccctggggagagtcacgctgactgagcctgtggttgaaagtgtgtgactgccaccgcgggtggaattctggctcctgcatctactgttcgctgtgaccttgagtggctgtgagctcttggcctcggttttctcatctgtaaaatgagatgccttctggggtggttaagattgattgggttgacactggtagaacacttggggcagtgggttgggagtgacatcctgatctctgaagctcttccactcagacctttcaattagatctgcagcctcaggactttggacctttggggactgctgtgaacagcgagctgccccaggtgtctgggcaggcagggagtatgggtgcaaagctgtggcctctctgcctgttcctccttctgttggctcaggtctgaaaatctgggtgtggcctctgcccctcctccccgtctctcctgagtatctcttgtatccacctgcttctccctctcctacactgccaccctggactggctccctttgtctctggctgggaccttttcgtgatcttgtgcttggtctcttttcagccactcttttccatctctgatctgcccttcccatggcatttagaggtctctttctaagatgcaggtggaattatgtaaccagcatctgattggcactcccagcccaactcagcccgccacagccccatttgtttctttcagctaaaataaaatgtcttcggtgacttccactgctctcaggagaaacaacagctgcaggaacccgaacacccatgtggctagttgatctccagtctctggcaccctcttcttccctcctgcactgtgactttttttttttcagttttttgaacagaccttactctcttttctctggggcctttgctgtttgtttgttttcttcttcttcttcttttctttctttctttctttctttttttttttttttgaaccggagtcttactctgttgcccaggctggagtgtagtggtgcaataggctcactgcaacctccgcctcctgggttcaagcgattctcctaccttagccttttgagtagctgggattatgggcacgtgccaccacacccagctaattttgtatttttagtagagacagggtttcaccatgttgcccagccccacacacgcgtagggtgacctacagctacctgctccacacacgcatagggtgacctacagctacctgacccacacacgcatagggtgacctacagctacccgccccacacacgtgtagggtgacctacagctctgcctatacctgttatgctggtgtaattattagtagaccccctggtgccttggtttggatgacaggttatgtgggcccccttcacatttacgaacttttcatctaatactccccagccttatagattcactgactcccttggggcagtgatcagacacactgcccccctacagccccccaggatcagttcagggtcctgttttagccttatgccttccaggacctttcctataggcactggatcttagtgtacaaaaatacacgcattgataaaatctttgcttattgtttgtcttctccattagactgcaggctccatgacttaggacagtgcctgtatttgcccacgatgtaaccctagtccctgatacagaatgagtgctcagtaagaatttatggaaggaaggaatgaatgaatctggctgcagctgtctggcaggggaggcctggagcctgggcgagtctgtagaatctgcagtggcctgcgtgagggaggctgccaacatcgggccagtccaagccctagcaagccagttgcccacactctggcacacatcatcggcttggtggcccctttaattattcatcggtctttctcaatggcctttgtgttcagaaacccaagacagaattcaaaccctctttccatctccctaaaactgagacctggaagaaaaacctgctggcccattctgcatccccagggggccagcaggtccacagcctcctctcgtggctggctttaagcgttgaagtgtcctgggctgccctgtggctctcctccccagtccactgggctcagggactgcctgggcacagctgagtgggtgcccgtgtggcttgagactgagcagggactggtgcaggctggtgggcagagctggatgagtccccatcattccccagcctgaacggagtctgaaggctggcctggaagagtttagcctcccagcagagtggagcaggctcaggctttgaccgacctagttcacacctcagttctgcctcttgccagctgtgtgactgtggggaactggcccttggtgtcctgttcctttgttcctttaacctagaattgttgagtggacttgctgagatggcgcatgcctcgtgggtgatgataacagtgagtgagcactcactgagggttataatggtagccaacatctttgagcaaccctaggatatgattccctctccttccctcacctccccttggggctccctgaagtccacgttgccatcagtgtccccatcttgaaactgaggatggaacgctgatctttcctttcaaggttggggggagggggctggggagccgaaagcaccccagggctgcccttgctgcagtgtctgaagtgaagcctaggagccccggtgctggtgggcaacagcaggcgtggatctctctgatctttgaagaggactgtgaatacactgaccacaggcggaagccccttgtcccgtcctgccctgcactacccagaggtccctgggcttctcagcagaggtggacagatctgcttgcagctgcccttcttcccacgcttctggaaatggaagttcccacagacacattcctgttcctcagcttgctgctccctgcttgctgataccttgccgccctgtccctcaaaccgggctggccataccaaggtgttggcgagctgctcagcctgctgagctgttgacaccccagaccaccgccggcctagtggacaggccaggaaggcagtgatggcactgggtcacattgtcctgggcctgggtgagggtttctgtgctgctttttaatgtgctgatctgtgtgtttgtgttttgggagaagaaactttgtgttgcggaacctcaggtgaagagaattgaggtcgttaggctcctccgtcatggcccagtgtcatctcggggccatgcaaggcctctgtgtgtccgtcacattttatcctacaatctcctgtgatggatatgcagattgtccccagctgctctcctgctgacacaaatgaggcaacgatgaacattctcccatacatcccagtgcagctgtgtgaggattgcattgagcagggaattgctgggttgcagggaatttcctgatacgctgctgagttaccccctaaaatggctgtacagtctactctccaccagccgggcacgagggcttccggatccctcaaccccaccaacattcggcgtaatcaactttctaattgtttgcctgtctattaggtgtaaagagatgcattttagttttgagctgcagctgaagaggaactctcctccaagtgccaagactgctcccctcctccagtcagctctcttggaaccagaaacttcctcctgggtggtgttgagaatcatggtgatgctctgcagaaaacctctcctctgtaaggagtggcagtttatagatacagcccgttaatgcctcagtccctgcaggaagttcttttttttttgagctggggtctcactgtctcccaggttggaatgcagtggtatgattatggctcactgcagcctcgacctccctgggctggggtgatcctcccacctcagcctcctgggtagctggaactataggggtgcaccatcatgcctggctaacatttttaaattttttgtagagacagagttttttgcctgttgcgtaggttcctgcaggaagttctgctccctgggagtgtctgctccagtcccaccccgggggtgcaaatcactgctgtgacttgtggtggcttgtgatgcttccacagttgctgaacttgttgcctcatcccctggtatctctggcatcctgcgggcttgggtttcctggagctttgagaattcctttgcaaagtcatgtggctgctgccgggtggttgtccctcagggaggaggtgggtggcgctgtggcattggcttggagtttgggctggatcagtgctgaggtcctattgatcaagttttgactgagtcagagaggttggggtgcagtgcctgctggatcctgctagcccagatgaaggaacacactgggtgccaaggtgtcccccatgatcccttgatgctacctgggaccgtttagtagacaagggcaattccatgggtcctggagtcgttctttttgtctcatgcctttccatgagcaccctttctcttgtctttcttgtactttagtaatgaactctagacactattaactacttagggtgtgctgggctttttgcatagattatctcattgaaactccttaccaaaccagttgagaaaggtattatccctgttttacagatgaggaaactgaggctcagaaaggtcaagaacttgcttaggttccaaggttagtaagtggcagacccatattgaacccagctcttctgtgcccaaatccgttcttagccactaagccttggtcctcagagtgtggtctctggaccggcagcatcagcatcacctggatacttgttagaaatgcagtttctctgccggcctagaactttggaatcagaaactggcggtggggcccagcaatctgtattttaacaagccctccaggtgattctggtaaatgttcaagtttacatattcaagtttgagaaccaccgcactgaattatcctgctgttcttttttctattttttctgcctggcttctccccttttgtcattgggccagtcactgtgagcccagactttgaaccctggctgctcttcaggggcttcatgccccttttaaagaggtgcagtaattcgtcctctggggcctccacaggaacccctcccaagtccccaaaagcagttgacagaactgatgctccagctgacagcctggtgaccggaaccaccatgggggtcagagttcccagtcactatgcccaaggaggtgctttgaggggtccgggtgacccaggggtggactgtgggacagaccaggacagaagctcctgctgggagattattttaggggcacagaaaggagacttggaaaacttccttgtccaagcaggatctctttctttcttgcaaatttgtaatgataagtggtttgacctttggagaggagcttccacacaggggtttggaatctaggcaggtccttgtttctggtcaacaaggcacattcaggagaaatgaccctggggagaggatagaagctaattttttttttttttttttaagtagagacagggtcttgctatgttgcccaggctggccttgatctcctggcctcaggcaatcctcctgcctcagcctcccaaagtgctgggattgctggtgtgagataccagagccagccttatttaatttttgagcccctaccgtaagtctagttttgtgctatttaattcttagcccaaccccaggaggggtggatttcatcatcccattccacagataagaccatggaggtttcaagctggaagactgagggtcatacctcaactacatggaggggtcaagttaggggccagagtctgccagaccccgggttcccatattgtatgagtagcaggctgggccaaatccctgtcagctgggggagttctctatggaattgagtgacccagagctctcagcatctgtgccaaaaaaaccaaatgacctcacttttggtggcttttccttctttggggaaggaatgtgctggccactgctgggagctacagcctgctgaggcctgtgtgctctcagacctgcaagggccagaatcagactccagacatgggggaggggttacagcaggaccaaactgtaaccccggaggaccggggaggaggctgttctcacactggcctcccggagcgggtgccactctgcttcgaagaccagctccgcccatttagtaatcctcatctcagcaggcttaccagccactgttcagtagctgaactagctcaattacatcagtcccccgagagggctctggtccagggcctgtctttgagcctggtttctttccaatgggccaaatgggttaaaaacaaaaccacgtcttgatataaaaggcttagcggggtcctggaacattttagtttaaaagagaaataacagctttattgagatgtcattcacatacccatacaattaacccatttatacaacttcatggtttttaggatagtcacataaatgggcagctatttttgccatcagttttgaacatttttatcaccttagaaagatattctgtaccccttagctatcacctcccccaactcctccgttcccagccctaagaaaccactaatcaagccgctttcggtcttcctaggtgcttttgtgttttaacatctagtgagtgcttggtctgcgtctggtagcagactgagccctttgcactagctcacatagccctccctcgtgactactttatgggctgcaggctcattttatctttattttattattactattttcaccatcatcattctggcccacagaagtctttactgatgtgagaaccaaggctccgggaggcccagtcgcaagtactggacagagctagctggtggctggcagttggggtgggctcttgggtccctgggaggggtgaggctgtggatggtgacagattggctgaggcagttgactctcattggcgaggagctaagaggacagacctgtttcttcactaggatcgtgtgtccacctgttttaaagtggctctgatttctcctgggagcccataggttccacctgtaccaggcaagaaggagctgggcagtctgccttctggggggccttggatggcagggaggccagatcagagtctcatggtggcccaggagccctctcaagcacggtgcctttgttaggcctcccagaaaaagctgcaggccccctgcttcttggccctggtgaccctctgggtgtctggtgctatgtcttttgaaatgggctgtagatgggtgtaaaccaggaaatgcaggctccactcccccctccccatctcctcctcttggccagaggcccgtctcagagttctctcatcagtggggaaaaaaaacaacaggacttctttcttgctctgtgaatgattaactttgattaaatagacagtggatgggaagtgagagcatgctgaccgctgacattgactgggctcctgatgtgtccagggtatcttgctggctgttttgcttccattgtcataatcttcacaaagtggtgatgttctttatccccattgtaaggtgaggcaattgacacctagacagtttaactaaagccacacagccagtgagtggtgaggacctgctgggttaacattgtttaagtgtctgttgtggacacagcaccaggctaagtctttcaggacatagggtctaatttggtcgtctttcattctgtgccattgtaggccttgttatccccattttacagatagggatcctgaggctaggattaaatctcctgtccaagcagacagatgtaatgtgaggtgtgggctggcactggagcctaggtctgtcttgttccaaagtccaaggtgcacccccagtcccccctactctgaatctccaggaccccagcactcacatgtcctggggacaggctgttagagcagtgccaggtctcagcagaggcctggtggttgtcagctttttcagcagccactcccaggtgggtgggaagtgggcagatctgggtggagatgttcccgaagactctgcttttcatcagcgcatgaaccagctgacggctggctttgaagggctggcagtcagcccctgataagttagccagatactcctatttaccatgccagaacactgggcatctgagatcacttctgggcaggtctttgcttagacaaaccacccagggcccacgccctggccagactggccatacttgtatgggggtcagagggattccagcacgccccctggctgcacctcagtaacgtcttcaacatcagtggatgctgcaggggactcaacgctgagcacaggtgctggcctggccttctccaaggaccctgctggttcacacaccccgcccacacagcagggggctggcttgggctggcagggtgcttgcctggggaggctggtgagtttgtttttgactcgatgagcctagaccagagtcctgggtgctctactcagggagaagaacgaccatcagacgagaagctggcttgtataggaagctgtgtaccattttcaggaagtgtagaagctcatttgggtgatttcctggggtcacttggccagagcacagccctttatcttacccagttagcagtttgctgtcttaattattggggagatgtgtgtgattgctggtgtatcctcatgtcctgctccctaattatgactttctttaagattttacactgataaggcactttaaagttcttcagagccttttccctatattatatcttattttattctcaaactcattcttttaaatagatgggataattttttcattttttatctttattttggaaacatcctttttcctcctccataatacctgagccttgtcccacccttgccaaataatcccagagaaatgggaagtcctctctatcctatcctagaggtctgacataacaattaaatgtatatattcccagacagacttttcttttttcttttttttttgaaaaccactaactttattgatctaaaaaactttacaaggacagtgactgttctgccaaaaaaggagccaaatggtatcaaatggactgcaagtgagggtgggggtgagagacggggccaggaatccatgcaggaaagctgataactgtcaccagggaattggcaagggaaaaaggaaggaggaggcatacaagagcgagaatccaaaaaagttgaaatggttaggggagaaaactctcaaaagaccctggagtacatcagaggtgagtacaatagcaatcttttcctctgtagaggacaggggaggagtcccttcatggctgcaaactctggatgagggctggggattgagggcttcccagagagcatcacaagaagttgtcctaccactcttaaaggcatcagaagcagttctgggattgcttggcgttggcaccacaagtgtccttcagccattcctggaagaggtcttcagttttcttcagcaccagaaactggccaaggacaacataggctttgtcaaagcccctttcctccggcttcttgcccaggacttcacccggccaggctccccactggctcttcccccatgggctctgccacgaactctcggtgcttttggaaggttgtcatcttgattaggcctaatcggcagcttcaattcccgtaacagttcctcccgccaccccctagacagactgttcttttatttgcatacttaaaaaaaaaaaaaaggtaatgacagcacattttggtacaaaactcaaacaaaagcatattctgtgaaaagcaagtgttctctaccccctgccttcccatttctctccctggaggcagccgatgatcctggtccttctgtgtcctgctaggaatgttctagcataaagcttttagatgctgtccgggacactaacgtcaggattctgcttgctgagaagggttaggagctggctgtcttgagacagaaacactgagtatgttttgagttcatggagatgaaattgtccctgggaaattttttggctttctttgagagcccaccaatcagaataaaccctacacaggaacaaaagattgttgccgggtgctgtttggttgtgtcttctcattaggcgtgttctgatgggaaaagtttctgggctccagcctgcaaggtaggagggacttgtttgcgctagcagagctggaagggattgaagtgacttatctgaggtcacacgcctggctgagccagggcaggtcccaggtttcctgatcccatcctctgaacacttaactcccctggcctgaatggtggctggtatttttgattccgggagagtgggaggatgtgcttggaagaggtgtggccagcacgtgagtttggagcctgggctgtcccaccactgcccagctagtcttgtttggctgcaggtgggttatcttgtttattccactgtgcaacaaatggaaaaagcacctttgtcaatggaggcttctctggggaggtcagccagagtggatggcctggattgtgtgttgaggcttaaacatcagaatagagcgctctagccgggtgtggtggctcatgcctgtaatcccagcactttgggaagccaaggtggacagatcgcttgaggtcaggagtttgagaccagccaggccaacatagcaaaaccccgtctctactaaaaatacaaaacttagccgggcgtggtggcacgcgcctgtagtcccagcaactcaggaggctgaggcaggagaattgcttgaacctgagaggtggaggttgcagtgagctgagattgcaccactgcactccagcctgggcagactcctctcaaaaaaaaaaaaaaaaaaaaaaaaaatgaacagagagctctctgacaggagaagggagagggagcagatcatcataaaaaccaaccacattgccaggcacagtagctcatgcctgtaatcccagcattttgggaggcagaggcaggtggatcacctgagctcaggagttcgagaccagcctgaccaatatggagaaaccccatctctactaaaaatacaaaattagttgggtgtggtggcacatgcctgtaatcccagctagtcgggggagggtaaggcaggagaatagcttgaacctgagagatggaggttgcagtgagcggagattgtgccattgcactccagcctgggcaacaagagcaaaactccatcttaaaaaaaaacaaaaacaaagcccacaaccaaccacatttacagacaactgtaaaacagcaaaaaatcctaatcagttcagttactggagtgcaagccctgttagcattttgatgtgttttgtttttagtcatttttttcatgtttgtgtgattgcccacatagttttaaacttgcagtacatacagtcttgaatcctgctttttttggttaattatatataagcagtttttttcatagtaacatagtttcagaacccatcattttggccatgtaatatttcattaagtggatgatgaagcctaatatacttaacctaataccttattaatacaatttctgtctctttctaatttttctctctcaaggaatactggcaagaacatttgtatgcttacagcctttgctttatatttagaattattagtctttattcaggatggtggcccagaattgggctaagggctggtgcccatcttagttcaccttggtgagttgctgtccatcagagttgtaccaatcgcctgcccacagtaatgtgcctttgtcattgaacccaccagcagtggaaatgatcagaaaactactttgcacatgtaataagtgacaaatacaccttttgaaaattcacaagcatggcagcatgtgcgtgacatgtctaaccacaggcccttgtgacaggtattgacgtgggttcctcattgatccagccccaggagaggcgcgcccgctgccccttacgggaagtcttgccagcttttgccgactcccagatggctgatgtccccaagacctgtcaggagtgttaactgtggtaggcacagctgtctgctgcgtgcttgttttagcatgtcatacattattacgtgtgtaactttattagcagacttagaaagctttcatgttttcccattgtgaaactaaagacccattgggtcttaattcacatttagcctgctgacatttttggggggcctgtgggatgtcttatttttatattgtggcagcatttcaaaactgagggagtctacataaaaatctagatttttttttttttttttcttgagacagggtctcactctgtcaccccaggttggactgtagtgacacaatcatggctctctgtagccatcatctcccaggctcaagcaatcttcctgccttagcctactgaggagctgggactacaggtgtgtaccaccatgcttggctaaattttgtttgattttttctgtagagatgaagttgcccaggctggtctcgaactcctggacacaagtgatccttccactttggcctcccaaagtgctgggattacaggcataagccactacacccagcataagttcagatttctgtctcttcttcattggaggtgtggcagccaagggcctatgttcccatatgaggcacagaggagctgcttctgccccgggccacctcctgccgtgatacagaggccgtattctagttgccattgagtagctctcatgcaccctagtatacttgtatttcaggatagccatgttttcttctgggtagaaaaacaaaggatagcccaagagggccactgtttcaagaacaatgcataagaatacagggaggtggccgggcgtggtggctcatgcctgtaatcccagcactttgggaggctgaggcgggcggatcacttgaggtcaggagtttgagaccagcctggccaacacggtgaaaccccgtctctactaaaaatacaaaaaaattacccaggtatggtggtgcttgcctgtaatcccagatactcaggaggctgaggcaggagaattgcttgaacccctgaggcagatgttgcagtgagccgagatcgcaccactgcactccagccagggcgacagagcgagatacatcgcaaataataataataataaaaaaaatacaaggaggtaaggactaacttgtcctacacttgacccctccttgtgccttagtttcctcatctctaaagtggggagaataatacttgtcccacagtgtcattgtgatgattcaatgagttaaaggaggtaaagcactcaggagaggatctggcgtgtagcaaatggtcaatacgtattagctgctgctgttattacgatctgtggcatatgtgtttgtctcctccagatgaggaactgaggggtgaattttgcttgtcatagcttggggttgggcgatgttaccagcaactagggtgtggtccaggggtgctgctgaacatctatgatgcatacagcagcttccctgcccccaccaaaaaatttttcagaccccaaatatcagtagtactgaggttgagaaaccttgcttagaccttggcgtgtgtgacccttggtctgactgaactcttctaacaggtctagaccaggtgcagtggctcacgcctgtaaccagcactttgggaggatgaggtgggaggatcacttgaggcccaaagtttgagaccagcctgggtaacatagagagacccagtctccaagaaaaattaaaaaaaaaaaaaaaaaaaaaaaaaagctgggtgtattagtcagggttctctagagggacagaactaatgagatagatgtatatataaaggggagtttgttaaggagcactgactcacacactcacaaggcgagctcccacagtaggccatctgcaagctgaggagcaaggaagccagtccgagtcccaaagctgaagaacttggagtctgatgtttgagagcaggaggcatccagcacgggagagagatggaggctgggagactcagccagtctagtcttttcacgttcttctgcttgcttttattctggctgtgctggcagctgattagatggtgcccacccagattgagggtgggtctgcctttcccagtccactgattcagatgttaatctcctttggcaacaccctcacagacacacccaggaataatactttgcatcctttaattcaatcaagttgacaatcaatattaaacatcacactgggcatggtagtgtgcaccttgagtcccagctacttggcaggctgaaaaaaaaatcctctaaaccaacattttcaagggctgcctcaggctcttatagagtcagagtgataaaggaccttacttagctcaactggaggggctgcttgaatcccttccccagtgcccttgccgagccctgccttcagccgcaggtagcacactgtacagccagcttgtggtctgttctttattatgttgaactctaatcttccctgaaactttctgtccttcattctaagaatagtagctcccatttttggagcctgtgtgtgggtgattctgcttagcattttccacgtgctactgcaacgatcttccccaccctgtgaggtggttctattaccatccccattttacagatgtggagatggaggcttggagaagtcaagtcacatgcacaaggtcactcagtggatccaggtccatcttgccgtagaatccacattcctcaccattcctcaccactggcctattctgcctggtctgtacccagcaagtttactcactcattcatggaaggatctttagatatttgcagtgaatccctcagccatctcatctctcctcctggtcatagagccccagttcccaaagttcccctcaaagggctgtctggtctgcttaccatctgtaatgatctctcttgcctcttgacaacacctgtctgtccctgggctctgcctctgtctgccaggctgccccagaggggctgcccatcttctgccaactctgctgatgttccatcaactcagactctctgtgccaatgctggctgcggtcccctggatttcatctggttggtgttttcacttcacagtgacccattttcagtgataccctatgagattcagcttacctgtttgaccattgagaatctcagccttggttctgctgttcccttccagcacccacccatgcctgcacctgaaatccacgtcattcgggtggagcagaaagtgtgaggggctggaggagtcaggaggttgagttgtgaatataatccagccgtgtggactggggaaagcctctcaccctctcttttttgtgtccttagtcgtaaagtcaaggtttgacttggatggtgcctaacacctcttctagctctaacattcttttatgaggtgtgttaacagcataaacttataataattatacccccaattgtggtggcaatagtaacaatagataattattgcagttgctataattttcagtgttttaagtggactgtctcattgactcctccaataatcctctgggtaggtgctattactacccccattttacagatggtgccttaaggcagagccatgtcaagtcacttgtccagggtttaccacctgctagaagctgataggcctggatttgcagtcttctttagagtgactaaatccttgcattcccatggatacttttctgcagagtgatccgagtgaatcccatggccctcctgctttagggtcttgtgatttacctctccctctccccatgaccaagggtatgaaggatgcttgattgtaaaagctcatcccctaactcatgcttctggggtaatcttctgtaccccagctccttgcagagtgtgattattcagacatccttttagaatctaaaattcaggcagtgatgatgacggtaggaactaccactttctgcacacttactatatttcagacacattgatactatattgtcattattcacataaattaacaacattactatgctaaaattatttactgaataagggtacttcctgtcagtcatgcctgggagatgctattgtcccccattttacagacttgaaaactgaggctcaaagaggcctgttgtggctaaagaaacattgcagtgtgtctgtctgagcttgggggcagggaaggcacgttctcaaaagccatattcctttccaacacattttaaaggaagtatatcacatgataattgtgaaagatgtgacgaaaagaggttagcggagtctgtgagagcaaggctatgagacctgtacagaaggtggacaatgtgattctgtctccatggccagctccatggctcctagcctgggctggggcccctctgttggcgcctggccaggtccctctttgcaaccctgaactacagggctggacagttgcactctccacctcctcaaaccaccttcaaactggattagacatgggcagtggcttcgaggtcattgagaggctgagcaggggtccaggctgttttgcggcccctccctctgtcccgggtcctcagagactctgcagggccggggcaggtggagtgcagacagggctgctgagaggggaacaggccgttgccgctgctctgcgggaacatcccagtgtggtccttggtcccaaggacttttcctgggacctctcggcatccctgaagccatttctggaacggagtgtatccactgaagacctgccatcccggatctcctttgtcaggctgtgagcctgagtatggcccaaggaggtgacttgaagatggctcttggggtgaggggaggccagatagggcagggcttcatcgggctgagcagtaacatggccctgtaccctttgtttgaatgcggctgggccacaaacctgccggggtagcactccccaccacgccgggcgtccaggctggaggtcttggggccgtgggtctctagcatgggcctctcctgtggctttgaccttcctctccttgctggacccctggagcactgctaaggagcaggtgccaccccctcatgctggagcttgagcctcaagaccaaggctgccccaggctggaggggaggatatagttgtatggtgtgcgttcagctgtcagacctcctctgcggaggtgcacaaggccactgtcaaaatccctggttttctgcacccacgccactgttccagccctctcccacgaacgcaccacagttccagccctctcccacgaacccgccacagttccagccctctcccacgaacccgccacagttccagccctctcccacgaatgtgccacagttccacccctctcccaggaactcaccacagttccacccctctcccaggaactcaccacagttccagccctctcccacgaacacaccagcaccggtgcaaaaaagagctcgcatgttgtcatcttggaaacagtacagcgcgtggtggggtgggacctacgacaggagagtttggtggctgggggcagggagaggatgtggggtgggagtgcagaggagcaagagcaagtcctctgagacctggtcccgggatcattttgggggagctagtcctgtcctcttcctcctccccactgttcactgagcacttactaaatggcaagttttttacagatgtttttgagttaatctttttaacttttatggagcgctgttactatccctgttttactgcaaagggaactgaagtttaggaaggttaatctgaaggtcacacagccagtaaatagtggatctgagaactgaatccagctctgatgcgtcccgaagtgcatgttgttgatcaccgggtcacagccaccatttcctcctctagcctaaactttgcggtggctgctgcttgttggggaaactttccagtttgagaggtgcccagagcccccttcaaggcagtaatctatggggcctctgaggattgggggttttagtaaagccatgttccagggctttgtccaggagacctgagcaaacataggtgtgttttgtttcccagggctgagcctggcttttccaggaaagggggctggctgctttcaacagcacttttcctctttcaaaagcagtgtctttttacgacagcagcctcttcctcctttatctcatcccaaccccctccacgactgggtagtaaacagtgagaatttatagcccccagctgggcgggtgggctcagggcagtgcctgctaggaccctggatgtttcaggccacattggacctgaaagcatcccttcgagttgctggggctgacacagttcccctcaaggaaatagaaaaccttaggctgaaggttcagtgctgggggactgggagtgggtgctggggatggccaagatggtgataaatgagaaaagaccacccaccccagtgtcaacgcacactcaagtgtgaacgcacagcttgaagacactgggcagaccagtgtcagctgggagagaatgtgcaaaaccaaagtaaattatatttgttttaaagagttaaaaatcctttaatatttttctaccaataaaaagaagttaaaataaggataaaggctaaaggccctctcatctcctgcagtgccagcagcggaggaaggatgcttggtacatacgcttccctgtcctgctgcgtcctctttcctccgagctgtcttctgtgtccagggggtccctaagagcactgtttgtcccatcaccccctgccctgagagcattcagcctcacccacaaggtgcagttggatctcccaggaccctctcagctttgcatccagttccccacttgttccttcacctggctgcccaattcttacgtccactagaatgtctgctgcacagaggcagggacttttgctgtttagttcactgctgtgtccctgactctgtgccctgggtctctgggatataaaggtgaacattgagtttctacctccaagagctcccaggctgggggtgtggagctgacaagtggctaggcataatgggtgaatgcagggtgctatgggtgtgtgtccagcccagacagagcaggtggctatcaggaaggcttcctggaggaggtgatatctctacccagtcttgaaagatgagtgagttagttaagcaagatagagaggacattggaaatcagtgtatgtcccctatctaccctgatctgtgtgccagtcttcccagagctctgggatagcacaatacgccgtttctcttcatcatgggagtaggctggcctgcagagtggagatatgtttgcagggagagagaggtattccatattggtaagttactagtgagacatgattgaaaaattaagcccaaagtcacagggtatcataatgctgtccctttctccccgcctgtgtggagggatagcttctgtccccctgttccctttcttgttcataggctcttcaacttttgctcctaaatctaagcagctatttcttttcccctgatactcgctggtgtgatgttcttccctcttcctacccacttattgccacttcacctttagagttccccagggcaggaggaagggattggggagcatgaagctgtgacctttcccatgaggaagagtatttctagtgtggctcctactgtcacatgaatgatacactgcccatcctttgaattttgcagggcaggtgggaagagagctgaatggctctggtgttgggtgagccccatgtaattggtagtgccatttggtgcagagaagtctggagttgccaatgaatggtttagatctaaagcaagggagctcttctctctggttgccacagagtggagacagctggagagagacacctgttttagatggacatgtaaaactgcgatgcatgcttttgtttctcatgtttgttgagacaccctcttcctgtttgagccactagctggtgctgttggcacaggatggcttagttgctgcctcacctgatcataatctgcttaatagagaagtaactatgaagctgatggtctttgatttgacctccttacattccctttctggaactcttcatgcttttgcagcttagggtgcccctatccccacccaaagcacacacagatacacattggggtgcttactcttctcccttgtcctgacaccctgcatctgaattctgttctcagcgaaacttactactcctttctcttagctggctgccaagtgagaaaggatttaatatactaatttaccctaaggtatcaacagggcttaatatgttccttcggggttactctgtcttaaaactgtgaagattgaaactaagtcttataacttaagaggtaacttgtaagaatggaattgtggcattttcaaatgtgggtgggcatgagtctttgagagagggctgggaggcggatgttaagggaatttgctgcttcatgtatcctgcttgctcccacccatgtagcaggctctgtgtagggtccctcagctgctgccctgtgggtagctcagtgcttggttgatgcagtgaatgagaccatggtggggcaactgtgttgagaggctctgctgagtaggtgtccacctcccaccccctggcaccattaaatggcttgtccaatgagggtgacaacaccagccccctgaccacttgcccttcttgtctctgcccagacattcacggcatggtgtaactcccacctccggaaggcggggacacagatcgagaacatcgaagaggacttccgggatggcctgaagctcatgctgctgctggaggtcatctcaggtgaggcggaacctggcccaggacgagatactgtctattggtgctgcctgacaccttggcatctgctctgcctatgagcgcagctggttttggtctcttgaaacaagttggggatgacatgtatgaattcatcctaggagcgtgggtctgagttctggttctgctgccagccatccaggtgccttggacatttgtttcagcatccttgtttgttttaaaaaaaaaaaaaaaaaaaaaaagggtttgaaggaactgaggttccttctcctccccagtgccaggattctgtggccaagaatgttaaccatgggtgactgtctccaaatcttggctccattactacttatctacctgtatccaggtgacccaggccattccccagcccctggtttgtccagatgtctggagggacagctctactggaacacacatctcatcctgcttatgaatgcctttctgccaccatcccttaaggggtgggagtcctgtgagtctagccttggttgatacactgggccatgttagctactctcttcaccttgatgccggtgagccttagacctaatcccagcccagccctctccctcgagccacctctgaaatgctgaacctcgctgggcgtctccaccccaatgtcccacacagtcctctcagcatgtccaaaactctgtgcttgtcactcctgccctagcaaacctcttttccctcccagagtcctgttcttctgcacccaagctgggatcatagacagctcttctttgcaagttgttactgatgttctgtttattctgattccttcttctcagtccttcttttaacccctactgttgtggtgtcagtgtggcctgtgtcaactctcacctagatgatcccacaaaggcctttaccccagctcttcctggcagtccacccctgtcactgtagccagagggcttgtccgacagtcagtccaaatatggtcacactgttccctctcacagccctcagcccgcggtgcctctccagggctttgagcctgcaggccacattccttagcatagcttatggaatcctgcatgagctggcacctgctttgttttcaactaactattcccaaaaaggtatcagaccttcgatcctctgccagttgtggggtgggggcagggggaacgtgcagctctccccagatgacatgcactttctgtttcctgtgcctttgcacaagctctaactgccctttttttttaaaagtagttttttctactttcagataaaacctgtgtgtgtggtaaaataatatataacagaaaatgtatcattttagccattttaaagggtgcagttcagcggtattaagggcatgcactgactgttgtgcagccatcgccaccgtccaccttcagggctcttcatcgtctcaaactgacaccctacagctgttcaacactagctcgccgctccccccggccctcccctggcaaccaccattctactttttgtctctgatttgactactctaggtataccttgtacgagtggaatcatacagtatttctccttttgtgacactggtttatttcacttactgtgtcttcacggttcatccatgttggagcatgtgccgccatccctttcctttttatggctgaatcgtattccattgtatgtatgacctacagctataaaatggctccccacattttgttcattcacctgtcggtggtcacttgggttgtttctaccttttgggtattgtgaataatgctaggacatggttgtacaaaatatttttaaaatccctctttcagttctttttttgtatattccccaaagtggaactgctaggtcacatgggaattctctgtttaattttttgaggagccaccgtgctgttttcctctgccgttatttatttatttattttcttttttctttgagatagggttccaccatgttggccaggctggtattgaactcctgacctcaggtgatcctcccacctcagcctcccaaagcgctgggattgcaggtgtgagccaccgtgccttgcctctaactgccttttagaatgtccctgcttcctacctcctccactacccttccccagttttaaacaaatctggccttacaatttatcattcttcaaaatgcagcttgagggtgtccttcaagaaggcttcacccttcctctctcccctaatctgagtggactgtgccctgcccgcaccacccccctacctgcccagctccccagcacctataataccccattaattcctctgctgtgtcttttatcacaaagtgtagtcattttcggttcgcttgttttcttctctgctccacactgagctccttggggcaggtcatcttctctctgtgtctcaggtgcttagaacagcaccagacatgtaggcggtgctccgggaacattagaatgactgagtgcccagagccgggcttgtcctcatgatacccagtgtgttcctgctgcataggtctgacgtgtgcccaggggacctgtgcatttctgtgaagcatgtgtctctttgccagggttgggaaagatctgttctgtgaaatgatctgttctcccctggacaggaaatgctgggatacctttttctcctgatcatcgttggagatgggtagggtgccccaggatgaggagaaggaggggtatgctgcctacagaggttctcaaagtgtggtccttggactacccacaccagaatcggcaggattgcctgtcaaaatgcagatttccaaaccttaacccagtcctcctaatcacaaacttagtgagagggggaaaggggctggacagccacagattagccagttctccaggtgattttgtgctgactgacgtttgagaaccactggcccaggcctgggaagctttttccattctcccgtgtttaacccttgcctcctccactgtcctttgcagaagcccccttccagccagtgtgcacagctgctgaatggctggggcactccgcttagctggacaggccccaagggctggggctgtaacaggagcagccttccagggaggggacgtggtgctgcctgcatccatcctgtggggagggagcctctgtgccatctccccccggacaggaaatactggggtaccttgctgggttgcagccagagccttgggagggccccaagtggaaagtcttgatttaatttaaaaaacagctgtgcttccctgggagctgacagccagatcccatctgtggcaggaagtctgccgtcttccagaagctagcaggctgctgggaggccacctggagaggtgctgctctgacagggtgggcctggcccagaatccccgtggctggtccctggagtcctcgcagccagattgtcgacctgctggggagacagtgggtgtggtcgggatatcagggcaggcacaaggggcctgaattccaggctctgcgatggtggttctcagccttttggggtccttggccccttagagaccctgaaagctatataccccttccctaggtatggctctatgctgcacttagaaaattctcagatcatttcaggaggcccctggatgctctttgttctggaataaaagtgctgttaatggggtatttggagagccagctcctctacctttattttctcaaaggttctgaccttgaaacctgagcagcagaagctactgtgtggaatctggaggtgggggtggagggttgacctggagctgagccctgggtgcccacaggaggcagcataataggacaagaactgtggttctcagatggggatgggctgctataggcaactccatttaaacaccagggaagtccataatacttgagtgacctataccctcctcccagggcaaagggaaggctagaaggagttcagggcctttgcatgtactgttccttctgccttgatcatcattccttgctttgtttgcctggctgcaaagactcagacctttcctgaccactcctcagttcctccttcctcttcctcctcctcttttgaagagcatggatctttctttgtatttgttcattgtatatatttatttgtgtttctctatttaaggtctgtctctcctactggactgtaattacataaaggcaagaaactgttttgttcacccccctattcctagcacccagccaaatccctggcatgcggtaggggctcgataaataaatgttgagtggatgcaagcagatttcgacctgagaagcagaagaaagaagaggcagggtagattctccctctcattccctgccagggtgacattctccagcccctgagcagcgtgtgagcacacacacacgtgcacacatgcacatgcttctgcctagctaagctgtgctttggatgagggtgtagtggtagtagctctggcccctggctcatagcgtctcaccttcctcttcctccctcttgatccaaacaggtgaacgcttggccaagccagagcgaggcaagatgagagtgcacaagatctccaacgtcaacaaggccctggatttcatagccagcaaaggcgtcaaactggtgtccatcggagccgaaggtaaggcctacctctggtggccccaaggagcctgattttctttgtccccctggttctcttggccttttttgtgctgcctcctgggcccatgcatcacttgggggcattgggcagtgggtccccagcacctccatctggtcgcctgtggaggctttgtattgcaacagcgcttttcttctagtctcagccctgcccaaaaccaaggacttagacccctgttcccatgcctgcacctgcttagccacgtccttgctctgtggagtcctgtgtgtgtggcatgccacctcccccatccagaggcctgactgcacggtgttgcctggagcagaggatttgtgtatgggctggaaagggtgtgcagacacaggctggtggaggctggaggctgccccgagactccccggggccctgggaagactgaagtcccgaagcctctaggaacatttttaatagcatttccctgcagtgtagcttcctaactctttaacttttacttagaaacacttaccaaaaaagctattagcatttccttaatgattaaaagaaggtagtgtaatttcttgtgtgcatggtggtggctctgaaaaattgagagtgggttgtttagagtgggcagaaaatgttctatccaggccccttcagtcctgtgaccatggatttagcaagtatttatggggcacctgctgcgtgatgtcagagacctaaagatgaacgaatctcactcattcaagacacatcgtggctgtgagaatggattgctcactctgtggcatatacttaatcctcacaacaaccctatgaggtagctctaagaattaattatcctgattttgccataagaaaacagatgcttaaagagattacgtgacttcctcaaggttccgccatcagtaagtggcaaagccagaactcaaacgcaggtcttcgtgacaccagaggaatgccctgagagtggccttcccttggagggggcaggggtcttgctcctgggaagtccataggagcagatctcttctctggttgaagcttacagtcccctctcttctagaaatggagggatatttatcaaatggagaactttaacacaggctcagcaaactgcagtgcatggggtcgagtccggctgatttggatttttggaaatattggaacacagcacaccggtgttaatgtatcatcagtggctttgtgctgcaatgacagagttgagtagttgctacagagcttatatggatcatagagccagaaacatttcttatcaggccctctacagaaaaagtttgctcacctctgccttatctggaattcaggccagtgcccaaggtggtcacgcaaggtgccttatggattccagcatctcccccaccagctgtgagcttctcaaaggcagaaaccttggtttctacatcctgtggccccagttcctagcagcatgatgcacacagtaggtgctcaatacatgttaaaaggatttacatatagcagtataatctgctttgtgatgaggaagatgttctctgccttataataagaaaagaacagtttgctttattagggagcaattcaagacttggcagaaaaagttataactaagcaggcgtgggaagccaaagaaagtcacccaggtggttagtgcaggctcggatgcccctggggcagggaagtgtagagaatttgtgaagtggttcaggggtcagtggcaggggtgggtagggaccgtggcaagctagagagtcatgtcctaagcgggatgggcaccttgtggatgtaagaagttgctgctgtgtggatccagtgctgctagatcttccagtttttcaaaagaagccagaaatccagattttttgaaaagaaaaatttggcaactaaatttaaaaaaataacttgtttgctctttaaagcctctaccaaaggggaggagggcagggaaggggaaggtggaagagaatagcactcaccgagtacccgctctgtgttgctagacagggtgctttacgtgggccatctcctgctacactcatgatgggctcgtaggatgggtatcaccagccacgttttacagttaaggaaactgaggctcagaaaagttgctagagtggaagagtgtcatcagttgagcccaggctctgagccagactgcttctatgtggcagatccagggttaaacccaggggtaggctccagagctgaggccttcctcttcctgttactgtcggcagtgctgcctccccagtcagagcccaggacagaactttcttttctttttttttttttagtagagatgggatttcactgtgctagccaggatggtctctatctcctgaccttgtgatccgcccgcctcggcctcccaaagtgttgagattacaggtgtgcgccaccgcgcctggcctaagatctgaaacttctttttttttttttgagacggagtctcactctgtcgcccaggctggagtgtagaggggcgatcttgactcgctgcaagctccgcctcccagtttgacgccattctcctgcctcagcctcccgagtagctgggactacaggcgcccaccaccacgcctggctaatttttttttaaatatttttagtagagacggggtttcaccgtgttaaccaggatggtctcgatctcctgacctcgtgatccacccgcctcagcttcccaaagtgctgggattacaggcgtgagccaccgcgcccggccagaactttcacatcgaattgtcttcagtactgagatggcagatcaagcctgcccctgccatgctggcctcaggggtgaggagtgagaggaacactggcgtgaactctcatctcactgctgctgctgtgctgggaaggtcattcacctggcagcctcagttttcccgtttcctttgacgcaggcctagcttctctaaagattttgaaaaggctcctttattttttattttttgagacagggtctcactctgttacccagactagagtgcaatggcacgatcttggctcactgcaacctccacctcccaggctcaagtgattcttaatctgcttcagccttccaagtagctgggattacaggtttgtgccaccacgcctggctaatttttgtatttttagtacagatggggtttcactatgttggccaggctggtcttgaactactgacttcaaatgatccgccagcctcagcctcccaaagtgctgggattacaggcgcaagccaccacgccccgacgaaaagttcctttaaagtgagacgttctttaccttctccctgccctgaggagccagtgttttcagctgtggcttccaggagtgaaatcatccactcccatcaggctgagcaccaagattatgccacaatggccgctctgctgagccaagaaactagatgaggcagcaaatggcgttttgtgggcttttaaaagtgaaatggagtttattgatgtcgattataaaataaaaggcgatgggcagatggcatagaatgagctctcctggaaggggagcgggggaacgttgcaggttgtccatcctgggctgctgaaggctgtgactgtggagaccaggcccagcagggacacccctcaccccccaccaaagtctttgaaggattatcatgcagtgcaaggactaagacctctggctgactccgaagggcagaaccaggcccagaataggtaccctgtaggtaggtggactctgggagccttgggaaatggagccggggctctgggagggttatgagttccctgtccctgaaggtgtgcacatgaaggctggagacaaggagcttccacacataaaggggaggttagagcagatccttaaggtctcccctacgatatttggttctagaatgcatagacttcatggaattggcctgggtgagtggttggaatgtagttaaccaggggagagaactcaaaaaggattttgtattttaaggtctttgggcaggtggagcctgagggtttgggtgctgtgagcatggaggtgggctcagtgaggtagcatgtatctttaggatggagggggcggtgggtgccataccacagcattggtctgggaggtggtggcccctggggttctagtttctgtcacatggaatttctgcagcattcattctgccgtctgaatactgaacagatgacggtgtccctggagagagaaggagggagaaacatgttcccagtaaacaggggatgtgagcagcttcatagctcgctgtagaccaagaaggtctacattacagacgctgttaatctgtcaccaaggtttttccacaaagcccagttgtggccttggaaccctccctttggggccagccttctaagcagtccctgacataaagctgcctgagagatgaggcacccctgctgcaaacgttgagaagccggaggcccggtatacaggacctgccatgccagggaaggggaaggagagtggatgggatgggagtcaggtgggaactggggctgggcgtgcatgggctgctaattaagcacgccctactctctatgctcgtgcttggcgcctctgttttctggagtgaaactatgcctttggtgtgaatgagaattcagtaagcaaaattctctggggagtttctggggaagaagaagaggaataagtaggcaagaccctaaaaagaagccacctgcctctcccagtccctccgggaggactccaagagggcaaatctgcaggcagtgagctcagggccagcgggaggccctggagtttggccgtcacagagtggggcagcatgtgggggaccaagggagggctagcattgcagccccactcctaggaaggccaaaccatgggattaccactcagagcttttttctaggcttaaaaaatttttcccttatattttaaacactgtttatgaaattttttacctgcttttcccacttcccatgctaaaaaatttttctaagttattaagcactcataagcattaatgtctgcgttcattgtcttttttgttttgtttttttgagatgagtctcgctctcttgcttagtctggagtgcagtggcacgatctcagcttactgcaacctccgcctcccgaattcaagcgattctcctgcctcagccccacgagtagctgggattgcaggcatgtgccaccacatctgcctaatttctgttttagtggagacggggtttcgccatgttgtccaggctggtcttgaactcctgacctcaagtgatctgtcccaccttggcctcccaaagtgctgggattacaggtgtgagccactgcgtctggcctcatcatctgtttgtcgtacttcgtcccaggcctgggccctgccctggaagagactgaggtccattgtgttctcagggggccaatggcaggcctgtgttagctctgcccattcccctacttgtggttagtgtttgttcactcattcgttcactcagcagatgctgatgggggctttgcctgtgccaggcttcatactgaactctaagcagtgatgcaaaacaggaagtattcttaccctcaaggggcttacattctagaggggaaagagagaaaatacacatgtacacctgtcagatggagaaaaccaaagcagggaggaacttgggtggtcaagggaggtgtccatgagaaggggacgtgtgagtgaaactggcaggaggcagggacaggccacgtgggtatctagggaaggggagctgcagggaggcccgagcaggggggacggggaggaggaggaggagaaggaggggaagaaggagcagggggaggagggggaacaagaggcccaggcggccagaccacgagggcctctctggccactggctttgactctcagggaggtgggaagctgtggaggttttttagcagagggtgatatggggtctggggatttacttggtcattctgtgtactgtgtacctttgcgaggtttctaagtacggggtgtgataaatagccttgcagcaagtgcattcattcaggaaccttactctgcatttcctttcattggctagggatagattcctggagataaaattatactgccaaaaagctgagcaactgtaaaatgcgtgctccttgtggccaaattatttcccagattaattgattaatttcccagaaattattattattgttttttaaaccaatttacacttctagtgtggtggccttgctgacatcaaggcgtgtggttttcaactttgggtttttttgtttgttttgttttgttttgtttttaagagacagggtctcaacttgtcgcttaggttggagtgcagcggtgatatcacacagctcactgcaaccttgagctcctgggctcagtccccagtcctcctgcctctgcctcccaagaagctaggactacaagtttgcaccactgcacctggctaattttttcatttttttgtagagacaaggtctcctatgttgccccggctggtcttgaactcctgggctcaagcgatcctcccaccttggcctcccaaagtgctaggattaaaggcatgagctacttcacccagcctaactttgttttttaactttgctaatttaatagctgggaaggtgatcttatttctttgattacaagtgagattgaacattcttgtgaattggttatttgtatttcatgttttatgatttttttgtcttttgcctatttattgagagtttagtatttttcaattgtcttttcaattgagatgaactctttaaaccattggaaataacaaatgaaagtgcattttttaaaatatcaaagatttatgagccgattcctttacttttttattttatttattcatttttttagagagggtcttgctttgttgcccaggatggattcacagctcactgcagcctctgccttggctcaagcaatcctcccacttaagcctgagtagctgggactacaggcactaccatgcctgtttaatttttgtatttttgtagagatggggttttgtcatgttgcccaggctggtcttgaacacctgggttcaagcaatccacctgtcttggcctcccaaagtgttgggagtacaggctcgagccactgtgccaggtctatgagttgattcttgatgagtagtactacctccccacaatgtggactgcaaaatgctggctggctgtgttgcttggtagcaaaaggggttgcatgctgctcagctctctgtttctctccaacccaagcatttggatgtgggactgtgccccgcctggtgtctggggctctgggaggggcatttttacttccctgtttacaagaagggttacatcctattccaagtccaaagtggacacttgttcctttgctcagcatcccatgcagactcagcaggttacccgctcccctgggaggtggctgtggccaagcactgctccatggactacacccggctggtcatggaacagcatacagttttgccctcacttttgggaaaggggctaagatgttagagtataccatccttaatggaaatccactcttgtttcaggggtttgtgggatgcaaatcctagtagggtcagaactgcctagaaattgatccttctcatggttctattgggtctcccctaaaattaatgttgcaggtaggaaaaaaaaagatattctttgggtaccttactcttaactgagcgtgtcttaccatgggccggattactatctcctggtctggaagcaggtgatgagtgggtgtggaatctacatttgagtatcacttgttcaaccacaagaccatagattgctccatgtattgggctccttaaaatagggcttatttatgttgtattccctgccattaggcctggtacagaaaaaaagagaaaatctacttcatagaacttgtagattctaaaactctaaaaggtgctgcttagactaaatatattgggttatctcttagctgtgatcttgaagctattgtttgattttttaaaaaaacatctgttttaatacccaaactgatggcattgtgagattgagtcagtggatagttcaagatggcaatttacaaaactttaagtttgtgactttctcttgattccactgtttttccacgtgtgggtggctattttgagagctgtgattgcccagagagccccagctcacagaattgccagaacatttgtgattgcttagaaatcctcccctcttcatcaggctgggaacacagatcaggatttcaaatgcccccttctctgtggccttccctgatgtacccactgtctccaactaggattgattacaccctttttttgtgccccaaatagacttctcttccagcacctgtcacagtttattgcattaactttaagaaacatccaggccaggcatggtagctcatgcctgtaattccagcactttgggaggctaaggtgggaggatcgtttgaacccaggagtttgagaccagcctgggcaatatcgtaagaccctgtctctacaaaaaatgaaaaaattagccgggtgtggtggcctatctgtagtcccagctacccaggaaggtgagatgggaggatcgcttgagcccaggatttggaggctgcagtgagccatgattgcaccactgcacgctagcttgggtgacagagcgaaaaccctgtctcaaaaacaagcaaaaatcctgtttccctctagaagtagagctctggagtcttttgattcctagcgtggggcatggagtgctgtgggtgctgagggagtgttaattctgtccccgctgaggccctttctgatgtgtgctgctgctgtttctgtagaaatcgtggatgggaatgtgaagatgaccctgggcatgatctggaccatcatcctgcgctttgccatccaggacatctccgtggaaggtgggtttctgctttgttccatcccgccatcaccatctcgtctccctccctgggcttagcctggagaactcccatacccagggcaacggacgttgatcaggggccatgtcctgggcttcttgctcatttattgggcatcagccttctcctccagtcaatgtagaaaaaagaactgtttgccattctgattctcataggcatgttggcctcagggaaactccccactttgggaaagcccaaggctgccatggggaagtatattggaaaacccacctggctcttgggttgttaatctgaaagggtggggaaatagcggctgggaggaaggaccaggaggggcgctaaccccgtcctccactttgctcccctagcaccctctagtggccatttcacagatctgcaagggccgccatggtctggagaggtgatctctacgcttgattccacactcgggcagtttttgagctttatgtctgctatgcctgtatttatcttgcataataatatttgtgtattgttgtgcctgtgataaaacacacatactgaaacaaacttttacaagatgagatggagatactattttttaaatatttgttttaatggcatagacatcataaacatttttaatcaaaggaatttcttaatgaaaacaacgtggattcaattcaattgctttgtgatggagatctaggtgtgacactctgtgatgcagcaatgtagagttccaagttcggtttatgggtacttggtatttagggttgaagtggttggaaagagggtcatagtagtcacctggggtgtggttcttgttaatgatagtggatgtaaatccatttctcaaatagccttcttgatgattttgattcttttgggtggacttcttgtcagctctgcagtcatcattgtgttactcttgtgatttagctgacgaagagcttaagctaagtagaagcattagcttttccaatttttaaattgtctgcttttgcttaggtggttatggtctttgtaggaacccttgaatgtcattttaaagtccattttgtgtgttgaaaataaatgagatcattcatgaacacagtccactgagtaccttaacctccaattcacaggcacaaacacagggtgtattagtccgttttcacgctgctggtaaggacatacccgagactgggtaatttataaataaaaagaggtttaatggactcacagttccacatggctggggaggcctcacagtcattgcagaagagcaagggagagcaaagggacctcttacatggcagcaggcagagaatgagagccaagtgaaaggggtttccccttagaaaaccatcagacctcgtgagacttattcactaccacgagaacagtatgggggaaaccacgcccacgactcaatcatctcccaccggctctctcccacaacacgtgggaattatgggagctacaattcaagatgagatttgggcggggacacagcacaagcctaacgggggtagtgtggtttgcagtctttcttctgtgctgggagctccgtgagccccctcagttgcctgcctaacctcatagacacgtggctgcttcacacacagagggcagcagtattgatccgtgcagtaaatataaggaaaccttattttttagattaaaaacaaaatctgtctaggagtcctaatgcttccttctcactcagctgtgtgcacccctcaggctgtgggattcccctgtctggagacccctagatgtgtagatttcccagatcaaatcttcctccccaacctgatagaggttgccgacttattttgtatcattaccatttctttgaataaaagagagtagggggagctaattcttgaagtttgaaaaactgttgtctcaaaatttgcacgtgtaacatgactagctctgaacagcttcccagcttgctttttctgtttctcaaataacttctcaaactctgtcaagggaatagacttgatggccagggctcctccttcagtagctgcagggttggcatcaaggggtcacagtggggcctcctgtgagccggcatcccttcctccaccgagtcagccctctgacctcgctgcccgtccccttccccatagagacttcagccaaggaagggctgctcctgtggtgtcagagaaagacagccccttacaaaaatgtcaacatccagaacttccacataaggtgagtgctgggggctgaggggctctcacagaaccaggctgcctcccccgggagctcccagacccccttggctgggtcagtctcagctttagaacaaagtggagacctctgggggaagaagtagctttccttgggaaggggatgtcgccatcgctctgaatccccccgtctctctccctgcagtgtcttagatggggctgctgcctgatataactttggttgatgcttttgctactgggagcgcccccaaggaaattgtccaggaagtcccagcccagggctctggaacagcagactagggccataggccttggtcgggggtagggctggatatggcaggtttatctgaacttgtcaacccccccacaaagtcttgaccctagtgcctgggatttgtggcaggaagaaatgtcccttcccatcctgtcttctaactcctaccccagaaagctctatgtgttcatctctctggagtctaggaggcccctgctttgccctggttgcccgtttgttcagcctcatttaccagcctgctccttcttctctctccccgggcagctggaaggatggcctcggcttctgtgctttgatccaccgacaccggcccgagctgattgactacgggaagctgcggaaggtatgtgtgcccacctgaccacccgctttgggtccctggcaggtggggtgggaaaagagcaggactaggacccttgttgtgacagtccatggtccagcctgagcagtgttggcctcttagaatagccagacagagccccaactgaaagtgaagagaaaacaccttccctgttagggcaacttcattacccttgtgcgtggtgtgtgtgtacttgcacacatacacagcccatcaggaaaatatcacagctgtgacagcagctttgtcagagggatggaatgatacatggtgtttctcccttctgtttttccgggatttgtaaagaggagacaatattttcatcattgaaaacagtgcatattctaagggacagttcatccccgccttgtcctttgacctgctgtgcggtcctgggcagcttatcccacccatggatttggtttcctttattgctcaagtttggctgggggattttcttttggtttcactcccgccttcagcatgaagctgcagtgatttttcttgagtgggtgtgtggagtggggacagatgcaggagtgggagctgtgtttctagcctcatggtggttctcaatgtctgagctggttggacgacactgccctggaccttggagaaacctgtcctggaccctctgaccacactctccaggttccctcctggaccctctgaccacactctccaggttccctcttggtccatcttggtgccaagaggccacatggcatggccatccaaggaaagacccttcccacgccccaagttggtgacctggagttggggttggaatgtcgcctatctgtgctcagatctcttggcaagggaggcttcaaggagcggctggacttgtgtgtctctacttcaccttgatgctggagaacacagtgttcagtgtagctcttgccttgcctgggcctccaggaagggcgtcttgcttctcagtggccaggagaggtttaatatcactggggcaggagctgctgtgcaactcatggtggtggcaggccctttgtttcgggcgggtggatagcaagctgccaaaaaggatcttgagggaggaaaggagcagatgcctacccgcttccctgcaccgtgccccgccccacccccaccccatacacactgccccgtcacctgaagcttgaggctgaggcctctgcccactggaagggcccatctgctgaaggagaggagccacagcaggggccagcccttcgccagctaacctcctgggggaagaggatccttggcccacctcctcagctgctttgcaaggaaaaaaaaaaaaagagaaccttcctgtcctgctggaaagttgtgtggccaaatcaaacgtggccaagggggaatattctacaggtggcagttttttcttttgaaggcatcaccacttcctattcagctgatgggctttggtgacaggtgtgcacctatctctgtccctgcttgggtatgctggggtgtcagtggccagttcatccacagctgttggacatccccactaaaggggtctgtgccgaccgtggctctagagccccctcccttattctgaaggatttggaagcatcagccatttgggaggtgaaagtccaggggttctttctgatacccagttagcactctcccacgcactatccctctctgtctttttatttatctctgccagtttctccctgttttgctgtctctgcctctccttctgtgtttttttgtttttgtttttgttttgttttttgagacagagtttcactattgttgcccaggctggagtgcaatggcgtgatctccactcactgcaacctccgcctcctgggttcaggcaattctcctgcctcagcctcctcagtagctgggattacaggcgcacgccagcacgcctggctaatttttgtatttttagtggagacgggatttcaccatgttggtcaggctggtcttgaactgctgacctcaggtgatccacccgccttggcctcccaaagtgctgggattacaggcgtgacccaccatgcccagctttttttttttttttttttttttaagagagtcttgctgtgtcgcccaggctggagtgcagtggcgtgatcttggctcactgcaacctccgcctcccaggttcaagcgattctcctgcctcagcctcctgagtagctgggattacaggcacccaggctaatttttgtatttttagtagagacaggatttcaccatgttggccaggctggtctcgaactcctgacctcaggtgattcgctcaccttggcctcccaaagtgctgggattacaggcatgagccaccgcgcccagccccccttctgttttttaattgtaatttttttgtagagatgaagtctcactatattgccgaggctggtctcgaacttctggcctcaatgtgaccctcctgcctcagcctcccaagtagctgggattacaggaacagccaccacacctggcttccactccttttaattcagtatcatcatcagtaaaatccagcccaaatcctagcacacacctgagcccagtgaaccaggaacacccttccagagaacaaggaggttgtgagaccaactggtgccgaagaatagggacagagggctgaggggctccgactgggaagctcttccttcctgcagcagccatgggtgggcatggggccctggggtccctgggactcacgtggggcgggtgtgtgtatacctggacctgagcactggcagctgctgctccaggccctggatgagaatgaccttgactactcggcagtgttcatcctcctggctgctgttggagactttcccagagggaccccaccttctctgtttagagcaatttcctcctgaaaacatcctggatgatgtatttatctttgtgttaccctatacttctccctttagcaaacagggaaactgagtcctgggccgacacaaccagcttgctttaggttagtctggggaaccaagaatagaggagaagggcccagccagaaactcttccactaaggttttttatcctctgcattaaaaacttatacaataactggtacaatatacaaaacaaaatttaccactttaaccatttttaaatacacttactgttcaggggtattccgtacactcacattattgtacaactgttcctaccatccatcttcagaactcttttcttgcaaaactgaaagtctgtacccattaaacggtagttccccgttctttcctgcccccccggcctctggctgctaccattctgctttctgtctgggaacctcataacagtgaagccatatggtgtttgctgtttttttttttttttttgagacgaggtcttgctctgttgcccaggctggagtgcagcagcgcgatcttggctcattgcaacctctgcctcccgggttcaagcaattctcctgtcccagcctcccgagtagctgggacgtgccaccacacccagctaatttttgtatttttagcagacacggggtgtcaccacgttggtcacgctagtcatgaactcctgacctcaaacaatccatctgcctcggcctcccaaagtactgggattacacacgtgagccactgcacccggcctgtgtccttttgtgtctggcttatttcactgagcataacattctaagagttcatccatgttgcagcatgtgtcagaaattccctcttgttgaggctgaataatattccattgtatgtatcaccacgttttgctcatccgttcatccatcaatgggtacttgggttgcttccacctcttggctactgtgaataatgctgctatgaacaatggaggtataaagatctctttgagaacctgctttcaattcttttgagtatctccccgcaagtggaattgtaggaccatgtaataccatgttgaattttttgaggaaccaccatcctattctcacagcatttgacattccacctacgtttatgttgcattcatcgcacaaggattacagcttctcaacatccttgccaagccccgctaagtgttcttgcgaaggtagcagaagccagaatagtccaaagctgtggctatttaaaggagcccccaaatttcatgaaatgtgagcaccagaggggctcctgctccgaatcttgactagtctagagtttagagctccctaccccaactcttgagttatggatggagaagctgaggtcaggttagctacccacgagtcccactggttgagggcagagctgaaaccagaagccaggatggatggtgactaggccagtgccctgcccttggcacacgtttcttaggaactccttcctacccccgactcaggctgcagactacttcgccccattttcctgacaatctgaagcttgaagggggaaagagaatgctttaaacctccaaccagtgagccccagtggtgagaccagccttccacatctggagctgtcccctgaggatcgagctggggctgggagaaagtcgctctgctccccagtttgggtggccacccaattgggagtagccagtgacttgtggtggctctcactttatcatcccttcctccttttctccctctaggatgatccactcacaaatctgaatacggcttttgacgtggcagagaagtacctggacatccccaagatgctggatgccgaaggtgaaaggcgctttccttctgtgtctcttgcccatcgcccacctgccactcagcggctaagaaggggtggaccccagcagtccggggctggacgggaggaggcctggtcttctgggaccgcatttgaggagcatggggatcacagcctcttggggattcttccatcgttctttgagctttggagagagaggtgttagttgattctgcaaaggtcttaggggctgttcttgcatcgactgcctgaggatggttcttgtctttgccttggagtcaggatagcgggtgctggggtgtggggaaatgtgcccttgttgtccggcacagtttgggatgggaagtttcccttgctgagaggtgcactgtcctcaccctctgagccctgggtggtctctggacagctgagcttagcatctcctctatgccccagctctgactggggctggctgggcatggtgtttttctcatctgtaaccctggcttccttctagcatcttctgaggagggtgctagagaactatggcttggactttctcagtggtggaagtgtccagttctgatctgtctgggaagatcccagccagaggcagtggctccatgttgggtagggaaggaaggagggggcccaagttgagtgttgacttttctgttcctcaccaaggccttgctgtcccagatgctgctagccaggatgcctggatggggacaggttcagggttcgacactagaacatccttaccaaagattgggcctggggctggaaacccagctcttcctggctgctgaccttaccattgcccctctccctgtgtagagcgtctcggatggggtgagcaggggctgtggggggaagggaagcatctgggagcataggggtctgtgggcttatgaagccagggctggcagctccaggctggggtcaggctgggtcttgtcccacctccgcgcttgccccttgggaggagcctgactcaccacagccccttccctgtgtgctctccttggccccaactgctcagtgctgaagggctagaaaggggttatggagacaggaaaagaccacggtggggtccagactgttccctgcccctctgccccaccagtggcttttttttttttttgagacggggtctccctgtgtcacccaggctggagtgctgtggtgcgatctccgctcactgcaacctccgcctcctgggttcaagcgattctcttgcctcagcctcccaagtagctgggattacaggcacccaccaccggctaatttttatatttttagtagagacggggtttcaccaagttggcaaggctggtctcgaactcctggcctcaagtgatccacctgccttggcctcccaaagccaccagtagcttttaaaatttcaaaatgtcatgaggaaaattttcaaacgcataaaaacccaggcaaaagcagaaagaatagcacgatgacctttcctatttccatcatccagatagaatggctactgaggtcttgccacactttgtgtttttcttgttttctttgttgaagtatcttaaagcaattctgagatatcacatcattttaccactgcatacttccgaatacatccttaaaaatagagttattttcttagtcaatgataaagttatcacatttagcaaattgataattccatgtgatacccagttcataatgaaatttccctaattacctatgacatttctttgagggttggtttgttttaatcagaatccaaacaaggtccatactggcattcggttgtgtttctgacagcttttcccatctctagtacttctctcctccctttgaccccttttattcctgccaatgaacttgctgcagaaatggggccgctgtcctgtagcaagttccttatactgggtttgtccgcctcctttggggcttcatttcacctgttcctctacttacattcccataagcgcaagttgacgccagaggctggttagattcgggctccacattttggcaagaagacttggtggtgctgcgagcttctttctgcctcacgtcgggggtgtatggtgttcttggaaccagctggctttaactccagatttttcttgacagacatcgttggaactgcccgaccggatgagaaagccatcatgacttacgtgtctagcttctaccacgccttctctggagcccagaaggtacccggggccccctgctccttccatgcccagcacacctcctgctggaccccaaaccatgtcctcctgcccgcctccacctctcctggtgacaggtatctggatggtctggtctctcggacagaggcagtccctagttctgaagtggcgtgttgttcttacctggctcccgtcccaccccacacctctctctctcatcttctactgttaacaagaaaattgggcagcagctcactttctgggacccagatgactggcttaagcaggaagggctgtgtgcatgaggcagccggggtggttctggaaggctactgaaaggtgaacaggagcagcccttccatgcccacgtctgttgaagccactggctcgatagagcagctggagctcccttagaagggcaatgctgggagacacctccagtcttcacttacccacttggcaaaggcatcataaagccccacctttgtcctgctcatgggcatgacttagcagatctgtcctcagccccttgggctctagtgccttctcctgtatcctgcctgggactcccatgcggccatgctgcactctgtgttctcagacataagcagaacctctgggaggaagggagaggcggtgggcagctgtgagccccgtcaagtgtcctggcccagttttgctccgggaggcctgagattaaagttcagtcgtgcaggttctgcaccacacaggggttccacgactaaagggcactgtccatgctgtggacattgaagatttgaacattttcatcaccaggcttaggcagcatacacccctcccccagacctccctggtaggcaggactccagaagaagcacaacatcaccatgaccacagaatcttcacgtctcatgcagatctcctgccctccacatggcatctgagtgaccgttttaaaatgcatgatgaggccgggctggtggctcacgcctgtaatcccagcactttgggaggccaaggcaggcggatcacttgaggccaggagttcgagaccagcctggccaacatggtgaaaccccgtctctactaaaaatacaaaaattagccgggtgtgatagcaccctcctgtaatcccagctattcaggaggctgagaccagagaatcgcttgaacccgagaggtggaggttgcagtgagccaagattgtgccactgcactccagcctgggtgacagagtcagactctgtctcaaaaaaaaaaaaaaaacaaaacaaaaacaaaacaaaacaaaaaaaaaacaaaaaaaaaccataaaacaaaaaaaaaatgcatgatgggagcccctgccctctcccacctctcctatgccgtccctgcctcagactctgctcacctcccacccactccctcccctgctgtttcattttttctctttctgctcattccctccttttctgtctgtccgtctgtcttgtgtcctctttctgtccaccatggctgtttgggtttattctgtgctgctgccgctgcctactttctcctctcaacctcttctccttctctgtgcagatgtgtaggcacgctaaggccggatgggaaggccgtgtgacctaatgtttcatgtcacggccacgccttctcgggtgtgcagaaggtgagctctccctcggcctcctccactctcccctcttgcccatctcttccgtcctccctggacactccagcagcaggccctgggatggaaggagggactagagaagcccctccttctcctgcaggggaacaggactctgaactttggccaggacacttgaagatgccagagaaccccagcctctgaatgacctcctgtgtctctgtccctatgccctgggcatagcggataccacaagcgagagagaagcttgtggtctcagcttcttccctgcaccccgcatcaagagcccttatcccaggcagcacagctcttggcagtgctttctatttccttaaacatccaggacctcttccctctctctctctccctccttcctgcttgagcaaggccaccctcgcaaatttagccagcagccagagcagggagaactcttcctgccttctccagggagtccagaccagagccctgcctgatgcttctcaaccaggctgccatggacagttgtgcaggttgcagactactcacaagtgccacgtgtgtgcagtggacaatggagatttgaatattgattactaaagtgatcctgcagatggcagtgaaaatgtcttctaacaaaatcagtaggacattttcccagtagaagtgcccttggggaagaggtaaaaaatgatccagagacaccatatgggctggcagcagccctgttccctgcctggttgggcacccaagaccctccggaacttccttccagggctcattggtgcgggccagagacaggagaccagccccgtctggaggctgtttctcataggtatcccccgagcctgcccagcccctctcagcccctcctctggccttccttctgcttcctctttgtccttcccacatctcctgctgctgttcctgtgcccctcccctggcccctcgcagccagggtgtgaacagcttctctcccttgccttggttggcctcctggcccaatagccacgggtgtgcacctgcccgtgtccgtggtcaggctgagctctctgctatggtcttttcccctcttcccaaagctccttccttctcttccagtctctccccttctccttcaggggtctgtcccgggcttcatgcccattggtgctggccttccctgtctctgaagccttctctgtgtcctggctggtgacaaagcttggaagggaatgtgagatgcgtgtgggtgtagtgggtatgaagtgggtgtgtggtatgtatgggtatggggggttctgaggagtgtgtggtttgaggtatgtatggtgtgtgggggatgtgatgggtgagatatggggtgtgtgtgaggtgtgtgtgtatggtatggatgtggtgggtgtgaggtgtgtatggggagtgtggtgtgtgtatgtggagtgtggtgtgtaaggtgtgtgtctggggggtgtggggaatgtggtgtggaagggtgtagtgtgtgaggtgtgtgtatgaggtgtatggggtgtggggactggtgtgtgtggtgtgtaggaggtgtgaggggtgaggtgcgctgtgggtgtggtgtgctgtgggtgtgaggtgtgtttgtggtgtgaggtgtggcatgtgggtgtgtgtgtgaaggggagtgctgtgtgtgtggggtgtggtgtgtggtgtggaggggtatagtgtgctgtgggtgtgaggtgtagggtgtgaggtgtgtgtgtggtgtgaggtgtagggtgaggtgtgggtgtggtgtggttgtggtgtggaggggtatggtgtgctgtgggtgtgaggtgtgtgtgtggtgtgtgaggtgtgtgtggtgtgaggtgtggcatgtgtgtgtgtgtggtgtgctgtgggtgtgaggtgtagggtgtgtgtggtgtgaggtgtggcgtgtgtggtgtgtgtgtgtggagtgaaggggagtgctgtgggtgtggcatgtgtgaggggtgtgtggggtgtgtggagtgtgtgggatgtggatggcgtgtgggtgacagcctgctccccctcccaaatctcatgccacctccccatgcccccttccctttcactcatccctgttgcaaccatttcacgctgcttttgtccacacctgagggcaaggtcacagctgggttggtggtagtggtggtcgtcctctcatgtcctggtcaggggtctgacccagagttgcccccaccacttctaaggtgactgctttgagctgagcaggcaggggaggggaaccctacctcgccttgtgtggtggggctgatggaggagaaggactcttgctgactcacacactcctgtcttgtctgtctccgggctggcaccgatgaggaaagtcttccaaaacccgtgcccagtgccctccatcctctccactgtctttctgtcgcccaaccttgtatggtggaatgaaaaggcaacagcgcctaatgtgtgtgtgcacgtgtggtgcacagctcgtgtgcctgtacaggcacgtgctgtataataagtctgtgtactgatttccctcattagatgaggaccaactgctgtttgacaggtgggttttggttctaattctttctctgcttccctctcccctcctcttcccttacagggacttagaatggatggagagcattaagattttgtttatgtagcttgtgttttagagttcatggtctgctgtttctgagaaagaacacttgaaggcttggactcgatctgagagaaattcatgagccatctgggaaaacctaaaaaaaggagccggcagtggctgcggtctgaccagtgccctgctctgccccagatctgagcagggcaggtgcagtcacaagactgccggccaccaaggttttcttgagcagcagaaacttgaacatgaggtctgtggggggaaggcttagcaaggccttgggaaggggcagacagtgttgtggagggaggtgaccacagcttgtgcaagaagcttcggggtatgcaggcggagcctgcagtaggagaggaagctggcaaggtgtgggctgcctgaggaaaggggccagtttccctctgcctggtcacccaccctggcccactcaccgtgaggaagctcggatgcctggtctgagatctctgctgatctggggctctcttagtaggaaccctgggcttggtggctgactccggacagagggaaagactgggcagtggacagctgtgggaagaagaaaaaagcaggtccagctagatttgggaacattttggctacagatgacatagatgagatcctcgtggcattcatgtgaatctgtgggttgtgggtggtggagccacagcacatcatctggccacgtttgggtgttttgatgtcaccttgaggacagttcctctctagactgtgcctgtatcaggcaattggatgctgattattagggtagcagtttggcttgggatagctaagtactccagggataataatagttcatatcttttaaaaaataactccagggataataatagttcatatcttttaaaaaataactcttgaatatacaacaaagtgtatatgttaagttgtataatagcgcagcttaaagtaggtcataaaaaaacatgaaaattcaggttgggcgcagaggctcacacctgtaatcccagcactttgggagttgaggctggtggatcacctgaggtcaggaatttgagaccagcttggccaacaccgtgaaatcccatctctactgaaaatacagaaattagccagacatagtggcgcatgcacctgtaatcccagctactcgggaggctgaggcaggaggatggcttgaaccttggaggcagaggttgcagtgagccgagattgtgccatcgcactccagcctgggtgacagagcaagattctgtctcaaaaaacaaaaaaacaaacaaaacaaccatgaaaatacaaactaagggaaaggaaacacagatttctagtagtcttctcctttggcacttggaagcaacattttgctcatttccagagaatattttctgaagccatcaattatctgttacatctgttacattatctcatgaagccatcaattatctgtgcatctgttacattatctcatgtcagggcacctggttcttcttgctggggccagagcagcccatctcctcttcaggaatagcctgaagccaggtctctcccggggttctcttctgaagttgcttctgaagctgcttcagttcctgaggttctcagggaaggaatctttcctcccctagaacacatctctcctttgaacttctggactaaagggttgtctttgagattctttatgtacttggtggttctgggtgcctctctcctagatccctcagagttcatggggttcttgtagctgtgagaggaaaaagctagaaaaccaggagtttgcggtgatggggaaggcctgtcacccccagcggcctttccttctgctcccgggatcgtgtcccgtgggcctaagcctggccttcccagctgacctcatcttacttctcaggctgaggctggtgggtgatgaagccgccttcatcaagggaccacgtggaagcaggtccaactcaccacccagtgggcttctctgtggtgcatcctgcctgtagggggagtcaggctgcgagagaaagggagaggatgaggttctgaggattctgccgtagtttttttagaaaaatcaaatctggacttcaggaacctgcttcctgaaggtaatgtaggagctgggctgtctctcaagggaacccggtggagtctgcagcctggcctgccatacagaaagcactcttgtgtctcccgtggtacttgtgtgttatttctgaaggctggttcactggttataatggatggtattctcagtcagtctccttctggagaggccatcctgggagcaggtggctgagactctggcttgggaatgcggttggatctttgtggaaagtccccaggaggcccacccggaatctcccccagacttcatccagaagggagcccttttgaccctgactctggagtagtcagcaggctcttggggatgggcgaggctcttgaggtcccataggacacatgtaaaatcccacaaatgcagaccttagtccaccagtttgataaattggcacacatcagattttatgaccatcgagccgatggatcaggagagtaacaaggtgaaggtggctttatccatgaaaatcacagccgcagttgcttcgtgccagttatgagtagctgccaaggggtttcagctgtttgagtggcacatctctggcatagtcttccggggtggcacatcctcacaaaaacatcagcctggaggaggacacgcgggtctctctgcagccccctgccccagccttgaagggaagtagtctggggcttccggcaagctgctccccagtcagtcccatgaggctgctggcctggttcccatggccccacttgctttctggggctccaggtctcctagacaggctccaggaaaagcatttccctcttcgttgcttcttgggattccccgtgggtgcttgttggttctcgagagagatggcgatcagtcaggagttgtgggtgagaagcagtcatggcatctccaggacagggttgagttggggtcagggggtgagggcctaaggatgtgactccctgtctcagtttcttgaggcccaggactcaaagtccccacctcaggggactcttagaccaccctctggccattcccaccttctccttattggttctcccaacccattctgacaccttgctctgcaggtcatgcctcccttgacctccttgactgtgtttctgacaaggcctttaggatgatctcattctgccccttaccccctgccccacacaccccagcatagtcatccatccacaaagcacatgatttggtgggcggattcgagaagttcttcaaggaaaaaacatttccgtcttccatcttagtcattccttccaattctaagcacgttcattctcaggaagctcttccttacaaccagcctcagttcatcttgctgcagttgaaacctgttttgtcttgttcatcaaccagttgtgaggtcctgtctttcaacctgttaatccagggatcatttttcatctgcagggcacccttctccagggtctcaggatgcatgtctgtcttctcacagatatcatcttctcccacccccaggctgtcttcctttctaccctctggcccccaaaaggctttgagttcacttcccccttggtgtagggttggaatgtatgcaagaacacagctggattttaaaaccacctatttgaagtggactcaggaatgctgggtccctgctggtgttaggggtacagtagcccccacagctgcagaaggcgctctcccactaaggtttcttagtctttgcctgggattgccattcagtcccctttccttccctttgctgctgaggccatcttgggtccctgctagcccagcacgcagcgcatgatgtgtgcttagctgtctggaagaggcctgtgctgggtttgctgggcattgagcccatacttggttgatccggaagtctggacttgggtgcagtagaatgtccgtcagttttctctaaagtgcttcaggctttgggccaagagccttgggagattctgcagggatcccaagaggtcccatgatttctcagtcagcactttatcccaggactcccggatttgaattcccacatctccaagaccctggaaaatccagccagaggtcctaagccttgcagttccagtgcctccacttggaattccaggatgggcatgaattttctcacctctccacctgacctgagtattttgattatatcagtcattggattagtttcttcccaacctgcaggttgggccttaaactcaggctgttctccaggggcccagttcagccaccaagacctctgtccaggctcacttgacccatgggacctggccatgggctggcaaggaggatggtaaggagagaggaggaatgtgacctcacagccttcttaactcccttccaaccacagggagctgcagggatgggaggggctttgtcagcacaggtgtgtaccaggtgcccctgctgctggggctggctggtcgtgactctctctgtcttgttgccaggcggagacagcagccaatcgcatctgcaaggtgttggccgtcaaccaggagaacgagcagcttatggaagactacgagaagctggccagtgatgtgggtacccccgggttcacctggcctgactctagcaagagtcagtcccctagaacgtgtacctccaagtctttccttggagcatagtctcaggcttgtatagtctctgatcccaatactgctagtccagggcagcctgagctctgttgtggctctcccagaaagtagtgaggtgggggcagaggccagtccctgagttatcatgagcctaggatatccctttgcctctcagagtcttcttgtttttttcacttgtcaagtgagagttgagccaggggatgtcaaagcctttccagcctagtgtactcttagtctgtgagttttgcttcagtgagaaaaggagcacatctggttctaagagggtgagggtagggttttcggtaaattagtgccggctcaggctagcataacagctaccaaaagtagcggctgtcccctactgttcagggaacaggatggcacagtgctgggtttcctgttctgccattggctacatttaggttaagcctcctcttcttgaaagaattcagcccgttgagctgctcagcccagcctcttggtggatctgctgcccagcatagtaagaacgcaggttctggagcccaagtgcctgggtttaaatttctgccattccagccaggtcaccttggcaagttacaggacctggtagggcctcggttgtctcctctgtaacatgcaggtgatcacagcccttagctttgtagtgtttctgtggtgattcagatgagtccatgtgtgtgatgtgcctggccccctgcaggtgttcagtgtattcctattgtcatgtgcacccctccaccttctccaccaccatcaccttggcccaaggaaaacagtccaggccgtgcctgcttgtgctccaggccagctctctgcccagaagccagcctcttcccttttaagtcagagacccacattctagattcttaggaagtcagatggcaagaacttctggaaatagctgttaaccccctccatggtatagatgaggaaactgaggcccagccagttagaacctggtactaaaacccaggcttccttcctgccttttagttgcactaacttcacaccaggtctatgggtcttcccttagcaaagcagggaggttgagtgacgtgactgtgagtcgatgtaccctagtagccaggcttcacgaagcctgtggttctcagagggaacaccctggaagctgacttcatggcctgggaatgtcagtggttgggaaggagtgtgctattaggagagaccccttccccatgtgggagggctgttgggaggaaagggaggctggccctagcacactccctccccgcctcctcacctcctgcccccaccgccttcccaccctagctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggtgagcactgggggtgagcctgggcccccagactggactgcctccacctctgagctgctcctagttgtggtcaaattcagctttatgggggtgcggatgggcgtgtttgcttctacctacatacactgctccagaagtcacttcccccttccagttaccacccaggctcaatcccaaactcggccatgtggggcagccccctctgcccagaccattctgggtcaggcttgcccttccagacccctgagcatctactccagacctccctctcacaaaaaatcatccctatgaacacaatgcttttgacaccctgaaccaaacagggcataattgaatcgcagtcaagttgatttctacttccatggaatcttaagtagttaaaaaatattattattgaagtaatagttttgtgggtttttttgggtagtatatttcaaagatacaaataagcaaaatacagaacatggaaattactgaaaatcttactacccagtatcaactttaaaaaaaatgattttaatccttttggttttttcgtgtaaatatttgagggaatcctaaagtgtatgtatttgaaattgaacattttttcccggtttctgtactcaagtgtcccctgacagataactaaagcctgttttatataataagctgctttaggaaaacccccaatctcacattatattctgaccagctttccatgtcataaaatactcttcttttaggttatttttgttattcatccttcttgaccctgtccccacaacttagggaaaaatttcataagccagagaaacacacagaagaaaatgtaagaaatttgccatgacgcagctttttgtccttaagtgaaacaagtaacaggagtgtcacgggcacatgacaggtctagaaggggagggtgaaaggcagacagcatcgtggggagacggcagcccagggggtcatggagggagaatacattgcaagtgggtatgcagtttggaaaattgcagtcatttcggggctccaaggctgaatcagtagcttttaggtggccagagccactgctagcctaagggtgctctatgagaattagacaaagtaccctttctgggggacagatgtagcttggcctggggacatgtggggagggtggcttgcagggtgcagccccagtgactgtccagctgggcactgttgcacaaactggaggcatggccctgtctgaaggggcgtgtgggtttgcactcagcatctgtcctcccagaattctggccggctcacccaggccggggtctctgtaggctccaggttattgcccagaggcctgagtccatgaatggatccaggacagtggggaggctgggcagctccagtgcctgcttgcctcattgcacattgttggtctgtttacctcgggggccctttgccttagcacatgtgtgacctctgtgatcggttagagtcctgcgggaaaccagtcctagtcagggagagtctggggccctttccccacagggctctgttctcaaagtcccatagctgggtgaccaatgtagatgcaggtcccatgccttgcccaggaggcctggctcctgggagcccagaaaataccagtgggagatgggaggtatggtggggcagcctggctagggtggatatggggcagagatagggaagaggctcttcctggaaggcatggggcaccttcaggggtctagggggctaggggacctgaagcctaggcccaagccagaccctgaccctgtacctcccatccccacaggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggtgaggccagcccagcctcctgcctccccccagggcttcacttccctactcttcagcccagccagcagccactatgctattctttgcttttcatttgtttcatttggtctcttactagttccatggctttaggcaagttcattagccttctggtcgcctcagcttcctcatctgtaaagtgggaataataatagtaccaacctcacaggcttgtaagaattgaatcagttaatacataacgaagttctgaggagagttcctgcatagtgcagtgctgtgtgagtgttcactttgcagtcaaatcctctaccccgagtgttcactttgttttttagttttatgggggtttttttttgagatggaattgtgttcttgttgccaggatcgaatgcaatggtgaaatctcagctcactgcaacctccacttcgtgggttcaagtgattctcctgccctagcctccctagtagctgggactacaggtgcctgccaccattcccagctgatttttgtatttttagtttcaccatgttggtcgggctggttttgaactcctgatctcaggtgatccatctgcttctgcctcctgaagtgttgggattacaggcgtgagccactgtgcccagccgtataatgtcatcttaaggaattatgtctgcaaagagcctgtttccaaataaggttctatcttgaggttctgggttgacatgagttttatgggggaccccattcaacctaattcagtctcctcatgggttgttgtgaggcttaaatattatagtacattgcatgcttgtggttttcatctcttcagctctttttcctctatttcctggcctccaattacagtgaaccagcctttgccttagcacatgtgtgtccctgttgctccaaccttgaggctcttgggggcgtgtctggtgtctgcttattggcagctaaggtgaactctgaagagagaggatcatacctaggatagtattttccccagaacctggaccagggctggaggtggggaacaggctgcctatctgctggggcccctccggccatttcagctggagcgtgggacagacctattggccggcggagctcaatgccctaagactcccccagtcagccctgttttgtactcctcagatcttaggttggagatgagaaggaagaaccataccccaaggccatttgggagtggcttggcttggtgtagggcagcggtccccagccttgttggtaccggggaccagtttcgtggaagacagtttttccatgcagtggggaggaggcagatgctttcaggatgactgttctacttcagatcatcaggcattagattctcataaggagcacacaacctagatccctcgcatgcgcagttcacaataggatttgagctcctgtgagaatccagtgccgcccctgacacaacaggaggcggagctcaggtggtaatgctctcccacctgctggctcacctcctgctatttagcccagttcctaacaggccacggaccagtaccagtctatggcccagggggtggggacccctggtgtaggggatgggagtgtgcttgactggctaaggggggttggctctagttcccctttgtaagtacaaatgctgggctttgcacacaatggtaagaggttgctgcccccacatccactgtgcgtgtatggagttatttatccagacgtgacgggcagagtggaggaggcacagtggggattgcactgattcatcacatgcttctgtcgggtccagctcacagccaaggtacaaagcaaagattgacctcgttgccttgccagccaccagcaggggcatgagaagtgctggcatgctggcacagcctctggggaaagcagtttggccacatgtattcagttctaccaattttactacactctgacctgggaattccatttcttgagactgtctaaagaatctatcctgggcgtgaggagtggcagcggccaggcagcacagtttcgcaaaggctgtcagcatgccgcggcccgcagacacctggcacgcgccctccctgccgccaggatgcccaaggggaaggtcagctctgctgaaggagccgccaaggaaaagcccaagaggagatcggcgcggttgtcagttaaacctcctgcaaaagtggaagcgaagccgaaaaacgcagcagtgaaggataaatcttcagacaaaaaagtgcaaacaaaagggaaaaagggagcaaagggaaaacaggccgaagtggctaactaagaaactaaagatttacctgcagaaaacggggaaatgaaaagtgaggagagtccagcctctgatgaagcaggagagaaagaagccgagtctgattaataccatataccatgtcttatcagtggtccctgtctcccttcttgtacaatccagaggaatattttttatcaactattttgtaaatgcaagctttttagtagctctagaaacatttttaagaaggagggaatcccacctcatcccattttttaagtgtaaatgcttttttttaagaggtgaaatcatttgctgattgtttattttttggtacaaccagaaaatagtgtgggatattgaattatgggaggctttgactgtctcgggtgtcagcttaacattccatagatgggggggttagtttttatatcctataatacaaagcatattaaatggcaatatggagtcagtcctgcatttaatatcttgaacattttaaattacttctgttgccatgttgttttttagtagaattgtttcctaaagaaaaccactctttgatcatggctctccctgtcagaattgtgcactctgtaacatctttggttgtggtagtcctgttttcctaataactttgtcactgtgctgtgaaagattacaaatttgaatatgtagtgtacgtgctattcagttgtgaactggtgggccgtatgtgacagctgaccaacatgtgaaaatactggtacttgatagcctcttaaggaaaatttgcttcccgattttaagctggaaagtcactggaataactttaaaaaagaattacactacatggctttttagaatttcattacgtatgttaagaattgtgtacaaattgaaacgtctgtactgatcttcaaccaataaaatctcaattattaaaatacaaaaaaaaaaatccatcctgaacatggagacatccacactagggcaagctgagggcccagcaactcacagtagggcagtgaagggttaggggagtggacgtgcagcctttctgcagacgtctacatgagaagactatggagccagggcagaaattccaataatgtgccgccaatttttttttttttttgaaacggagtctcgctctgtcaccaggctggagtgcagtggcatgatcttggctcactgcaacctctgactccctggttcaagcgattctcctgcctcagcctcccaagtagctgggattacaggcatgcgccaccacgcccagctaatttttgtatttttagtagacatggggtttcaccatgttggccaggatggtctcgatctcctgatgacctcgtgatctgcccgcctcggcctcccaaagtgctgggattacaggcgtgagccaccgtgcccggcccatgtgctgctaaatattttaaaagcaggaaacataatttatatatgcccaaagaatatccacataaggaaagactgaataggagtggataagtaggcttacctgtaatttttttcctaagctttatatattaccattctgttttaaagaagaaagagtagggggaaggaaagaaatgccacctggggacacaaccttggctcccagcccagccttatttattgagatgggccgagcataccagcagcagagggttgggtatgtgagtgagggaggctgggccagcccccatcctgtgcctgtcaacttcacaaggcagctggtgagcgtcgtctaacaatggccctgggaggtcatttcttgttcctgctttcctcctgtggaaacaaatttaagaaacgcaagacctgcttgtgccctgtagatagagggcagtgtgtctgagggtcagagaaggcgctagccactgtcgggttctgtgcagagtgcactggacacactgaccgagggaaggggcccctgcagggctgccggcagccagtgacggtaactggggacattctaaaggcagggtactcctgaggtgcttgggttgtttttttcctggttataccagagggtgtggatggctgtgtttcccgctgtgtgtatagcgtcatgccctatgcattcccacagactcctgcatagccttcctgcgtagacactttcatggccttggaagtgctctgaggagagtgcttttccccgttgcgccggttggtggatgttctagttgcacatctgcttttgcaccctgcagatccctgcacaatgggcacctccttgagaagcacccccagaagtggagctcctggggccctgaggggtgggcggttgggaccaaggagatgcttctcactccagctcagccatgtggccctctctcaacccaggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaagtaggtggccccagacacccctaccctgtggtgaggggctgaggctgggctttctcagctgctgggggaggtgggggtgtggccgtggaagatggggagggtgggtacaggtgggtgcccaggtggggagggagtcaacgcaggagacaaatatctctcctggtggggaaggagcccgggaccactgccatcctgttaaaggccaccagttctcgcctgtagctagtacaggagcagagggtgaccaagacttggttctgagctttctcgttgggcctcgagggctccctgccattggccattgaggtgaaggctggtgtcacctccagccatgactgggaaaggggtcttctttggtctcctctctgccagtctcctgaaagaggggaggggtggaaggagtgcctggaaggtctcttgaagggagcgcccctggctcttcccagcaccaccagccaccccactgacagcctcagagagagggagatgggccatgaaattaacctgggtcccctgacttccttgtctcttccctccccagtgagctggactattatgactcacccagtgtcaacgcccgttgccaaaagatctgtgaccagtgggacaatctgggggccctaactcagaagcgaagggaagctctggaggtgagaggtcccagagggagatctaggcccatatccggcagccctgtggtgccccttcctgcttcttgactctctttgctttgggctaaaagactctatggcttccccagacctcccccaaccctggcctaaatgtggaagattcactttggcacaggatttggactttgccctcatggcgatgcctcctctcttgccctcacatgtctcatcctcccagtttagtgtgctttacagcccaaccccagccatttgagaaccctcctattctacacaccagactctgggacccaggccaggtgactgtgatgtgagatggttcatacagctggcaggaagagcttgttctttctgcctgattgagtcagtgcttctagacctggggctcaccaggaggatcttgataggagtgggggatgattctggacatcactgtactaacccttaccctatttggcactcccagcggaccgagaaactgctggagaccattgaccagctgtacttggagtatgccaagcgggctgcacccttcaacaactggatggagggggccatggaggacctgcaggacaccttcattgtgcacaccattgaggagatccaggtgagccccacctccactccccggaggctggctcccctggggcccctggcccatgctctgtgggtcacttttgcaggactgccccctgaggaagagcatcctaaggattttatagacccagaacctttgcatttgacttattttgacaagataatatatgtgcatgatctaaaatttaaaaaaaattaaaaaggtttatgatagggtctccctctgactccttatcctccagcccctagttctctccccaaaggtaagaatttgactacagtctctgcacacaagcaaatgtttgtttccatgctttgtaccctttttgtataaaacaaaaagtaccttttattatataccatattctgaaccttgatttttatttattttatttttttagagacaaggtctcactctgtcacccaggctggagtgcagtggtgggatcatagctcactacagcctccaactcctgggcttaagcgatcctcctgctgcagcctccctagtagctgggactacaggctcacatcaccatgcctggctaattttttaatttttatttttgtggaagtggggttttttctttgttgctcaggctggtctcgaactcctggcttcaagagatcctcccatttcggccttccaaagtgctgggattacaggcatgagtcactgtgctcagccatgaaccttgatttttaatgtaacatttatttggagctcatttcacatcaattagcagcttcctcaatctttcatgcagttgcagaatactggatttaaaaggttttgccaggagctaaggaagctcatgttgtgggaggtcacctgggtagtgagcctctggagcagcccttctccctgacctgtgaggtggtgaacacaccagagaggttgctgctaatttgaccagccctaaggatgaagctgttgcttttgatgactgtggcttcaccttcctgtggccatacctgccatcctggttctcagccacaagaatctttgaattgatgcctcctggtctcccagctggtgtggaactcaacctccatggcccttccactcacttctagcgctccctttgttcctcttgcccacatattcccatctctgtccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgagttgaagggcatgggccgagccattgtaagtttcataaaggcagggatttttgtccattttaattgatttttgtcaatttcatttaaaattgtcatatagtaaacactcattgtttgtccaaatgtcaaatgactgggtttccagaacaggttgacacctttactcctgttctgttactgaccggcccttccccttctgggtcctccatttcctcatctggcacatggacagatggctgacccatcctgaaagtcgccttgttgttcctgccccaggtgcggcagctggtgcctcggagggaccaagctctgacggaggagcatgcccgacagcagcacaatgagaggctacgcaagcagtttggagcccaggccaatgtcatcgggccctggatccagaccaagatggaggtgggtcccatgctgggaagcagtgctggggctcccacccctcccccccgacactatcctagccagccaggctgcctgtctccctgggtgggacccatggaggactgaggcccggagcccaccgtgggtctgctgttctgtagaaggctatgggggcctatgtgaagaagccctgctggcagtatctgatttgggagcaaagacatatgaggacaccactaagaagctgcctgtgggctcacgcctgtaatcccagcactttgggaggccgaggcaggtggatcacctgaggtcaggagttcgagaccagcctggccaacatggtgaaaccccgtctctactaaaaatacaaaaatcagccgggtgtgatgatgcgtgcctataatcccagctacttgggagcctgaggcaggagaatcgcttgaacccgggagacggagattgcagtgagctgagattacgccattgcactgcagcttgggcaacagagcaagactctgtcaaaaaaaaaaaaaaaaaaagaagctgcctatgaaagtcccatactagggtcagttcctgagcgcccgatccagcttaatccccttgatgtctcttgttgatcaggcctccccttcctctcctcctcctcctgagcaatgagcctggccaaagaaaatgattgatcttcccagaaagagaactgaaccccagtagagcatagaatttttttctgaattgtgtggggtagatagtggggtgctttagcagatcaggaaagaggccctgcttggctagagcatggcctctgagttccttaagaacagagaccatgttgagttcacattggtatgtgtcgctcccctgcacccctgccagcacattgtccttagtagacaggcaggaaatatctactgaattgaactgagtggacagaaagtgctttcacaaacaatggttgtttacatggatgaataacagacagaaatgggcattaggcctggcctgcagggatgaatgggattcaggtgggccagggcaggcatcccaggaggcggaacagcaggagcaagagcatgggtactgaggaggtgagtgaggtctgccgaggctacgaggatcctggttcagtgggtccctgagatggacaagacttgggaaagggcatttgaatggcaagcagaggagtgaatatttaggttagaactgaccctgcatcccctttctgaggctgacaggtacccgagagttggtaggtatttcatccaatgataacagtgcttgttatatacctctgtggtgctgtttccatacctaagagcacccatgctaaaagtgtcttactaattaccagtgatggcctccttagggctgggatgggaactgagaatcatttgagggcttaataagtgattttggaggccccagtccccaccctatgggagcagagtgaggtggtctgacaaggtgcttccttcccggtgagcaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggaggtgggtggggctggccttgttcctcttcgggagcccgtggccccttctgctctttctcctgggtggggaagtctccaagggaacaggtcatagttggaggataaattaacttcacccctgaagcctcacatcttcaatttttagtaccttctgctttcccaaggaatgtgttgagaatgcacatttctaggccccatctctagaatttgcttcactaattctggggtggagttcagaataagcacttctggtggttctgggtgctggtgggctccaaacactggctcaggcatctgctttgaaaatggctacttgttttaactgtgcaagagtgtgtgtgtgtgtatgtgtgtgtgcgcgcgtggctgtggggttggaggttcggggaatcacacatttttttgtctcaatctttcctacccccaaatctgccctccttcctgacctgacccccattggcaagtcctggtttctttgctctcccaggcagaggctgccaccctgccccttggtcatctagggtccttgtcctagtaggttgtccttgtcctggttccccttcctctggtgacactcagccacacagaaggccaagtttgatggctttggccattttgatggttggggagtaggatgggcaggggccgccaggagcccaggcctgggacccctttgctgacaggccccttgccgtcctgcagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggtgagagccccatcctgtgctttcttagtgcagcccccaacccctgccccagggccctggagggcacttccccgggacgtgggctgccatgcaagtgaggagggagagaaaggggaaactgccgtcagcctgccctgactcaatgcaccctgcaaaaccagccttggaaaacctgtgttggtgccccataagcttccctgctttccgggagagagtgttcagactgtgggtagaaagaggacctttgacccctgatccttgctctcctaccatgaggagtcaccctcagtgaaggcttgctgctccctggctgtggagacagaggagcagaagagactcctcctgccctcgctggcccctacccctaccccgacctccagtggcctctgggactctgctggggatgtcagaggccttggtcctgggttcccatcccagctctgggtcaggctgggttttagtgggctgccccttcccagtgccctggggcttgcgggcggtcccaaggcgtgggagcatgggcttgggtgctgcccaccaccccacctgcttcatggctctctaggcacctggggggaagcccctggggaagcgggggggctgggtcacttctgagggagcttctcacccttgtggctcatcacaccccactgtggtcctgctccctggagcagggctgcgtgtgctggggggagggcaccccctggagcctcgttggtgtgtctaaccgtgtgcacttttatttcccctcctcccccgcccccccaccctccctccgcatgcctgtccctgtgtctccccacacacgccaccctcccccggggcatgcccccctcacggctccacctccctgacaccgcatggctcgctgcctggcgcaccgcggccccaggatcactccggcacactgggtcccgaggagttcaaagcctgcctcatcagcttgggttatgatattggcaacgacccccaggtactcgcctcctgcatggagcacgctcaggggtggcgtctggggcaagaaataatgcgtttttcctttttctcttctctctgtctggatctcctgtccccctcctgtgggccatggggctcgtcctctcctgctgtctctgtctgccccatcactggtccaccctctgccctctgctgtctttcatggcaacctactgggtgcccgctgtcttccgtcctcgctgctcttcatcccatgggtggatttttgcatctccctgctctgtcttcctcctgtctttggacatttccaccgatgtgtgttcgcatcttctcctatgttcctttacctatcctgacccccaaaaccataaatctcatccccgttctggccatctgttcctgtcttcctggccccgggccggcccttcctcttcctgccttcccgaccctccttgtgtcttggtaccactgccccccacagaagaagacaggcatgatggacacggatgatttccgcgcctgcctgatctccatgggttacaacatggtaacgtaaaccccaccctctgtctgccctggtgagaaggcagccagctggcgggagcagccaagtcccaggagtggcaggctggaggccctcaggctaggggctgccctccctggaggagccccagggcccatgtccttggggaagatggctccctgaaagccggcccggccacgggcgtgtgtgtatccgggaggcctgacctcctcgcctcaatctctgtgccacttcatcttctggtacttctcactcccactgtggacagctgggctgaccctgaggctggcaggaaggactggtggtgtgggacatcccaggtttcgggctggcatgcgtcacctcacatggagcatggaaaccgagacttccacctctgtcctggcggtgactctggttgggcctgccgcccctctggattgtcccaggccgtcccccaccccccaaccttcctagtctgtccccccttgcacagacattctgagcagagcagtcaggtgactcctgagccatggtgccaagtgcagagcccacaggctgtccagcgcagggcatgggcatggggctaggagcagtgaacctgggagtaaatcccagccctgccgtcattagtgtgttacctcaggtgaagtgggggaaccctacaggactgttacaaggattaaatgaaggaatttaagtgtgtgcatgtatctggcatgtagaaaatacagtgtggtggggagagaacagattctagaaccagactgcctgagttcaaatcccagttctgctgcttcctggctgtgtgaccctgggcaaatcacttagcctgtctgggcttcagatttctcatctgtacaatgaagataataaaatacctatctttatggttgtagtaaggattaaatgaattgaaataaagcttttagattaatacttgatatgctacataggtgtcagccattgttaatcattgttgtcattatagttattatcaacatgattatttgctctaagaggaactcaggcatctgcagggtgtggggaaccctgagctgggtctcccctgttgggtgttgtgtccccatcatacccttaggacaacccaggttaggtcagggggatgtgcccttctcttccagccataggctgctctgagcccccagggtcttcagtccatatgagatattcccagcaggccatgggctgacaggcctgggtttggctgttccctccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaaggtgggtgtcctatgggtgggcactgtgctggggtggcaggcactggctggactgtgatctaaaggggtgagagctggaacatgaactcctcaaccgccccttcttccagggtcctttggcctctccttgtttgccacttctactcatttctgtaatgtcttgggctcagctaaggtgtcaggacacaggattagtataagtgacccttccaggatcactgcatgccagtgagggactccatagctgggatgaaatgacgggtggcagatgagaatagagtggtgtggatgtgtgatcggactcttggagtccatctgacaatccctgggacttcacccttggtctcatcccgcgcatcggcacggactataatgggagcaggaagagggactgtgggacccaggaaggaagcatgtctctcgtgttttctaccctgagcagtgatctactctgggtttcccagtctcccaagtaccctgcaacactccacctggcagtggatggatgcagggggttgtctccatggatgccagaggctcagtccaagtctccactgttctgagatggtcattggtagacctggatgttacccagaaccacagccatctccagcccagggacctgaggggatctgtagaagccacagatccctcgaatattagagaaaagactcacagagcagccagaagaaatggtgggggtggggtgggggcctagggtctgtgttctgttcagtaaaagtcacagtaaatccttatgccatccttccttcaaaactgaaaagattcaggccaggcacagtggctcacgcctgtaattccagtactttgggaggctgaggtggatggatcaggtcaggagttcaagaccagtctggccaacatgggaaaaccttgtctctactaaaaatacaaaaaattaaccgggcgtggtggcgtgcacctgtaattccagctacttgggaggctgaggcctgaaaatcgcttgaacctgagaggtggaggttgcagtgagccaagattgtgccactgcactccagcctgggtgacagagtgagactccgtcttaaaaaaaaccttaaagaatcagttagcgaagcaaaagccaatagggagggaatataatttctggaatgtctgtctataagggaataaaggctgaacctacaaagaagtccctaaagttctgatttaaatacaagaacaacgttatttgcatcatagcactttggagctggaaggatcctcaaaccatttagttgtagtggctaattttgtagaggaggaaaactagggcccagctaggggcctggtctcccaacttttggcttgacagtggcagctctaccctccctcaaactggttcccagggcactctggcagaggtagggcatggtgcagggcgactaccttgtgggtcagagcccccaaatgagctctcctggatcttgaagctcctaaaagaagcagcttccaagtagacctatcatgagcaaacctgggagaaggtagatacccaggctggagctgcttgcatggggcaaggcccgcatttctgcaaagctgcttaacatagcctggccatatttgggaagcagtgatgcccaaacatggatggtgttcttaatctgctggagggctcattaaaattagactgtctgtccgaggcgtccagagagctcagttgagtgcgtgtggggtctccccaggaacctatacgctccaccagagtatctgctgatactgctccagcacgcaattattgcagactagtgtgattcagaagatgattataggtgtaattggcacatggaattagattggaaagtggcttacaaagtaggtactgaagtggaaaacctgagagaattttaaaaatacatgttgtgtatgcggtatgtacatgtgtggatatttacgtccgtacatcctgtagttacaggagggaggcaaaatgcaaacggcacatgctgccttcacgccgccaggctttgcggctgtgtcgggccgcgccgctttacggctgctggactttgcggccttcctgaccactctctcctcgcagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacgacaccaaacagccctgtgacatctgcattccccccactcgttttatttttgctgcagggaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgagatggtgaggagagactgaaggctttgccagttctttggcctatgccaggctctctggtacttctgcgggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaaagtcagctgtgctttgttatgctgtttaaaatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaactgtgagataatacgtttgtgttgttttaagccacttcatttgtgataatttgttacagcaaccataggaagctaatatgtgctccatcgttcatgccctggggagctggctgcctccctgacgtcagtgacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttgacccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccgttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattaatcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgcttgagcccagaagttcaagaccagcttgagcaacatgatgaaactccgtctctactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggctcatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgagagtgtgaaactttgtctcaaaaaaaaaaaaaaaaaaaaaagactctgacaaggaattcagaagagaattttagcaaatttggtttcctcttattgtccatgatacaagtctaaaaaagtctgagctctttcaataagtatataataatgtacatatatgagtacataaagaacataataaaattctaaagaaagcattgtgttatggtttaactggttacactttatagctcataaaataatggagcatctataaatctgatcatatctgaagagtataatatggcctatgggccctattgcctgtcaaatccaccaaatctggattctatatttgatggaagaggaaaagaaagatacatcctaaacttaatccaaaagcaatgtaagggatgtctggagggcctgggaaggtcttcagagtggaagaagtctgtgagaagttaacctggtgataccgattcaaagagcctgtcaagtgaagccccctaaaatggggagaataagaatcttagaggttgttcagtagaagtcttggaatgcattttcagtggttaagggaaaaaaatgactactcttaaaagttgagaaaccaaagtcgcccttacttcatccccaaactgaggagccacctaaatctgttgaagttccctgtggggtccaatccagaagccatcatagccttcagggtccatggaagaaagcagttccattacagagagcccaggagttcagccagggaaaatgctcactgaaaagcagtagaagtggaagctgtaagaatattaggtccctctgggcgtgatggctcacgcctgcaatcccagcactttggtgaggccgaggcgggcagatcacctgaggttgggggtttgagaccagcctgaccaacatggagaaacctagtctctactaaaaatacaaaattagctgggcgtggtggtgggcgcctgtaatcccagctacttgggaggttgaggcaggagaattgcttgaacccgggaggcagaggttgtggtgagccgagattgtgccactgcactccagcctgggcaacaagagcaaaactctgtctcaaaaaagaaaaaaaaaaaagattatatcccaaagctactataacttatgatagctccaacaaaaatataaaaatacaataacacatgatagctccaacaaaattatgatgtctctgggacatcataaaggagaattccttagtcagagggagtttacagaacctaataaggaactctcagagtaaagaatgtattggaggctggctcacgcctttaaccccagcactttgggaggctgaggcaggtggatcacgaggtcaggagtttgagaccagcctggccaatatgatgaaactctgtctctactaaaaatacaaaaattagccgggtgtggtggtgcacgcctgtagtcccagctactcgggaggctgaggcagaagaatcgcttgcacctgggaggcggaggttgcagtgagccgagattgtgccactgcactccagcctaggcaacagagcaagactccgtctcaaaaaaaaaaaaaaagaaaagctcaagaattatgaaagaagattactacaggacaaagaaggtctttgaaaccagctccgtatacagaaggaggtaaatcatgagattaaaaagttgctggtggcttctgttggggatgatcttcagtatcactttgaatgtctagtccttgagaaaaatcagcttattttagaaaatgaagccctaggttgaaatacagctcagctttccaaacagaacgtgtgttaatacagtgtgatatatggcaaagtaaattccttgcaagcagggtaatggcagatgagttaaccaagtcaagagcatcaagagcagttttgtttttctttttttttttttttgagatggagtcttgctttgttgcccaggctggagtgcagtggtgcaatctcagctcactgcaacctctgcctcctgggttcaagcgattcttgtgcctcagcctcccaagtagctgggattacaggcacccatcaccacgcctggctaatttttgtatttttagtagagttggggttttgtcatgttggccaggctggtctcgaactcctggcctcaagtgatccttctgcttcagcctcccacagtactgggatgacgtcaaaaacgtgatgcacgtggggccatacaggatctcctaagtgaatgggaacagtttcttcaggaaatgatagctacccagaaattattggaggagctcttagtctccttgcagtggggaagagggcaaccttactcccctaatgtacaaccccacagcacagcagagctggcattaacaaatcacaagttggcaaaagtagcaaattctcatcttctgggaaacgttggcattaactatcaaaaaaagattccatcgacagttgaattctgcagcaccccagctgagaaaatggctgaaatggttctataaactttagatccaactacctatacagagagctcacctgataatccatgttttgagttttcaccaaccaccttacttgctgcaaagaaaaattctggatgatttcatccctaggctagatatgaaaatataactttcaatttctgcagtcactgccagggagaacttactgccctttaacagtcaatatattggaggcatgctacaggtacttgcttattacccgagagtcattatttgggagctggggttcttagaatgctagaagtaatatcacttcctatttacaaagtgtatatacccaaagatgttttatgtactagactccagattaccccttcttaataaatatctcagggtaataaaagaatgaaactgtatttaaaatttaaatacagttgcattttttttctttgagcttatacaatgttttagaaacagtctactttttataaatatcaagttggatattcttgtgtgttaaactgtatttaatatttaaaatagagaatacttcccaagcaatacatgatgcttttcctaaaggactctaaaagtaaaaggttctataactttcttttaagcactaaattattatttatcttactggatattttatatgaacagtgttaatttagttacactaaagcaagggtaggcaaactacaaccatgagtcaaatatggccacacccattcattcactattgtctaggttgtttttgctctatagctgcagagttgagtagatgcagcagggcatgtatggcttgcaaagcctacagtatttactgtttgatccattacagaaaaagttttctgactcctactctaaagtaattgtagtagaaggccagagggctttctttccctttatggtaattttttgagctacaaaagagccttggataagtgaatgaagggattaatctttttaaaataaatgctgtaagttagaaaaagaataaatattttagagccaaattaacaagtacttcagcaaaacatgttagttttatgcaggggattctgtattctgaatggacacaatctgacatagataaacagattcttaactgttgactctttagcaaatgcaacacacaggaatatccatttgatatttataaaaagtagactgtttctaaaacattgtataagctcaaagaaaaaaatgcaacccatcaattaatatatattatgtaatatatactattgtatatttattatgagccatcataaatacccattgattggcctttaagaataattacaaaatatttatatcaaattatgcaaatttgttgcagaagtgcctatcagtagagaagtcttcaaaagacaaacctggtcaaataataatatattttaatgtcaacttaaaaaaggcaatataaaaatcccctcttatcacagattaccttaagatatactttctaattgcactctgtagcatcttccatttctaatcatgctttcttgtctagaaatctccttaagtcctacttttccaaccaacaatgcaagagaaattttgcaaactccaatagctggggaagctggcttctggaaacaagctatttgaaagatggcttgtgagcacttgtaaaaggatacggggggccaggcgcggtggctcacgcctgtaatcccagcgctttgggaggctgaggcgggtggattacaaggtcaagaattcaagaccagcctagccaacatggtgaaaccccatctctactaaaaatacaaaaaattagccaggtgtggtggcaggcacctgtaatcctagctgtaaccctagctactcaggaggctgaggcaggagaatcacttgaacccatgaggcagaggttgcagtgagctgaggccgagccactgcactccagcctgggcaacagagcgagattccatcccccccccccccccacaaaaaaaaaagatacagggatccttgggcccagcccagtcccaggtagaagaggctctgcttgattaactcttcttttggggttggataccaggctctacagaagagcaatatgaaaatgtctctgtccttgctgaaattcagacaagcagcgtctcctctaatcctggtgggaacgatggggaaaggggagtggatggagagtcccactagaggactaagtggctgtggaaaccaacatgccagaatgtgctggcttatgcatctgacaacttgcagggacatttctgcatgctgtgaggaccagtgattattcccagccagtcatttttcttaatgacttggactcatcaaactcatggccattttgaagccaataaagtaagtgggagatttgaggttcaaaaagaccttaataggcagtcatgatgggagtaatcttacaaggctacatttcatagtaataaacataaaaccctgaaactgggtctaaaaaaccgaaacctgtctccaaggtgggaagatatggtgggaccacatggaaaagaggccgagaagactctaaatgtgattcagcagtgtggtgatgcagctgaaaagagttacttcaatctcgggctgaactgataacttgggagctcagaagctggtggttttctgccaatgtggctgtgaagcacggaaagccggtctctgacgagagaagaatgaagcaatgctcacagtggagaagagatcctgccacgtgtcagcccgagcctgtgggtgagtgacatgaattgtatcctggtacctcgtgacacattttccttttctttctttctttttttaagcaaaacttaattttttctttttttttaagagatggggtctcactctgtcacccaggctgaagtgcagtggtgcaatcatagctcactgcagccttgacctcctgggctcaagcgatcttcctggttcaacctcctgaatagctgggattacaggtgcatttatttcccttctctaatttgagttaatgcaggtggatttgggattggatttgtaacccaagtcctactcaacgcaaatgttataaggactgtgagagatgggcaggacacgacccctaacactgagtggtttggtaagatcaagtggttgaggctgatttgggactttgaggatcaaaatgaatggaaatctccgcttgcttttccagaatcttctggtggtgagggagtgagggggcttcctgggctgtactcactgcaagattctttttagttccaaatttgcactccatggtgaaagcagcatttaaagaagaaagagagaaacccattcttcttatataggtaatagaaatggggaatgcagaaggaatgggttagagatttccaagggaacttctgtggtcctcagtgactggctaaatgcagttgaagaaggagaagaatgtccatagaatgttagtgttggaaacacctttgaagtcatggagtccaaccttcccaatcattgtaggagaaaaccaaggcctgggagcatgggttgccttgctgtaagtcacagggcctgaggcagagctaaggtgagaacccaggtctcctgacttgtagcccagtgctctgtacaggacagcaaagtttgggggccatgatggtcgggaggagagagagaagtggaggtgggaataatttggttttatgtacaatcggcatgagataataaatgtaataagtcatcaatgtacccaacccactgtcatttgtgggtgacagtaaccattagattgtgtagtggttaggacccttctgggtgcaggaaacttaaaacccaatctaagctggtaaagatagaaggataagctgggtgtgatggctcatgcccgtaatcccagcactttgggaggccaaggtgggtggattgcctgagctcaggagttcgagaccagcctgtgcaacatggcgaaacctcgtctctactaaaatacaaaaaattagctgggcatgttggcacgtgcctgtagtcccagctactcagggaggctgaggcataagaattgcttgagcccaggaggtggaggttgcagtgagctgagatcccaccactgcactcagcagagtaagactctgtcttgggaaaaaaaaaaaaaaaaaaaaaggataagttactggctcaaataactgaagtgttcagaggtaatgctgactttccaggtggctgaggcagaggctcaaatgccagcagggcctagcttctctggctggaccccattctcaaaagtgtctctctccaaggcagcaaaatgacttccagcagctccagcttccccaccttgtgattgcaagtctggcagagagaaaaaggagtgaccccagctggaggcaggcaacatagtggccccagccaggacagtgggttttgcttattgttatatgtaaaatgtttattcagaaatagaatgcttgttcctcggcaccacaaggaaaaattagcattcagacaagaagttttctcagcaaggcaattttacttctgcagaaacggtgctccttgcagatggaacaatggtgggagcacacctgaacaaaggagggaagcaatttttatcctttacacagcttgtccctgctactgtgtcctgtctccattggctggagccagatctcacaatctaaactaaaacccaacaggctaataatttaaaacttttctaaataggtaaaggcaagggagaacaaaggaaaagaggaagttgcttatgccaaatagggaaggggcataggctaagagctgggacatgcctgtgagcacgtccggcacaaatatcttggttaaagtacaaggacatagactgtattacgtgcctgtgagcatgtctagcacaagtattttggttaaagtataaggaaatagaatgcacttattcctttatatctagcagctacataggatagggcttaacaaagagttaatagcacaaagcaaggaggcttgaaggaagttagtctttaaaataaactattatttctaacatgatttattttttaacaagaaggaaaactttgaagaggaaactttttactttctacacttactgtttgaggcctagcttgggttgtatgctcaccctagggtggcgggtgcggtcccacccaggccacctgaattcagaatggcctggccagtatgtcagggctccttatcacaagcaacagaaaccctttctgcctgcccccaaaactcatatagggcgtgggcttctccagaggcagatgccggtcaagagacaggacagacatctatgagcatggggaggagtggactcccagcccggatccaggagaagcgctgttgggacaataggcagccagcacctgagtcagaggtgaaggtagcctctagcagcagttgtcaccaccccgcccgtgcctgtcccacccttcagtttgttccagcaaacttccacctgtgtgtacctgcatctgtgtgcctggggctttcctcccagaactgcagaagaccactctgcctgtggatggagcaggctactgaagaagcagccaccaagagcagccctcagccctcagggtgggtgtctgaggccctcagctccctcacacttggatgggatgattctgaggcacgtgttttagactgtttcttggcgcttctttctcccatgggattcagtgcagatgcccatgcggtgctgagctcatagcacagcttcactgttaagtcccccttccctgagtctcttcctcatttccatcccctgcacctcccacgtaaaccactggtgctagagccctcatctagtgcgtgctttggggtgtcccaaactaggacacagcccactctctgggacctacctggggacagtgacttcacctggaagtcccgctctagacctttgagacgggctgggaaggagccccacaccaggtcctcaaacagcactggaacacttagacccacaggtaaagaaaccattcctgctgctgcggtaaggagggggcaccaagggcttgggaaggagctgccacctctccttcagctgcccccttgttcttcattggcagcccccacggaccaagcgggagaacaggaagctcctgtgtgcctgcaggagtgggggtccaggcatgcaggcatgtggcacagcaggggtcacctgtggagacctcggtgcctgtaggggaccccaggtttagaaacaaaattctcattttatgattcaagacaatgagaaaacagttctttaaggaaaacatctctctataggttatataggttatattttataggttgtattaatattttatagaacttaggctgggtgcggtggctcatgcctgtaatcccagaactgtgggaggccgaagtgggtgggtcacctgaggtcaggagttcgagaccaggctgaccaatatggtgaaaccccatctctactaaaactacaaaaattagccaggcgtggttgcatgcgcctgtagtcccagctactcaggagactgaggaaggagaactgcttgaacccaggaggcggagggtgtagtgagccgagattgcgccattgcactccagcctgggcaacagagcgacactctgtctaaaaaaaaaaaaaaaaaaaaaaaaattatagaacctattctgtgtattctgtgataggttatatctgtttactaagggctgcctggaataggatgcataaaatgaactactaggataaaagaactaaccccgtgtccagtaagcc

SEQ ID NO: 13454 - DNA, 15353 bp, Human
cctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccgggctctgtgtcgtggcttgccttttgtgctttctttctgagcacagccccttgctccggagatgggacattgtggccagggccagccacaatctggagctccagtgtcctggcttccttcttgggcccaccagctagactttccagcttaacccacagtgtctcatcctggtccatcccactagtcaccactctctgttcctctcacttaccccttgctcttcaaagcccatacagtaggtatacaagtggacaaaaaaagttgctcatttatgcaatcaacaaacatctctggattgctggggtctcagcagggaacaagataaatatggcctcgacctgcatggagctcatagatactaaattcagaatacttaaaaaataattacggggtatagtacattctaggagaagcataacaagacttctgatataaatggcaggcagctttctcaatgaaggattttgtaatcccaataatcactaatttaataatcagtactgtttgcccagccttatgcgatagtttttgcattctctcatttaatcctctcaacagccccagtaggtagatgactttgaatatccccattttgcaaatgagaaaattgaggcacatttttttttttttttttagacagtcttgctctgttgcccaggctggagtgcagtggtgtgatcatagctcactgcagcctcgacctcctgggctcaagcgatcctcccaccttagcctcccgagtagctgggattgccggtgcatgccaccgcccactgcgctcagcttggagttgaagggactctggaagatgtagaagtggcattgtcagtgcctagatttaaatcccaattgccctccagggtccaaattcttaaccattacgctccagggcaaaagtatgcaaaggctctggggctatagaaagatgagctttggatggaggtaggagccagatcagagggccctgatagacgagagtggggactctgcctgtcattacagagcaatgggaagccgagggcaggttctcgcaggaaggataggaattattctttgaagatgcttgtggctgctgggtagagagtggagtggagggaggctgagatcggggaggaggttgctgcaaagatccaggccaggaatgttggaagactctgggctgggggccatggggtggggataagtggttctatttgatacataattaggaaatcgtgtttgctgaagatgcgcaggagaagggtaaaaggagtttctgggagaaagaggaagacagcgttgagatagtaggcagggtcatcaccaggcaccaaggaggataaggggtcaagctctggacatggaagtcacaagcctggcaccggattcggggcatggccgggagccagggcagagctcgtcgttgccaaactcagagtcagcccatcccccgccacccagagcgcgtcggcgctaggacctagcgactgccttcgacccagagggcgccggcagaggcacgcatgcgcgctgttccggcaggggttgtcgtggcgcagggggcgggaccagaggcggtcacgtgaggggctctgggctaccgggtcacgtgaccgaggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcaggtgagggcgcgggcggcaccgtggggccccgaactcaggcgggcgggctgtgtctcccacctggggcggcggagctcctagtctctttttttctaagctccagcgctgacttttcacggtggagaaaagggcagacggctcctagaacttgggcggcgggtgggcaccagcctctccaattcttcctcctgaacccaggctctgctgggttcccaaactcaggcagggatcgcgccgggccgccagcttctccctctggggcggcgaggttcctgggattcccactgggagcctaggttccgattgctcaacttcgtctggaactcagacagcgggcaccagcttctccaacccgcacgtgagactcccaggcttcccctcctgattccaggggacaaatgctcagcttccctaagctcaagcctggagagctggagggattgcccccaggcgattaactcagttttagctttccaaaccgctggaagcgcagccttcttaaattcgggcttctagccaattctgatgccacccctcctcggggaggctggaggaagaccccttgtgttagcttccccttctggagctagctggggacccctacctgatagatgtcccggtgtcccagctagtagggtctggggtgggttagctgtaatctcagctctgtaagcgggccctgccctctggctttgtcgtaaacagccacagcagcatctcattgcaaagggaggggccgggaacttgtccctctctgcaagggaggttctgacagtgcacacatttatcctgactgctttgctaggcaggaggccaggccctagaaagcagcacggggccaggccctagaaagcacatccccatgggggtgtgacagggacagttttgggctactgtgactggttttgactccagcagttgctgaaagcttagatctaaccattaggctggaaaaaaataaacagtgattagaacagcttgtgtttgctgaagaggtctttatctgctgtgtctcactgaattctcagagcagcttcaggatctcaacctcaaggctcagggagagggtggactttttttttttttaataaacttttttttgttgcccaggctgtagtgcagtggcataatcctagctcattgtaacatcgaactcctgggctcaagtgatcctcccaactcagcctcccgggtagatggggtcccagctactaactacgggcatgagccgtcacacctgactatttaaaaaaaatgttttttttttgtagacagggaggtctcgctgtattacctaggctggatcctcccaccttggcctcccaaagccgttgggataacaggcatgagccactgagcccagccaaggggtcgcctttttaaaatttccactcttcagatgaggagatggaggctcagggaggtacctggagtcaacctactgtaaagtggcaggtctgggatttgatgctagggctgcatgatttctaggagctggtgcttttcagggagataaaatgagtctttagcgaatgtgttccattattattacttatgttgtcaattacctcttctccaggtccttggcttctgagagtgtcagctgatgggccaggttataatgaacccagaggtcatcttttgggtatttgtccagacaaacctagaatacaggctgagttctatgctcatgtctggaagctggagttgggataagcccagcagccttgaacgcccagtgaaaagccagtgggagcagttcattctctccccactgatcaataacgggaacattgatgaaatgttctgacattcaccatggaccagcccctgtgatcaatgcttcataagcatccagtccttagcgttcccatgagacatattattgccccatttcgcagatgaggaaactgaggctcagagagctggtgagcaggaggggcaggaatcagcccaggccctgtacctcccaaacccaaactcataacctctgagcaggacgggtgcatagatacctacaatgtcacaggttttctggttttctttagacctctcagagctcttccttggcaggagcatggggacatgaagatagggcgtgtgctgccttcctggttggagaaaggggaaaaggggagttgcccaggcctcaccccagtgccctctcctattcccacagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcaggtgaggccagccaagcaggggccccagctgaaggccacctgtggctgctgtgctccttgaagagagtcttaaagcagcactttggaaggccgaggccggtggatcgcttgaggctgggagttcaagaccagtctggccagcatggtgaaaccccatctctactaaaaatacaaaaaaattagccgtgcgtggtggcgggtgcctgtaatcccagctacttggcaggctgaggcaggagaatcgcttgaattgggaggcggaggttgccgtgagctgaaatcatgccactgcactccagcctgggcaacagagcaagactgtctcaaaaaaaaaaagaagccgactctgaggctcagagaggttaggagacttgcccaaagtcacacagcaatagaacattgggagctgggatttgaacccaggcagtctgacaccatgttgacccaatggctgcacagatagttctccctcccccatgccagaccctgtgctgggctctgggaaccccaagatgaatcagacccagccactgccctaagtgcttacttcatgttttgggctgactttagcatgtcaccatgcctctaattttccctctgaaaagggacccaattgtccaggcatggtggctcatgcctgtaatgccagcactttgggaggctgagttgggtggatcatttgaggccaggagtttgagaccagcctggccaacattgcaaaaccccgtctctactaaaaatacaaaaattagctgggtttggtggcaggtacctgtaactcagctactcaggaggctgagacaggagaattgcttgaacccagggggtggaggttgtagtgagctgagatcataccatggcactccaacttgggcaacagagtgagactctgtctcaaaaaagaaaagaaaagggacccagtcatggtacttaccctgaaagtttgggtttaacacagaatcggacatccagtaaacatttaatgaacgttagtccctgcagtgagatagatgagtccccaccctgtgttgtacgggggaggacacagtggtgggcgtggcatggagcttatgccaggaggtggggtgaaattaatcaaagcaaagaaatgcacaagtgaaatccgtgtttgtggcccaagttagcagggccctgccccaccccagtggacatctgcagggccctccctgtcctcttccagggcctgtgccctgagggagatacaccccaacccccatcctagccatgccaacctctactaccctctccccagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccaggtgctggtgggcgggcaggtgctggtgggcaggcaggtgcaggtgggcgggcaggtgcagttgggcgggcaggtgctggtgggcgggcaggtgcaggtgggtgggctgcagagagcgggccggactcacaggccctccccttctctgcccacagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactggtgagtgggcaggacgaggcttcactgttgggagcctgagctgctgggattaaaatcaacagctgtggctgggcacggtggctcacgcctataataccagcactttgggaggctgaggaggaaggattgcttgaggccagaagtttgagaccagcctgggccacgtaggaagaccttgtctctacgcacaaacaaattagctgggcgtggtggcgtgcccctgtggtcccagctactcaggaggctgaggcaggaggatcgcttgagtccgggaggttgaggctgcagtaagctatgaccacgctgctgcactccaccctgggtgacagagtgagaccctgtctcaaaaaaaaaaaaaaaaaaaaaaaacaagtatgcttagtgtgagtgtgactcttgccacgtagaaagcaccagatgttatattttaatatggctcattcagtaaaacatccgcaggcccagagagtgccaggcctgtaggaatgacccaaccctggggaagcacagggaagaaggccactggggactctggggagaccagcctggcctccccggccccctgaggcccttccctgactccctgtccttagactgcatccaggtggatccccccgagcggccccctccgccccccagcgacgatctcaccctcttggaaagcagctccagttacaagaacctcacgctcaaattccacaagtactgcctgctcactcgaggggggcccagggtgggggaggcagcacactaggcactctcaccccagcaactacttccctaaggtggggacagggcccccccgcccgcgctggtgcctgctgggtgagcacttcccctgccagctgcagagtcagcacgtggcaggggacgctggcacttggggccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctggtgaggccccccgggaacccacagggctcctgagttccagggcagggacctggtcagggagtgtcttgggagcactggccaagggcaagcgtgcgggtgatgagggagggagcccggggtctgtcaggccacctgtcatgtggaccttggggcttggggctgccaaggtttactctgcccccaactggcccccacagatcacgtttgacaacaaagcacacagtgggcggatccccatcagcctggagacccaggcccacatccaggagtgtaagcaccccagtgtcttccagcacggtgagcccctgagccccagaccagcactgaccaggggccctggcctgtcctgggattccccaagccccagatcagcgctgcctgggggccgtgacctccccaggaatccgctgagcctcagatcagcacagaccagggaccccgtcctgtgctgagatcccccaagccccagaccagcactgaccggggttcttgactcaccccaagcaagccctgagcccactgaccaaccaaaaccagccgtgcagccccctaggtctccagcctggcctggcaccaatgctagcctcccaaggctccatgccatccttggccctacccgctctgccctccccgcaggagacaacagcttccggctcctgtttgacgtggtggtcatcctcacctgctccctgtccttcctcctctgcgcccgctcactccttcgaggcttcctgctgcagaacgtgaggcttctgcgtcatgtgtgctggtgtcctccccgcctggccctggggcgataaaagccagggctttgagggtcctgtgcctggtcaggccctcaccccgcctgccttctgcaggagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaaggtgcgtcctgccaacaccctgggccccaggtcccatccctgctgtcagtgcctatccggggccatatcctcccccaggccccccaaaggaagggctgggccagataggttgacgcagctcccacccgcagaacttggcgagctacgacgtctgcagcatcctcctgggcacctcgacgctgctggtgtgggtgggcgtgatccgctacctgaccttcttccacaactacaatgtgagttttgcacatgcagctgggccttccacatggttactccacaccctccaaataaatccctacacacgcagccctcaccagccccggccaatggccccttgcaagcctcctcctcctacctgcccacaccagatatatctgtcactgcacctgcgcggggccccgggagcctgctcctttgtgcccacccagctgagtctagccgtgcgttgccctcggaccccctcagacgtggccacgccccctctaggcacccactggctcccatgaccacaccggctgtgccctcggcaaggccccgcccctcccacccccatctgggtgcccacagctgacctgagttgtggccacaccctcaacgaggctccctctgccccaacccagatcctcatcgccacactgcgggtggccctgcccagcgtcatgcgcttctgctgctgcgtggctgtcatctacctgggctactgcttctgtggctggatcgtgctggggccctatcatgtgaaggtacatctaacccctgatgtccctgacattgaccctgtgaccttgtcattgacactgtgacccccagatgaccccttggtgactgctgggagtctgtccactgtcccctgtggtccttggtgaccctgacactgaccctgtgccattattgttgtcacagttgttgatgaccctatttcgacctgaattactcccctcctgctctatctacccagaccctaggtcggccctgtggccctgtcattgacccgtggtcccggccattcacatgggaccccagcctgggacctggccattcacatagtgaccccagcctgggacccggccattcacgtgggaccccagcctgggtcccggccattcacgtgggaccccagcctgggacccggccattcacaggggccctagcctggaacccgaccattcacatggtgaccgcagcccgggacccggccattcatgtggggccccagccaccagctcctagccatttgcatgggaccccagcctgaccccagcccccggttcctggccatgccttggctccctctgaccccgccgcccctctggcagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaaggtcagccgcatgcacccagccctgagctcgggctctgggtgccctggagtctgccatgagggggtcttggggacaccgcagggtgaacagagaagacccaggagagaatatgggagactctatgaaaccaaaaagagggtggttcagaactggggggcgcagggggatgtcaaggtgggcttgggccaggagggggcctgagtcagtctttgccaacagggcaaccgagtcatagagtttatttatttatttgtttatttgagacggagtcttgctctgtcacccagggtggagtgcagtggtgcgatcttgactcactgcaacctccacctcccgggttcaagcaattctgtctcagcctcctgagtagctgggactacaggcacacgccaccacgtccagctaatttttgtatttttagtagagatggcatttcaccgcattggtcaggctggtctcaaactcctggcctcaggagatctactgccttggcctcccaaagtgttgggattacaggcgtgagccaccacgcccggcctattttattttattattaaagtattgttctttattttattagagacaagggtctcactgtgttacccaggctggtttcaaactcctgaggtcaagtgatcctcccactttggcctcccaaagtgctgggattacaggcgtaagccaccacacccagcctattattattattttttttttgaaatggaatcttaccctgtggcccaggctggagtgcaatggcatgatctcggctcactgcaacctccaccttctgagttgaagcgatccttgtgcctcagcctcctgagtagctgggattacttgcacgtgccaccacacctggctaatttttgtatttttactagagatggggtttcaccacgttggccaggctggtctcgaactcctgacctcaggtgatccacctgccttggcctcccaaggtgctgggatttcaggcatgagccactgaacccagctaagtcatacagtttcaatgaccttgtcattgaccctgggacgttgccattaacatggtgatcctcagctggccccattcctatggcggacctctaaaaacccaaccctgaccccagcccccagccatgcccccgactccctctgaccctgcccaaggttagcttctttatttatttattttttttgagacggagtctcgctgtgtcacccaggctggagtgcagtggtgcaatctcggctcactgcaacctctgcctcccgggttcaagcgattctcctgcctcagcctactgagtagctgggattataggcacacgccaccatgcctggctaatttttgtatttttagtagagatggggtttcaccatgttgaccaggctggtctcaaactcctgaccttgtgatccgcccacctcaggctcccaaagtgctgggattacgggcgtgagccactgtgcccggcccaggttagcttctgagcagtaaaactgggctcaacccagggctgtctgattccagaagccgtgctcctaacccctctgtcctcagtttagtagggtggctgggaacagtggtttccctgcaagctgcaagggtcaggggacagagcaggatgcggaagtggcaggtagataggattctttcagcagatatatctaagggccaagatctgtgctgggttctgggcatggaggaaaatcaggtgtgcatgatccgtccaaggcctgtgggcaaggatggcacaggaacagacatcccatgaccaatgacctacttgtaacaggtatgaaggaagagtggaaggttgcagagggacccctgctttagattggtatgacaggagatccaggagagcttctagaatgttctatccatcactagtctctagccctatgcagctatttaaattttgattttaattccggctgggcacggtgactcacgcctgtaatcccagccctttgggaggccgagggggggtgggggtggatcacctgaggttaggagttcgagaccagcctggccaacatggcaaaaccccatctctactaaaaatacaaaaaattagcggacgtggtggcaggcacctgtaatcccagctactccggaggctgaggcagtagaattgcttgaacctgggacgtagaggttgcagtgagccgagatcaagccactgcactccaacgtgggcgagagaccgagactctgcttcaaagacaaaacaacaattttttaaaaattttaattcaaatgaagtacaattgcaaatttagcctctgacttgcaccatcctgtatccagtgctcaaaagccagtgtggctggtggctgccatattggacagcatagatattgaatacttccatcgcctctagactgaagagatgggagcccaggggcagtgcaccgaggggaaggaatagctaaagcaaaggtctagtagcctgaaaaaacttggagaaaagatggcccctccatgaggccgagtgagaggaaggaagccttggctgggaccctgccacatccaatgtcaccggcagatgggtacacccccttttccccatgcatggattcagctgtcccacagacacattgactcaggcccttggaactacttcctgtcttgccttagcacgtagacatcacacacatgcatccactcaggtgggcagtctcaggccctgctcccactgctgtgctcagcgtgcatccagctcactcaatagatggtttctgagcatcgaggtcatgtcagccctggctctaggtctgtaggtgctggacctacagcagaaggcaaagacacagactggcaaagacacagcttgtatccaggttcaggggtcagggaaggtccctctgtgcaagcaaactgtggaacaacgggtggagcaggcccagcaagtgcaaaggcccggaggtgggaagcgatgcagatatggctggaggggagggcggacttcaagggccttggaggttgggagccactttcaggctgagcctcccggcttctctccccagcatcccggcggcgcaggcgcagaggagagcgagctgcaggcctacatcgcacagtgccaggacagccccacctccggcaagttccgccgcgggagcggctcggcctgcagccttctctgctgctgcggaaggttcgagtcccgggtctggcacattcagattggaggttagggaatggggaaaggggagcgagccagagaaaactgacgcccctcttccctgcttccttcctccagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaatgtgtcgttttcatttttagcgggaggagcagtccttgcgttaagcggtgtgaggccctttaaggcgcggccacactcagcatggcggcctcagtcggccttccaagcatggcgcggggaggaggggtgggagggtcgggagggactgcggtgcgactaggagtgaataatttaaaggggccgcgcctgcggagccgggcggaacgctagcggtgttggcgcggagtggaccccggctgcggcccctgggtgagtctgggtttccgttagcctcgcaggggtgtcccttcgagggtcgttagcgagcctccgctttcccacgatctgtcctccgattcctgttaactctagactttctgatgttcccataccccccacgtctcggcaggtgtttccacaccggtagccagctgtgccctgaggtggaagaggaccggccacccaggaattttccaagtaacgactcggagtctccgggattcctatctcccggcccccgaatttccattaatattctagcgatgtcagaaacatcctcagcttcccagaaaaatcccagtaatattccagcatctctcagtatcttccaaggagcccggacgccctccccaggcccgctctcataagcaccccaggaatgtgcccacccacctcctggttttcccagcagtagtattgtaatcctcagaatctcagtaactttccagtgaccccgcatccccacccactaatcccagcgtctctggttacgcctcccagcaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgtgggtatcagacgccttccgcggatgccccggcagtactcccgtgcctcccagctcctgggtcttccccggggcaggcttgcgtcgggagccgagtatctaggtgcccactcccggaccccacggtttgcgggcccgttttcctggggtggggcattcagtcttcgacggagtagggggtgcggcctggggggtggggtggtcaggcttgatcaaccctgcagagggcagtgacccgggaggaagtcaccaggtgcagaggaccgtgccctgtggggacctgcctgcaggctgctgacagtgggtaccaggtcggcctttggccccggggtggggttggacaggcgggcgtctggtaggccctacgcgtaggcgaagggagcaggaagccggggacccgcctcatctcctggccagggccgagaggtcggtttgctccatcccttagtcccgcagcgcccctctagcctcgcccctggcagctggagacgcttcccccgccaccccagagggcagggcttgagctgggggcagggcttgaggcaggggagaggtgggcccagattgacgacttgcacgggttccttcgactccttgatttcccaggactccgggctaccagatcggccgtccagctggaatcaaccgatggaggctccgctgcaaactggaatggtaaggggtggggcggagaccgggtaggtgccggcgtggggcgccaagaggactacaactcccggcgtgctcagcgcgcattacgtggtctggcgataacgcgctgcgtccgctcgggcggaactacgtttcccggcatgcactgcgggccgccgggcctcagggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacgg

SEQ ID NO: 13455 - DNA, 8291 bp, Human
ctccagcttccataagcaagggatgacaagggagtgtctggattgcctggggttcaggcctccgggtttaaacaactttcaagtaatctggtaaacttgggtgcccccctgtggttctgagtggaatgtgtccattttgccttcagggaaggcgatcaggttagcaggggacatcctctgtcaccttgctactcagtgtgctttgacccacccaccaccggcagcatctcagggctcattccagacctactttattggagtctactttgaacaagatctacatgttacagtttggaaggcactgctctggcagcccctaagatggccataaagccctcctcttctcactccctgcaccaaagaccatgcagctcccaggcagagttgactctccttagggactaaagaggaagattaggtcacatcccatttccatacccctaaccacttcccaaggtgtgcttttcccaaaacagtatgcttggttctcccttgagctttggatcaacctcttcaaacccaggcatcacggctgagggcagtgagtttgaagtgactcatccttgtcctcacagagctcatgacattcatttttttcaagcttatttggtccagtccatggcatgtacagcagaaggcctaagctgtgcacggtgctgctcgctccttgccacggtaactgaacccctgttgtagaggaaatgggcctgtttatataagcacctgttatgggattaaccccaagagtgttggtctgagtctcagttttttccaacccttctgcactgtgcctccatacagattgcttctctaaaccatctggctttaagttaaacttctctgagcagcttggatttccccacagcaatggatctttttgcatggatctggattccatttaggggccctgcaaaatgttgaattaaagatcaggagccctggtctctacttcttcctctgcccccaactacctctgtgacctcaggcaagttgcaaataagtgtgttcatacctgccctgcctttgtcaaaggatggcgtggctgatgaaaagtgtgtgcctagaagctttgcgagctacgaagcactttcggtaactctgaaccattttcaaaatgtatatgaaagtgattgctattgaaacttaagataatttgcagatgaaacctaagcatctttctaatgctcaggaatgcttgcaagaaggcaaaaatccaacagttgagatgtacttggggagtcagtcccttctccagaggggatgatcatctttctagaatctttacagggttggtgtgagtgtgtgttgttggcagacagggagtgctcgcatgtagttaaacggttgcctctctctctctctctctctctgtgtgtgtgtgtttgtgaaactggtatctggttaggcccacatgagctgtcttatgtgtctctctgtgcagtgccgtgtgtgtcattcagctgttaagcgttgagagacctgggttctggtttggtgaccttgaataaatccctcagactttccaagcctgtttccttatttgtaacttagtggtttgtcccttccaacttgcgtacagcttggggggggggccttcactactgatttcactgtctagtttggtttctgggtctctgttccagtgggccagccactctttgctggcgcctccctgtgccaacttctgtacctgaattgttgctcactgaagagctggcatttagctttttggaaattgtctctaactcactggaaatgcaggaagcttgagtataaaactcactcagaaaaaaaaaaaaaaaagaaaaaaaagaacacacactcagaagaaaccgcagggcctatcagcctgtcgtcatcgagcagactagaatagtatagaaaaccctaggcagagaggaaatgaacttcagagaagggaaacacacggctaagaagagagaggcaagggcaggagtgaaggagagagctgaagcctggggctccgagatggtcagaggatgggagacggggcagtgaaacaaggcttcttgtatcttcagcagcagcagacgtttggaaaggtaggagtgaggctgggctggggttgggcagggggcctgggaggctgctagaattcctgggttggagagggagtttcatattcaaaacccttataggtctgactgtgcacccaccaagttagacccagagctcaactttgggagggctcttttcctacccgacgctgtctcctgaaccaggccccaaccaggtcccaaactgtgctccttactgagggctgtttgccctgggtgggggtgggggatgtgctgccttcatctcttgcctcttttgctctcttgctctgtgttgacttcttttcaccggacaccttggaagggaatggaaggggcagctggagggacagtttaggatgacaatagaggttccttcccaaccccagtggggtgcatgtggctggtgttcagcttgggctggggcctctgggggcctggaccccagccggctgtccatcctctttccccttccctggcctccttgaaccaggaagtcctcgtcccctaaccaacactggggggcacacctgtctctctctcatggcccaacctatcaaggaatgaggcagcaaggttcaggagggtggagagaagttctccttcaggatttcgcacagaaggagaatgaggtctccagcccgggtcacacgccgccctcctcactccctcctctgggcctcagccactgccccgctttcctccccagactggagtccactgcggtgggcctgtttggccttcttgcagcctgctttgggctcatcccggcgttgctttctgcctgggcagtctctgctcttgctcgtgggcctccttctcggggctggcggctgatctccgattttctaattcctgcagtcactgtcctcttctctgcctccctgggtctcatgtgatcttcacctctctctccccatctccaagtggctgccccagtccccctcccacggttcctcttctccccttggctcacgatctccccgtctctgggtggctccctcccgcccccgcctcccacgcctctggcacagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttccccgtgagtcgcgcggggtgcggaaagggcaagggggcgtgcaggccgagggtgttagatacttcctgtgggcaagtgttacaggtgtcaaggtcagggtgatggggtgcttcctccatgtggggggacccgaacccagtgtgcagacagagccagcaggttgaggtggcctgaaagaaggcctgggccagaggggggcctggggatcggggaaggtgatgagacggggcgcctcctccctaggggcagaggaaggagctctcggggccagagggaaagcagagccggccctgcatggaggaaaatgaattgtacagcagcgcagtcacaggtgagggggcgggggctgccctgctctcccctgggggctctccccagggtgaggtggagaggaggtgtgggctggctagctgctggccccgagtcttcctgccttgtggttatccccagcctgggccagccccgttatcagcctctccttctcgcttccgggtgcagcccaacgtagggagcctaccctgccttgagtctctcccttggttcacctcatcttacctagggcctgctggtgggagaggggaaggctgggggcccaggtgagggtgctgcttttttctatttttgagacggagttttgctcttgtcgctcaggctggagtgcaatggcacaatctcggctcactgcaaccgccgcttcccgggttcaagcgattctcctgcctcagcctcctgagcagctgggattacaggcgtcggccaccacgcctggctaattttttgtatttttagtagagtcggggtttcaccatgttggccaggctggtctcaaactcctgacatcaggtgatccacctgcctcagcctcccaaagtgttgggattacaggcatgagccactgcgcctggccccaggtgttgcttttgaggagctggtggagggaggagaaactttcatctgccttccatctaagcttcacccccagggccccggcagtgggagggcagggccaaggcttcacctgcagctgtgaccgtagggactagggtggtggctggtttggggtgagagatggggtggggaagacaagactgtggctctggcgacaggggcaggaaggatgtgggcacgaggttggggtggatgtgggtaggggcgtgatgcctactagggtagggggtggaggtacctggccttttggggagtatgacctggcacagagcagctcagcctccaagacccaggcagggggccataagtgtgtggataatactttctagaaaagttctggtacgctcatttagaactgggcagtggtgaggcaggccagctgtttcccattaactgccttcgccttctctctcttcttctccccagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtgagtgggaagctgcatcagggcaggttgagagggaggataagctacgaacaaagaggggtgagaagcagcgaggggatgggagagaccaggagagggagatggagtgaagcaaagaatagagtgacaagatggcagaagtggagtagaaggaaggagaatgagaagaggtggagagaccgtagaggggtaaacagcgtctgaactagtgcctagctccatccttgaaatggtggcagtgagcaggaagggcctggagaggggagaggagagagccaagtctctgcctgtaggggaaagcacagagggcagaggaggctccagcagttcccatgaagggaagctggaggtcccagggcttgggttagggatggggtttaagaaagcatccctagctgggcgcggtggctcgtgcctgtaatcccagcactttgggaggccgaggcaggtggatcatgaggtcaagagatcgagaccatcctggccaacatggtgaaaccctgtctctacaaaaaatacagaaattagctgggcgtggtggcatgcgcctgtagtcccagctaccagggaggctgaggcaggagaatcgcttgaacctgggaggcggaggttgcagtgagctgagattgtgccactgcactccagcctggagacacagtgagactctgtctccaaaaaaaaaaaaaaaaatgcacccctgccctgtggcctggccaataacctgctttctccctggtccaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaacatttctgtgtggcatgaatgctgtgggagtgaagtctccaactgaccaaccttgatcacatcctctcccagctgcaagatccccctggggcctaggctgagccccaagcatctgctcacagaggcctctagaagtcagtcagggtgccctgggaatagtgttcaagtatgtctcccttttgctgggagaaggtcaatgtcagaaaaatggtgggggaagcacgggggagcggggggcgagccaaagtgcaaggaaggaaataattggattgatggagcctcttgtacaccaggagtgggagtcaccaggtgtgtggtcctgggccctttcgcttccctgagatttctgcacatcttcataaaatgagggggttgccccatgtgggcaaggaggagccatccagctctgtgattcccattggctctgggttcctaggtccccacacaccatttccccacaggtcagcctgtgtccttgtgcttgctcctcttatcaaaacctgctttcccagtagggtgtgtccatggacttcagctatcaacccagtccgccgacagcatgggcactgtttgtgggaggctgtagactgcatggcctgtgagagacacactgcccagaaggggatgagatgaaacaaggcacaggtgtctgtcacagagtgggtgtgagtgccacaagggaccagacagggccatgagtgccagagaggtaactatttgttgggagcgcaagaaaggcttcatatcaaaggtaccatttaaggtgggcatttacgggtgggaaggagttccatggagataaagggggtgtgaaggagcatcttggataggaatgggagtgtaggtgaaaccacggggaggtacggatgtgttgctttcgggacggagttctacgctcagagtgcgggtaaggtgacacaatctagttgggaaggcagattctgactgtattaaggggaatttgtacctaattagagggaaaggtggaacgactaaaggcttttgaacagggagtcccataaaagctgagctttagggcaataacccgatagccctgtggaaggtggacttggggtgggagggggtaggttggggctgaattgaaaaggggaaattctgccaggcacggtggcttacacctgcaatcccagcactttgggaggccgaggagggttgatcatgaggtcgggagttcaacaccagcctgtccaagatggtgaaaccccatctgtactaaaaatacaaaaattagctgggcatggtggtgggcacatgtaatcccagctacttgggaggctgaggcaggagaattgcttgcagtgagctgagattgcaccactgcaccctactgggtgacagagcaggactccgtctcaaaaaaaaaaaaaaaaaaaaaagaaaaagaaaaagaaaaggggaaattcatctgggcaccgtggctcacacctgtgatcccagcaacttgggaggccaaagtgggaggatcacttgagcccaggaattcgaaaccaacctgggcaacatagtgatgagaccgcgtctctataaaaacaaacaaaccaac

SEQ ID NO: 13456 - DNA, 11321 bp, Human
tcctaacctcaggcgatctgcccgcctcggcctcccagagtgttaggattacagacgtgagccactgcgccctgaccggttgcattcttttgaatttattataagtctttccaaaaaagttaatcgaaatacgcatgtatctctgggagcaaaaagatgacttgaatagaaaaagaggcagattcgcaataagcagttcccagcttgaaggtgcctgagatatttttctttcacaatcttattgaacccacacctggtgtaataacctggaagcctccccaggaggcggtcagcacagaggctagggaatgaggctttccaggccattacaccagttttccatttaccagcagggtgaccttgggcaatttgtttcaattctctgaaccccagtgtttttcttctctaacatgaggattatattgcctggtcaaagaatcatagtgtggcttcaataagacagaaggaaagggacagaaacagatccgatagaatactgtagctagctcattgaggcagttcacagacggtgtttgggaggaacttggaagaggctgagccatgtcttacccagcaccagcaaggaaagctgtgtttcggttctttcttttctctttccacaatctcactgctcctaggtcaggcatggctcagcctcttccaagttttctcccaaacaccctttgtgaactgcctcaatgagctagctacaggatcccactgcatctttctgtctccttctttctgtctctctgaatctatttctctctatctctctctctctctctatttccatctctctctgtctgtttctatctctctgtttctctgtgtctctctactgtctctctgcatgtctctgtctcttcctctgtctctgtttttgtttgtccatctttctggatctctctctgtctttctctggcaggggtgcagtgggagtatacggcagatacatgtttgggtgcagaatggcattctgccagcggtagagtggctgagggtcactccactctgggtgtctcatgccatgtggctgcagtatggggttctcattggaccaccgtgacagtgtagggtggatgtcattcctggaaactgagcctcaagctgggttctccagcaatgccaccaccccccaccaaccctgatatcctccgaataaactcttcccttccttggtcagcgagagccagcgtctgctgcttgcaaataagccactgagacatcaggaaagctgctcacagaattacaatgaaaatcagtaataaataaaatgtttcttaaatctttagaatcaaggaaaacctgagggatacttggagagtcactaacagcaccccaatctggcagttgtagctctgcagggtgggcccaggctgggccagaccctcaccctccaagggccacactgggggctcactttctgaggagtgccctttggaaacgtcccaggaacacatctagtgggaaaagagaaaagttggtccatcgaggagagtgttctgcataaggggagagatgagaaggtagccttggccagaggaagaaacttcattacaaccagctctccttctgcaagggaagagggtgaagtttgagtttgtcttgcaggaagacaatcaaactaaagaggccaacaccagcttagagccgagcggccccctgctcagagcttcccagtggctctcctccatgtgatccagaaggagggactccagtgtgaactgcctgttccagaaaccccatcagaactgcctaacctagaaaaccaaacaggaggagctggcaccagggctccaggctgaaagctaaatccagcggcagccagatggagacaatgtgccatgtgactgctgactgctcagggcaaatgacaccaggggttagcgattagaagttcacccttgactgtggcacctcccttcagttccgtcgacgaggttgtgcaatccaccagtcttataaatacagtgacgctccagcctctggaagcctctgtcagctcagcctccaaaggagccagcgtctccccagttcctgaaatcctgggtgttgcctgccagtcgccatgagaacttcctaccttctgctgtttactctctgcttacttttgtctgagatggcctcaggtaagctctggtacctgcaagagtttcccatccccagggctggggacaatggggctgatgtgagtctcggatggctgcctccgtgtcccaagggacgaggaacaagcagcaggaaagcatcccgtggttgagtggcctgcagttggcagaaggcagcaggcaagccctgccaagccttcagggtctgtgagccgccaaggagtgagcctggcagggtcatggcgcttgtcacaggcagctgcctgcatccttgtcctggacatgtagacagtatcctatgtggatgagattgctgcttcccctgcaagacgactcctcacactgagaggccagcttcctatgcagagagaggggccggccccatcctcagcccacgtcactgggtgcagcctcctggggtgccctggtacaggtgaggtgctgccgccccacccatcaggccagctcagccggtgccttggactcacctcgtgtgcaggcaggcggtcctctccctctcctgagaaatgcatccacattctccaggttagcagtctccccagtcaataggagggggcttcctgtgagccaggtgtatgtcagcttctctgggccaaagcagccatgaccctgacatgatggtgggacgtgcgggaggaatcgggaacatgttttatcccagccctatccttgttcacacgagtcacatggtgctaagccttggtttattcatctgcagaatgaggggctgggaaggatgatcctgaaagcaagcactccagttcagaaagtctctgtaagatcctattgtaagtttctctaggccatcactgtatccagcagataggcttaatttattccaattatgcctcagtttttccatctgaaagctgagtacaaaagcattctaaatgcagaacttttcatgctgccagttgctacaatggattttgttttttttttttttttttggtttttggtttttggtttttggttttgctttgctttttttttgagacagggtctcactctgtcacccaggctaaagtgcagtggtgtgatctcgcctcactgcagcctctgcctcctgagctcaggccatcctcccacctcagcctcccaagaaactgtgactacaggcatgcaccaccacacctggctaatttttttatttttattttttcgtagagataaggtcttactgtgttgaccaggctggtctcaaactcctgggcacaagcaaccctcctagttcagactcccaaagttctgggattataggcatgagccactccactcagcctaccgtgtttttttgttttgttttgttttgtttttttgagatggagtcttgctctgtcacccaggctggagtgcaatggcacaatctcagctcactgcaacctccacctcctgggttcaagcaattctcctgcctcagcctcctgagttagctgggattacaggtgcatgccaccaagcctggctaatttttgtattttttagtacagacggggtttcaccatgctggtcatgctggtctttaactcctgacctcatggtccgcctgcctccgcctcccaaagtgctgggattacagccatgagccaccacgcccggcccatgtttttttaaaggaatagaaaatattacttcatgccatgtagtaaaagtagatgctatttaattacacccatatttcagtttggggtgtgtgcatatgtttttactgagtagcagtgagaaatttctttctgatggtggttcagtccaaactcaaaagggtttgaaaggcactttgttaacataaagaatttttgttttcagtctattatatctaaattgaattatgagaagctattctcgagccttcccagtcacaactccctcctacccccaagaataatcactcacttgacttttatggtggtaacttttcatatttacacttttgccacactaattaatattcaggttgaatagtacagcttggtttgtgcacacatttctattggccagtaggtgcccttatgcctctatttctacatgctgaaaagttgcatcaccggatcataggctatgcatatattcaattgtattggacaatgccaaactgttttccaagattatttacaccaatttgcactcccacaagcagtgaataagagttcctcttgctctgtatccttgccaacatttgataacatcaattatttttaaattttaaccacctggtgagtgtagcaatagctcactggagttttaatctgcatttccccgataaataataagttgggcccttttatacatagttacaggcaactgggttattttttgtaaaatacctgtttgtcttttgtccatgttttcttttggattatctgtcttttcttattggtttgtagttctttatgtattttctatgcaagccttttgtcaattatatacatcacaaatatcttctcttgctttgtgttttgatttttcactctcttaatggaaactttcctagaaaagaggcttttatcatgatttcaatgtagtcgaatgtgtcatgtctttttccgtaaggttactgcactttctatcttgtttaagaagactttctttacatcaaagacatgaagatagtccccagtattgtcttctaaaagcttatcctttttctttttacatttagacttataatccatctggcaatggggtgtgtgtgtgtgtgtgtgtgtgtgtgtgtgtgtgtgtgtgtggcttcggtatgaagtaacggtcaagttactttttttccccaatatgaatatctgattgtccagaaccaacttttttttttttgagactgagtctcgctctgtcacccaggctgtagtgcagtggcacaatcttggctaaccgcaacccctccctcccaggttcaagggattctcctgcctcagcctcccgagtggctgggattacaggcgcctgtcaccacacctggctaatttttgtatttttagtagagagcaagtttcaccatgttggccaggctggtctcaaatacctgacctcaagttatctgcctgcctctgcctcacaaagtgctgggattatagccatgagccaccatgcccagcccagaaccaactgttgataagactatttttccccaccgttctgctgagacactactattctacatcaattctccatgtatgcatgagcctctttctacactctatcttattccatttggacatttttctgtccttgtgccataagcacattgccttaattacagtggctctacacttagtcttgaaatacagtaaagcaagacctctcaccttttttccaaatgtgtctcggctattctcggccctttgaatttccaaataaaatttagaatcactttgtcaaattagaacctctggggattcccatggtatttggttgaaccagaagattaatttttttaaaaaagtaatcttcaaatgctttaacagagcatttccactcatttaggtcttcttcatttcaaaatgtttcaggccttcataataactttttttatgttagtaggatgtgatgttcctgcttttgtttcggtctttctctcaaatcttgacctagtaattctttactgttggttctctaatacctacaaagtgcacatgtgcgtgcgtgtgtgtgtgtgtgtgtgtgtgtgtgtatgtcagatattctagctgttctttttgggctgcctggtccacaattattggaaaacaaaaaccttcagaagcatttagattacactaacatccttaagaagcacgtaagagaaacagacacaggcacagcaatatcgaacacaaggtgaaggcaaatgtcatgaaaatgttaaaggcaagtgcttttaaaaggcccctagactgaaagcagcatagactgctccaacaggaaggaacctcaatattccagaccaaaggttgtaaaagtatggcctctggaccagaagcttcagtgtcacctaggagcttgttttaaaatgcaaattatcagccccaacccagacccactcagatgctgaggaatggaatgtgatcttgtcacccaggtaatgagcatagtaccccacagttagttttccacactcctctgcctccttcccctctagtagcccccagtgtctcagtgtttagcccccacttataactgagaacatgtggtacttggctttcttttcctgtgttaatttgtttaggatattggcctccagctgcatctgtgttgctgcaaaggacacaccttcattcttttttatggctgcgtagtctcctccgttttaaatttgagaagctgctgcctagagaggttgagtggtttgcaaaagatcacacagtagattagatgtggaacacagaatgtaatcaaagtaccctctcactaactttgctgcaattccttttgtgtcccataatgtactagatcctggaaggtaatgccagaaattagttctggttatgcaccgtgacaccacagtcaaccagcagtgtggtgaagtggaatgagaactgaagtgagatcaggaggcatccattctggtctggggttggtctttgaccagctacatgctctgcggacatcactggaccttgttccttcatctggggagaggatcacagaaaggttgaattaattgagttccgaagtccatcctggctctaaaaagctacatccatattaaatttgggcctcctctgcttactcagcatatatatacccaaccatttgattactgagaagaacaatcaagaacaaaggtgtataaaccttctcgatttcaaagtgctttcaaatttatatgctcagttgatctctctaataacagataatcacttggagaggttccatctttcgcagcgtgggttggagtaggcatcctctaagcatctttccagcactgggagcctccagtgcagggagactaaagcagaaagtggagactttggcagagtctagctggtcatgatcttacttgaggtcaacattatggcgagattattaaaacatagtacaatctcagacagcctcattaggaatcagtcagagaaaaagaatataagctggcaatcaagagactgtgttttgtatgaacaaatgagtggccttggcccaagatgcttccctgagtactgggatgggagaaccagagtgcctctcaattcccttccatctccacagcaacacaaaaaaactcttctttcctcattctcctcaatgcctggtttccgggcccttcccaaacctcttcattctcctgtggatgtgtttaagttggccaatagacttcccaacgtttgaagcctggtatcaatacagagtaccttctattgaaacgaagttcaataaaacgttctgcagtggtaaaaagattctatatctgctgttcaatgaatgcagcacccactagccacatagtgctcgtgagcacttgcaatgcggctagggtgatttcaattaacctaaaagagaacagccacagggagcatgtggctgccatattggatggtgctgctttgagaacaaaatgagagaaatgaagcctctatttaccttggttggcggaacacattgaagggactctgtattgataccaggcttcaaactttgggaagtgtactggccaacttaaacacatccacaggagaatgaagaggtttgggaagggaccagaaaccaggcattgaggacaatgagaagagtttttcaaaagtggaattactgcaaaaagtggaaaaatagcctttggatggaagttactgatgagacaatttccatcggtgtgaaagccatctttccaacagagatctgcaacatgagaatgtactgtctcctagggtagcgatggcctcttgtattagtccgctcaggctaccagatttatcgtttaaactgcccataaacagaccaggcagtttaaacaacagaaatttatttcctcgcagtcctggaggcaggaagtctgcgatcaaggtggaagcagggttggcttcttctcaggtgtctgtccttggctggtagatgaccgccgcctccctgggtcctcacatggtctttcctctgtgtgtgtctgtcccaatctcttcttataaggatgcaagtcttatggatcagagcacaccccaatgaccgtgtttaacttgaatcacctctttaaagtttctctctccaaatacaatcaccttctgaggcactgttagggcttcgacacaggaattcttttcctaggggattcagttcagtccaaaacgcctaccagtggagacttgcaacatggcggcctgctggtccctcgccaggaatatcacaggcgactgttccctgttgcatggaatagaaggctattccagagtactgtctctatttatcagatctgggatactgggagaagggcaaaataaagtccaagtagaaaaaaaaactatgaaagttttagagagtaaccataatttcagcccgatgtgaaacgatcctagatttcagctgaaatagtgatgtgggaagtgagggggccgggattcaaggcagagggaacagcgtaactgaaggcatggaaggagggaagtgtaggctgtgtttgaagagtggcagctgcttccacatttctaaaacacaggatgtgattttggggtgtgttgagacaaggcagaaaacttgtttggaaaaataacttgaattccctgcacatttaaaatctctcagcagaagaaaaccccactcagaaccccactgttcattccttggcttgtatttggccacagctggcatagccccagactgagtaagctcttcagacacctcatttcatgagtagccccaaagatcaatcatgggccaatttcttggaagagaagactctccggtgttttgcagttatttgttctgctttcgcgagatgttctcaaatcgttgcagctacaagccatgagtctgaagtgtttgtgttccctccttacaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtatacctcctttgggccaaaatgaatcttgtgtctcaattggaagaggtaaagaagtagggggttagggtgcatgggttggaacgtgagacaggtcgaaccacaaagcctgcctggaaaaggggagtgacgtcctaggcttcagtgatgtcacctccactttgtttgatccacaaaccaacaggtgactgatttttttttttttttttttttttttgagctggtgtttcactcttgtcgcccaggctgaagtgcagtggcacaatctcggctcactgcaacctctgcctcccaagcccaagcagttctcctgcctcagcctcccgactagctcggattacaggtgccggccaccatacctggctaatttttggggtttgtttttgtttttagtaaagacagggtttcaccatgttgaccaggctggtctcgaactcctgaccacaggtgatccacccgccttggcctcccaaaatgccaaagtgctgggattacaggcatgagccacgacgccggccccaacacatgactgattctcaagtgtccacataattcagaggtctcagcagtctgctcagtgaaatagtcctttggcaggacccagaacttccattttttctcctttctggtcttagggcactgtgttggttaactttagcatttgagaatctccaggactacttggagaaatggcagcctccaagtctggaacataagatgtacaagacaagcctgagttattttgctgtgctagaaataagacatctcaaagactgaagggtcgcaccaaaagaacaccagctccaaatcaaaggggagcccaatggccacagatgagacatttttcctaactgcagtaactaatgataacaattgattgacgcacacaaatatataaacatccatgagttcatgatgacaattaaatagtttcatttataattagagcttgttacagcaccaacttatcacttcagaaatttattctgcattttcagtacaaactgccttttagggtgaacaatagttaaggaaatgccttctttatagaatttccccaactaataaatgaaaaagggatgatagaataataaaatcaccatattgcaaccctgaatgaaattataggtctaaagcaatcatcaatggactgttttagaaccatttggtgaaaagcttggcagggaatttgataactgagggttaagggtgcactcgatcatcagtcttaccctccctaaaactgagacaaccagacattaatggatttcctgttgtgatgtaataagaattacacagcaccacccatgaactattcttgcccaaagaaatggaacctgaaactaattgagtttctagatctaactactagtttacggaaaatacaggactttcggaaacaagcgaaacaacagcacaggaagcagtgggtcaaatccagagtgtgagacattctacaggaaaaataaccttgtttctccaagaaaccaatgccatgatgaaaaaaaaggagcatgactgttgaaaaagagagaaaggagacaaaacagccagcatgtggtcttgtgtggcccctatattgaacagtcttcctggccgggtgtggtggctcacacctgtaatcccagcactttgggaggccaaggacggtggatcacctgaggtcaggagttcgagaccagcctggccaacatggtgaaacctcatctttactggaaaaaaaaaaaaaaaaaaaaaaaagtcaggcctggtggcgggcgcctgtaatcccagctacttgggaggctgaggcaggagaattgtttgagcccgggtggcagaggttgcagtgagctatgattgtgccagtgcactccagcctgggcaacagagcaagactctgtccaaaaaaaaaaaaaaaaaaaagtcttcctgtatcaatggaccctgattacacttttagtagtggccaggaggagtttaaaccacagatgtaccgccactggttgccacatgggattagat

SEQ ID NO: 13457 - DNA, 5379 bp, Human
gattggtctgcattatcttctatttcaattaaaataggctgggaacacttcttagtttccaaagatagagcatacaattccaaaatgctcctttaagtcaagacaaattagatcacttatttacagaagtatcttgtcctgttagctagatcagggtatctgagtaacagctccagggtaggatttccaggtgatagagtaattattgcctgtcccatgaactactggggaaagaggcatagacagctataagtcacaatggacaattacagtttgggttggagagggaaagtttaattcgaaatttagatgttagttaaatggtcatctcctgctgggtaaatgaaggcaaaattcaaataaatacagaacaaatgcatttttaaatgcccatagattccctaacaaaactgaaacaaaaatcaagaaaacaattccatgtacaatagcatcaaaaaataaaacacctaggaagaaacaaggaggtgaaggatctacacactgaaaatgaaaaaaaaaaaatagtgaaagaaattaaagaatgtaaaaataaatggaaagatatcctgggctgaaaattggaagaattaagattgttaaaatgtctatcccaaacaaaacaatatacagattcagcacaattcctatcaaaatccccatggcattctttacagaaataaaaaaaaaatcctaaaatttgtatgaaatggtgaaagaacccaaatagacaaaacaattctgagaaaaaaaaacaaagttgaagacatcacaattcctggttttaaattatattacaaagctacggtaatcaaaacaatatggtattggcataaaaccagacacataccagtgaaataaaattgagagtccagaaacacatcgaaacacatatggtcaagtaacttttgacaatggcatgaagaagacacaatagggacaggagagtctcttcaataaatggtggtgggaatactatttccatatgcaaaacaataaaactggacccttctcttttggcatatacaaaacttaactcaaaatggataaaatacctgaatagaagaccagaaacaagagactatgaaaataatggtagagttctatatgttttgagctacaaagtattcaaattacagcattagggagaaaaaacaaagcacaaaccaatgtttaatttttaagtggagatttcctggagcagagctgcagggctggggcaaggatggaggctcattactccttttaccctttgaatggtccttgtgggcaattcaacattttctaaaattaaaaataaaataaaatttcagagggggattgtgggcatgtcaattgtttcgatatttctcaaagtggagagaaatacctagtacatattttacttgatacattcagatcacatgggtttcttgaaataaatcttttggctttagttttactaactctttacctagtatcccactgagttcttttcccttataggctgataaggtcattatcttctccacactgtgccccacaagagcctattcaccccataatctcaaagcctccttcatgagggcagaaatgccccctgaatcctgcaatgaattaactctctactctagcgggatccagctctggcctcaaggtctagacctccagagagtggccagccccaccttcagaaaataagaggcatttgattcctgaaattattcattgaaagcactgttcttttcttttttgaatattaacaagtaaatattccagcagatggaaaacaggacaatgtaacactgttcttatcatcactatcagctgggaccagaacagacactcaataaacagcctcacactacaatgaagcttggagaacaaaggagcatcaaagggacatggagggcaagggtagctcttctgctccccaatcacatgcactccccgtctcaccgcaacatctgtccctgagccttctcccagcagacctataaatccaggctggctcctcactccccacacatctgctcctgctctctctcctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggtaagagacaccagcattgcagagctaggagtgtagagaggaaaaccaagcacttctagaattagatccaacagctggctctttctcttaggtgatcacctccccaggcctcaattactttatgtttgtactgaaaaggaagaatcagtgatattcaaggcatgacttttctctaaagattttttaattctatgataagtctatgaaattttctaattttttgccatgtagaaatgtattgaggagtctctacttcaaggaagagagcctaattttaaaggaatgttttgttttgctttgttttgttttgttttgtttgatggagtctcgctctgtcacccaggctggagtgcagtggcactatctcagatcactgcaacctctgcctcctgggttcacgcaattctctccctcagcctcccaagtcactaggattacaggcaccagacaccaagcctggctaaattttgtattttttttttttcagtagagacggggtttcaccatcttggccaggctagtcttgaactcctgaccttgtgataaacccaccttggcctcccaaagtgctgggattacaggcgtaagccaccacatccagctgctaaaggaatgttttttaatctgacttttataggaaccgttggaaactggagacagtcatatgggtgcattcagatgtgtgtgtgacagggaaggagcagataagtacagcatatcagaatgggtctctaatcctgtgtgtgaccaacactgctctgcgtatttattcctattgatggtgtgatcatgctattggctgtaatgcagccagcattacatgtcagcaagcatgcaacttcctgaagattctctttactgcccgctgctgaccctggtgctcaatttctgatgctctctctctctgtccccaggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcctatacattgccatcaactttgtttcctcatctcaaataaagtcctttcagcaagttcttttgtgtttgtgcttttctggtgtttgataattcaggattcttcagatgcaaaaacaaaaacccaagtcgtatctcagaacactagctcttcgaaagagttttctatgtagaccagagaagtggtagagaggatgttgagagaagagaggatttgggttttttgtttttttgttttttgctttctgagatggagtctcgctctgttgcccaggctgcagtgcagtggcacaatcttggctcactgaaacctctacctcctgggttcaagtgattctcctgcctcagcctcccaagtagctgggattacaggtatccaccaccacgccaagtaatttttgtatttttagtagagacagggtttcactatgttgaccaggctggtctcgaactcctgacctcaagtgatccgcccacctcggcctcccaaagtgctgggattacaggcatgagccaccgcacgtggccttaggcactctgttttaatgttaatgctggccagctgtgcctgaattccaatgggaggagggtatcatgaggtattcctgatccccacgtcccatcatggcctgaaccagtgtttgaggttaacactggaatgccttgggctgagaggaggcgtccattcagttggctggagggcttagaattttaatcttggtttgaatgggatacaaacataggaggaaggaacgtggggtcctggcccttccgactctggccagaaccttgccaaccacatgtccacaagaacacaggccctctctctttgccttgtcccttgtcactatgtccagagacaagagggtgacaacagtcctgggtataacaacaaccctgacattcatccagaggtctggccagactcccagttcttctgcccttctgctgggtcttcttacctctttgtaggagagaccatgttaaagtggcctattttccagttctctaaaacacagacagaagacgtggagggaatggttctccaaggcaggtctgaacgaggagaaacatggagtcacaaaacccatttccaagcctgactttgccactttctacctgaatggacttgacaaacccagcacgaaaatggaggcttcatttcctcctccataaccttgtggcagctgtctcaaaacttgactatgggacctaacaggattcttcataacggtggtcagagacttagacatcaaaggtggggaataaataacacagtcagataggaagggtgggggggtgacctagcaagtgggggtgacctagtgagtgagggggtgacctagcaaatggggggtgacctagcaagcggggggggtgacttgacctagtaaggggggtggcctagcaagtgacggggtgacctagcaagtggagggtgacctagtaagtgggggtgacctagtaagtgggggggtgacctagcaagtgggggtgacctagtgagtgagggggtgacctagcaaatgggggtgacccagtaagtggggggtgaactggcaaggggagacgtgacctagcaagttggggggtggcctagcaagtgagggggtggcctagcaagtggggggatggcctagaaagtcgaggggtgacctagcaggattctttgctaagatggggctggacagaccaaagacagacaggacctacttgaaaagatggctcagaggagcctgactaaagtttggtcaagggcagagtcttggttagcgttcctgacctgagacccagatgatgaaagggctcaattcgtgcagatctcaggggcagaattccagaaatggaggcaggggagcaaatgcaaaggccctgaggtgctaagacggggtttgtgctcggagccaagaagaaggccagggattgggggctgcaggaccagtcagagctgtagtagggcccagagcacagcggcctgcaagggccaggaggggcttctcagtgcaatgaagtcactggaggatgttccttggaagaaaggcatgactcctgctctg

SEQ ID NO: 13458 - DNA, 43537 bp, Human
agtagtaaggctgcatgcagccccgatggagtgaacgcctccagtagcacagaggtttctacggcaagaagttgccccttgccagcctgtcaggccctgtgcttgctacactgtctagcccccagctctggtgggtgtgaggggctggcaccaaatatgccggtggcagcggtgccaaagcctccctcagaccctgagggcatgggtctggcggcagtggcaggggagagatcaagctcgcagtcctgaggctggtgagtctgagcaaaatgatatatttaacatcaaatatactcaaggactattaggattaagtattcaagatgaaggggaaagtgaaaccctctgagctgcagatgaggcatctcattagaagcagcgcttttctgttttctcaaagcctgacttccctgcctagcagagaggaatatggctgcagcccgctgctccccatccctgtcaagcactggggcctcccagggcttaaagggtaagacctagcctccaggtctccttcaaaccagataatctccccccatccccctgcattgtctggagtgccacagtttacaaagcacattaacatgcattagctcatctgacccccacagcaaccatagatacaggaagagtaggtctcccacctcacagccaaggaaactgaggcccagatagagaaagagacttgctaaggtccactgttggtaattggcagagatgagatagaatcccaactggtggcccttcagcccgtttctctttccctgggtctagtcctcagaagtgattgccaggaccaagcctccaacacatctgtctggagccctccttgggctgaagaaaaatcattatttctatcccaccttggaactctgtactgtctaggcaaagaaaaaagacttgggatttaaaagtaggtggccttccggccaggcgcagcagctcacgcctgtaatcccatcactgtgggaggctgaggtgggtggatcacgaggtcaggagttcgagaccagcctggccaatatggtaaaaccccgtctctactaaaaaatacaaaaattagctgggcgtggtggtgtgtgcctgtaatcccagctactcggaaggctgaggcagaagattcgctggaacctgggagccggagcttgcagtgagccgagatcacaccactgcactccagcctgggcaacagagcaagactccatcttaaaaaagaaaaaacagaaagaaagaaaaaggaatgaaaagaaaaaaagtaggtgggtaggtggccttcctagggtaggcagccagaacatcagccccaggattctggggagaagcagggtccaggagaagagatgggcactgtctcttttcctgccttatgagttacagagcaagaatcgtcaactccataatagcagcaggaatctttgttttgttcagtgctgtatccctagtgccttagaactgtgcttggcacataatacatgctcagtaaatatttgtagaatgagaaaagctttcaaggccatgcctgtgcttgcttcgagagaagttgagataagctctcccgctccatggagtcaggatgcttttgggggtgctgctggggtcaggagtagtgctgtaagactcagggtaggatcgtttgtgccctgaagagggttaactttgccaaacaatccgggaagcaacacgaaaccccgggcagaactggtaggaaggaaaaggatgtgatcagagaaatattgctctgaagaagagacaaaaatcaaggctgagggtctgggagtgacagatgggatgcgtcctccagacaatcattgaagaccacgaccctgggatcggagcaaagacgctcaccgagctaggacctagaagcctccaggtggcgctgcggagccggacagccgtgcgtctccactccccattaacccgggagggtggaggcctcaggaaatgtgtgcatttatgcagtagcaggagtgcaaacctcatacattgagggagaaaggcagcgggagacggccacgagattcccccatctctttgaatataattttagattgagattcagattaaatccgaggggaaaacactttatgaggctgaaagctgtgtcgttgccagagacagggttatgagctatcaaatgcaattacattaagacagattatactgggcaaattgagccatttagaaggtgagaatcaaagaaacggctctgatcctcttttcccccttctctctccctctccctctctctctaaattgcagttcgtagttccttccaattctgaggcacaaaagtaggtgagactgcttttgtatctgcgaagtgcttcactcctgaatgtaattctagctgagtgcaatctaggttaagagccggacaagcgggtaattagagcccgctagctgcccgaggaccggccgccccgccaaagcgcgccccgagtcggcgcccttctcccggccgagcctagctgcggctggacacggagcgcccgagatgatggtgctggacaaggaggacggtaggtggcgggccggggtctcgaagcccctcaccccctcgccccccgccgcggcgcgcaggcacacacacgcggggacacgggcgcacacctgctgggctgtgcggggattgcggggcgggcggcgcgctgggggccggggctggggcggggggaagtaccgggggacagccgggcggaacttgcggggggaggaggtcgagccccgggctgcacgcgcccggggccgcacgccccccgggtcccggccgcgagccgaggagctgtgcactggccgtgtgctgcgccgcggggccgcgcggaggctggggctcccttgcgatctccgcgccgcggaggttcgctctgagcatttcgtgtctgaggctgctgctctcaccgcagccatcaccctcgcgccagccgccgcgtaacccgagaggcgctgagcgccgagcaaatcagcggcttcggggagaatcgggctccagagctcggggcaagcgggagcgcgggaggacggcgcgagcgccagggtgcccggcaggcgaggggaaggcgggttggaccctccgggggacatctgcatgagcgtgactcggtgagaaagagagccgcctcttgtgccggcccgctagctccctgtctctctgagcgcggaggcgggagtttggcccagaggaagaaagtgtcccgccgccggccggtagcacttgtgcgggagcggcctgcgagagtggcacggaccttccgtggtcgagcctcagtgcgccctagaaaactgcagggcacgggaaaggtcggaacagaggagcccatggctgctggaagccactagcaggtggtcccatagaccccaaagccttactggcagggagtgccctgcagttaagtgtcctagaaggctggggatcccagcccccttggggggaaagccaagtgggtgccctaagatgagtccccagggtaaggagagaggcagtaccttggctgtcccaggacctcctgccctgtaggtgaggcctgtgtgttggtgttgcaggggcatttgtatgtgactgttggtgcccacgctgccgccggcgttctgccattggtgaggtaccgaaagggtaggtttgctttgagtcagcgggaatcctcttaaagtgactgtagtggccatcctctgcccttccgttcaggagtctctgctgggcctgagccctctgtccctggggcagcgttgttattgatgtggccagttggtgaaaatgcaaagctaagtgacttgctcagggtcacacaggatgttcgcattgccgctgccaggtgccgatgcccccaggctgctaccgccttctgagacatccagcagggagggggaatttgaagtatctggcctgggggtggcatctaggaggacctgtggctctcagtatgtgtgtaggaagagagaggatggggggaacctcagtgcttctgggctagctggggtgggacatcatcttcaatatgtcttctctattcacggaccccttccctggagccccatgtaggccatcggagaacttcatatagaatgaaaaggagaagaaggggtctggggttgggccagacagggagggaagagaccttgatttggtgcctttcatcacgaactccccatgttcaccttccctcttggtaaaaatgaagggcttggagaagccaggggagagggtacttccttggtacctggagatactgtcactatggggagcatgcaaggttcatctttagcagaggttatttggcatacttggctccccaggcccaagccaggaatccagaagactcgggctctgtacgtgagaggcctcaggccagggagattggtctcatgccaacaagatgacaccccctacctgcacccaggatcttgctctgcccaggcaccacatgatgcctctggctctgagataatacaaagggtttcagatgagccttgagtgagaatggatttctggaggtcattttagccagctccctgcctccaaattgcagtgtacctcaagcaccctgggcagatgtttcttctggtttctgctagatctgtggaagagagccccagatgcccctccatccccagcctgtccagcctaaacaatatggtgcccactaccatggagctgctgggctctggggtccattacagcacaagcacatccactggtgtcctaagcagccacctattcttgtcctacccagcccatagctgtctttcaaaagcgacgtttctgctcatgcatctgcactccactccctattaagaggagtctggcctcccatagttccaggaaaccttgaagatggcatcttcaattgggggagggagaaaggttctggatgcactcatctgctcctccaaaccaaccacctatcttcttcttgaacgcttctgccctctcagcaggtggctatctgaactgggtggcagcattcccccaccccccggctcccccaaagggtgcgttccctgcatacggcaccttttgtctggctgcagcagggactcagggctgctattaaccacccccaacgccttttctccacctgacagcatcttgtctggagaggctggggctcctctggttgaagtcgggtctgccagctgccgaggaccaaagctcccgctctgctgggctgcagggctttcatgttgcacttctgaaagataataaaatatcaatcgttttgccgtagcaacgggtttaagagactttctgaagtattgaatcgtcagaaaaaaaaaatttttttttgcttttaagcacagtgcattattaataaagtaatccattaggtcgagcagtgaagggtcaccacagagacggaaagatctgttttgcaaacggttaaacttcgggttttaagattaattgctttcatttggatgcttgctcttggcctagccatctccactttactggaactcagggtccgggctttctacatgctgctgggtctgcctgtcagcgaaatggaactgagctccaactttcccggagaaacagcccttcttcccctggcacctgcggcttgggctggcaccaggtggtgagctttttgggagggttaaaatcccaagggagcaaggagagctacagctctgaatgctacccaagtcaaatgagcccctgggctgttcgagaagaggcctttgagtaggagcagacagcagagagtctgagagggcccaagaacagtgagagctttggtctgtgggggactgggcaggagaggaggctggggcatccagctggggatgctgggatgctctcaggtgcacacaggagaagggcagggctgggtataaacggcctttgcaaaggcccagcaggaaggtgggggtgaccacaggaagcagcaggcgggttgtggaactaaacaccagacatgattcctagggcatttttaataagtaaaaatgcccaagagagtgaagctggactgaggaggaccagacagcggagtcttcaattgttaatgactgctaggagcacaaattccacagccgactcagttaatccaccagagccggcgcatggctatgcttgggtaccaaccagcccttgctgggccaccagtaggatttcctaggatagacactcatgttctagaccacagagaatcccaggggcctctcctggcagagtgtgctcatgaccgtcccaaccctggagagggaggcaggccctgatgctgttccatgccagagaccccagcccatcagcaggaaggcggagccaagtggacactgctgcctgctgaggcctggtaaaggccttgtgagtctggcagggtggggaccaaattgtgcacttgcccagtgcctagaagcaggggagcgggagggttaccatctgcatctaccatgaccagccccagcggcagccctcctttctgctgggaatgaggcatcacatcctgagctgcacatacagccacttccccttcctgcccaaacttagccaggcagagtgtctgtaaagatgggtaacccgccccccaaccccacacacacacccgagccttgggtgaagaagcaggtgcttctctctgttccctgctcttccattcatttgctcacacagagcagcactaaggggggacagggaaacaacataaattggtctgtcgtccggaatccatgtctcgctaatgtacccagattaactcaactgtaaattgtctccttggatggcggtgtcttgctaaaagtttcccatatgattcatgatttggattgcttttaacggctattggctaagcaagccagtgactgtacaaggtgatgcaattggcattagcgaggggaggcacgggagcgtgtaatgcagtcaatactgcattaactactgatgcccaattacagggagcaggagagagcctttcaggagcattaggactgggggaagctgagatcactggccgctgctcgcctaaaagcttcaccctttggatgccggggctcagtgctggcatgaccactcacttggcctctgtggctgtgggaactgcctttttctcttgctgtctgtttctgaacatgtcctcaaagatgcctttagcacatgaaaatgtatgtttccctagagctgggacccgcttctcatccctcccgagtaattgattccttacccccaccctgtgtcaccctgtgtctcagagtcagaccaggcagctgccccataagcttccatttaaggaacttcacagcaggctctatttgtgggcaggaccaagaggaggtctattttggtctctcaaccttggaacagatggatgattgccagtgagcactggcagttgactccctgtggtcatgggcaaaggaaacacgaggttcagccatggcccagggcgaagctgccagagttgggaagtggccatggctagacgggctgggctgtctgagcagaagacagagccgtgatggtgcagctagggaaggctgggggtgagtgccttgagccacgttggggtctagagcagatgcaggcccagggagttaggagctccctccagagctgtgcccccatatagcagggaggccaaggctgttgttggatccatctccagggtccagagggcctcccagaaagccctgatcagggacattgagaagattggaagatgttagggcagaaggtagaggtgtcccagtgtgccaggcactgtttgacttgttgccacctctatcattgcactaagctatgtaggtccaatatgtccactgtgattttgtgttccatgtccacccagtgtagaggttgctttgcttccaaacctttgcctctctaccttctcgtctctacagtgagaacagccatatctaattggcaggattgtattcaggattaagtgaggtactgtccatgtacacatttgataagccagaaagcctcatggctgtgtggagcaacattgctccatgctcagttacagtatgatctgaaataactctgtgtccagtccagtgctttgtttgctggcaagcactgggcctgcaccctcactctgccagtttatttatcatggtccttaatcattgctgcctgggaggcaggctgacctcactactcgcccacgtccagatcaccaagacaggtggcaccttgggaagaggtctctaggaccactctttgcaagttcctccatttatagggggaaggttgaggtttaaacagggcaaaagggctgcctagggttccatggggaattggagcctagagcatcagcatctttttgccatgccttctgccctagccctgaggcgtgatgaggctaggtggtagaaaactctgattacagcaaacatcagctggactgggaccacggaccacgtgcttgggtgtcccagttatgccccttgccagcctactgacagcccagaagatgcagttctatcctcagatgtaaggtgaaaggtgctgagggacactcacctgtcctgggcctttggaagtggagaagccccagaggttcctatggcatgtgtcccatcttgcttgcctgtcctgtctggagttggaggacactgagacatgcaaggtgtcctcccatttccaggcttagctctttgtggtgctgctagagtgagttttcccagcaggcccatatttgggattggactacaccagtggagtcaacttgtcctggcttgcaagagattctgtacatctgttcccaactctgagttcagagacactgcattggtagcttgaagtcagccacaatgggagtatttgtaccatggatgttggcaaacactacaaatcagggcattttcccaaagacttggtcgttaagcatgcatcagcacaccactggattgcattcatctgggactctggacctacccttttctcctctgctaccaccattctcatctcacctgctatctttcttgtggtgctcattacaaccagtctgacccaacctctgctaccctggcatcctgcctgaggcctactgctgctttgaccatcacactaaactatgcaggtttagtatgtctgctctggttttgggttccatgaagactcagcatttgcctctattcccttgttcctatgtcctccttgcctggcatgccctttctcctttagttggctgaggcttctcccaggccattccaggccatgctcagagacacatccaccaaacctagcaacaagcttgttcgctactggtgggagtgtgttcgttttgtgttctgtccaaggcaggagttcacagtagctgatacaactgggggcaaattaaaagcaggtggtgtgagaggagtgagcagattggtccaggtcgcagaggcagctgcccagtgtgaaggcccatgggctcaggtcactagctcctccctcctgtcccttcccctggaggtcaactgggctttcttgagtggcctcctgtctacaggtgtagtccgctagcatgattcagaaaacctgggttttgtcccagctgactgctgtgtgacttcagcgcactgggcctcagttttctcatccctacaaagggtgaaacacctaactggcactttatgtccaagcacacacttgataaaccagaaagtttcatgcttgtatgaattgacattgctctctgtacagttacagtatcatcttttggctttggcctctcagtctttaggagtcataaaacactatagctatcattatactgaacccgtacttaaaagtgcagcattggccgggcgcggtggctcacgcctataatcccagcactttgggaggccgaggcgggaggatcacgaggtcaggagattgagaccatcctggctaacacggtgaaaccccgtctctaccaaaaatacaaaaaattagccgggcgtggtggcgggcgcctgtagtcccagctactcaggaggctgaggcaggagaatggcgtgaacccaggaggtggagcttgcagtgagccgagatcccgccactgcactccagcctgggcgacagagcgagactccgtctcaaaaaaaaaaaaaaaaaaaaaaagtgcggcattgtgctatctgtatgtatcaattagttattgctgtgtaatcagttaccctaaaatgtagagccttaacacaataagcatttatttaactcaaaaatctgtgggtcagtgatttaagcagggcttggctgagcagtttttctggtctcagctgggctcactcacatctggaggatggaggatggctgatcagttggatgctgggcgtgacaagactgcatggccctcattagccagaaggcttgtccgacttgttcttatggcagagaccggtccggaaggtgtggaagcacaaaagccttctcttttttgagacatctcactctgttgcccaggctggagtgcagtggcacaatcacagcttcctgcagccttgacctcttgggctcaagtgatcctccctcttcagtctcccaagctgagactataggtccatatcaccatgcctagctaattttcgtattttttgtagagatgagatttcattacgttgcccagactggtcttgaactcctggggtcaagcgatccacctgcctcagcctcccaaagtgctgggattacaagcttgtgccactgcgcaccaccacacccagcctacacaaggcttcttgaggccaaggtttggcactgggatcttgtcgcttctgctgcattctatcggccaaaataaatcacaaggccagcccaagttcaaagggtggagaagcagattctgctcttgaaggtaggaggtgaaaagtcatataacaaatggtgtggctgtggggaagggtagagaattggggccatttttgtaatcagtccaccaagcatcttccatgtataatctcatttaatacccataagaaccttaggaagaagctactattaccctcattttacagatgagaaaattattgtacaaagagattgagtaattggttccagctcccacagctcaagaatgccagggctgggctgtgaacccaagcaggctgactgcagagtcagtgcgctcactctctctgctctgtctgctcccttttccagctgtcagacgtggggatggagagaaagacactcagagttcaaggaagggtgacgaacctgtgagaagatgacttggggtgggaggaaggttgctgtgggcagtttgagtggggctgccatgggagcccagctccattcctcccagggccagcctcggtggggagggaccataatcaggtcagtccccgttgcctctttcaggttttcctctctgtcctgcaaagccactagacggcttgaaaggatgtgatgttctgtgttccctgagctgacttagacctgagcatatatgcagatgcagccaggtgagaatcaattcattggttggcccctagcctcaaaatggggtggtaagtgggctggtgagaggcctgtgtacattcataaaccagctgattgaaaagcaatatttcagataaatacaagccagcgatctatcagtggttgtaataaaacccaggcttcaggctgtgattttattttgaaataataagaattgcttgattctttttacttgagttaccatggtaattccggcgtggagcagtgttatattgatttagaaagtggacagtaatatttcttttgtgttattctgtttctaggccttgatttctaatttccacttggagattacttttataaatttcttaagtccttccacttttttttcctctcacagtataattttcctctcatacgccgctatgttctgagcttattggtttgctcttattttaaattaaacttgctggtttcaaatattgaaatgacatctttgtctgtgtctgtactttggtttagcaaaatattacagtctgacgcattctgcttaataatttaggggaggcattctgtcggccctcactgggtgctgataacttatgactcaaccaacgcaggccttaaactcctgacattttaatattgtgtggcgggagtggctgcccctcttctctgagtctcggcggggaaaaattcgtggggtaccccagaaaggagttttaataattcaactttgctggttggcacggtgacttgatagagagcaggagggagacccactcttgccagacaagtgggagcagtgctggcctgggctcctacagtcctgctccatcctgcgtgtcctctcccctcgatctttaaaaaccccaatcctgacgacagtatccaggaaggactgtgtggggctacctgcgggtgccatcagaatgttcaaactctctgattctcagttttcctatttgtaaaacaaataggaagtgggctttgagtcacacgggttcaaatcctgcctctgctgctaagtcattctgatgagtaaattctaataataattccaagtagtaaaatgggtatgatcacgtttaccttttaggtctgttgaaacttgaacaggcaaagcttctgagagtcttgtagatgactggtgccatttctctgtcctccctggggtactggtgagagcaggggagacaggggaagtggatgtgctttggaaagcttgccctgctccagacaggcctggagttcccagctttgggaggattgctctttggaaaggatccacggctgtggctccttgaggacgtgaggcagcttctcccactttcctcgtctgcccagctgagggcagggggcctgggtagggcagttggagacagggctctgtcctctgggctcctctcctcgaaacactccacatcaaggcctgtgctctaggaggaagttcacaacaacacgggttgtcaggcagagagctgtctgcagggccccctctcaatggcctgaggagaggacccttctctgcagagtatatatgccactgtggcagtgtattaattatctacagctgcgtaacacattccaacacacattccaaaattagcagctagaaacaatacctacttattctctcgttgctgtggaccaggaatctttacttggttctctgctccgggatttctctcagactgtgatcaaggtgtgtcacctggggctgtgggttcatctcaagattcatgtggggttgtttcaagctcagtcatttggtggctggcagaatgcggttcctcacgggctgctggactgagggcctccacgccttgctggccatggtggccatgccgtatgggcctctccaacgtggctgcctgcttcctgaaagccattgaaagacagtgtctgcttacaagaaggaagtctgtctatgaatcacagatgtgacattccatcacctttgctgtgtttccttccttgggagcaagccactaggtccagcccacactcaaggaagtggggcagatgatacaagggtgtgagtgccaggaggcaggatcactggggaccattttagaaggtggcctgccatgagaggccagcctctggaatagcagctgcctccagagagaatgcctcaccagctccattcccaggaggactcctgggtcacctcatgccagggaagggcacagatgtctcggagtctttcatttcatcttcacaacacccttgggaggctaagaggacaaatactagccccattttgcagaggactaggttgtgtccagagaggaaaagacacttggctgggataccccagcaagttggcatgttgaagagtttaggcgagaaacaggccccgcctgccatgagcctggggaggtggcggtaaagacactcacaggccctccttggctgtagctgtgggagggatggtgctgaatatgtgtggacacacacacatgctcacacacacactcacacacattcacacacacacgcacacccccacacacgcacacccccacacacaaacacacactcccacatacattcacacacattacacacccaccacacactcccatacacacctatacacacacatacactcacacacattcacacacacacgcacacccaccacacaggcagacacatgcactctcacacacactcacacacgcactccacacccctccacccctccacacacaccacacacacataccacacccctataccccccccatacacaccacacgcacacctacctgcacaggcagacacatgcactctctctctctcacacacaaacacacacccctggaccagcgccgggggctgctggatttttttctcacagatggtcagttttccaaggctgggagggccctacaaagccaccccagtggggtctctcaccccagggcctctcttctcagtccgcagggatgatacccgcagaggaggtgagggtggttccttcctgagccagcctccccgctgctgttggattgagggccccgcttctttcctggctgttacggggcggtggaggcggcatttttgaggcaggctgggtaaaggtagtgtcggcagttcctcacgtgggagcagggtggaggaggctctcctgtgggctggagcactcccataaacaggctggtgagcacggggctgggagccagaactgctgcatccacatcccagctctgccaccacctcacagtgtgtccttaggctggtcccttcccctttctgggtcttggtttccccatttgcattcccagggtggctgctggcttcataccttgtggtgccatatatggagacatgactgttggggaatgggtgtggcagggccaggccagcagaaaggaactcccagtgaggtctctttctctttcactggacttctggggtcgggacacacagtttcccaggtgagagcatctgttgcccttagccctccacacttggtcttgtcacactcgaatccaggtggaaggccctgtcccctgctgtttccaggtagagtctcaattaggaggtagaggggacccctggagcaggttcaaagcctggaggccagtgagtggaagtcatagcctagggctgagagtaccccaattacatccttttatggctggggaaactaaggcaccgagaagcgtctgcttcctttctcagctgagtgtttctgaaatactttctgagtagaaatgtctgtgcccagcagaggctgcatccgactggcatggggcctcgggctgcaccccagctctttgcctgtcagtcagaggctgtctcttccaggcagctgctctcccccgagccagaagctgtttcccatctgtgaggcatcttcttggcaggggccagggctccagggagcagtgggcagtgggcagggctccctcaggcacctggttccaagctggtactccacccaaatgcagagttcaatgctttgacctgcctttgtgccctgaggatgttttcatgctattctttgatcctcagagtgtttatcagatcactgctaaaatatgccttctacatgagcataagatctcattagtattattgagatattattctcaaaaaaaagatccaggaagaaattaaaattggttgaaataattaacacaaagtaaaactggcgacaactaagactgcacctggtaaagtatgttattgactaaaaattgacagaagaatcaaatcttcctgacaaagtttagatctgcagaagttggctcaggaaacattttctggtagaaataattgccagaaaagaaatcccgacagtggcaaaaactctaatttgtgagatctatagtgagccaaaagctgatcataagccaatagtcaccttcaacaatttaaaaataattgatcccgatgaaaataatctccacaaaaataaaaaaaaatggggaaaggtgaagaaatggtttaacatgaatgaatagaaaagtgatcaaggaattaaattgacttaatgaagctcattaagagttactttcttgatgaaaaatcctcagttttggtataatttttatcaaaatgtagatgttaagggctagcccctgctggtagatgcttagtaaatatttgttgagcggataatgaatgaatgagtttacaggtgaaggaggtcaggagaggattggagagaatcataaggattcctttgtctcagagagaggacaaggaaccccaagttcaagactgcagaggccattgtgactggagcttggggcatcatcagtgaggctgcagggtggtcagggttggcagcgctacattgtgcagagccttgcaggccgtgggtaggagttccagtttctccacatccttggggcacatgtgcaggtttgttacatgttacatgggcatactgcatgatgctgaggttcggggtatgacagatcctgtcacccatcagtgtctgttgttcccatctttatgtccatgtgtacaacgagacacctttgaatggctttaggtagaagcaagactcatgctcaaatttacattttattaagaccatttggtttactctgtggagagcaaatgggaggggataaaactagaggcagagaaagcagcatatgatggggagggaggggttctttttcagctttacagatggacctctcctcatccctctggcttcagacggccccacactcctgtctgcctcccttcagtttcctccagagctcgcagtctgggtctgtgcagggtgaggcaggtgggggtctgggttggtcagaggaggcagttgaggtctaggagagaaactgtgctgaagctgtggccttgggaatgggagctcatctgaggtctactggtggtcaagatcctggctggagctgctcagctccccgtagcagggcttgaacttgtggccagagctggagttgagctccagggaaggtagaccagagcccctggctgcaagcctgtccttgcccagctttgtccctgaggcccttgcttgcccagcccagctttggcctgaaggcttccctgacccttcacttccccctctgctgctgtcatgactggaccacaatcctggctttctaggctctgagggagggagccaaagactgtgggcctgaggcaggtaggaggacactaggactgggaggcagcaagtctagacctatccagccacccatggatcagtccctgactcctctgacctcctctgatctgtctgtaaagtgtttcttggccctcccactctgggccagtgttctttctcccgaatggctttcatgaaagctgctgattctgggaaagaggcgtggctcacggtctccctacccttacctatttctactccagtccacccccagttatattcaactaagatcagtccagagaagagcagaacttgtctgaggctgcagagcacctccgtggagtctgggaactatgcctaaggtcttgcctctgcaatgagctgtccctcaggggagaggtctgtatagtggtctgtctgtagactcaggtgtctatgtggtgcatgggcaccactcctgcctggctgcccagggcctggagacccaccagcccactccatgctgtctcaagggcacacactcttctccctgtggtccatactaccaggaatcctgccctcccttccatggcaaaggcttcggactcactcttccaaggagagagaacccccaagagcaccagctcagatacatgcagatgtgaaatctttagaattctttgaaattgatggcagcggcatgagggcctgaccgcttgctgcaggggtagctgtcttttgacttgggaggtaacaagcatggactgtggtcctctgactgtgagatcacgggcaatcttgctctaccacccactgctgtgtgttattgggcaaaccacttaacttttctgagccctggtcacgtaagttaagacccagaacatcctccctgccccctgcacagaactcaaatgacagaaaatgttttcatgtgttttgccagccaggcagcactgtgcccacccgaggaggtgttggtgagaacacagtggctacataaagggaaggtacttgcaacatgtactcctgccaccccttaccttgagaagtcttctcatccctgggcctcatagaactttgggggagaaatttagagaagttccaagggtagtttccctaaggggcagcttcccaagacagcatttcatgttgaatccatgtagactcagggaactgacctaatgactagaaaacgagcatgtgtccacttgcttcaaggcccagatagtcctttcaagtgaccagacctgtcctgtcccctccatagggctctctccattgtgggaggattggaggctggtcgcctctgcggagatgaggcctgagccgctgtgactactctcagtctatccctgctcattcccaactctggggcaggcaaatgcccctgccccagtgcggccccagctccccctgctggccaggatgcttcatctttttgggttgtcctctcagattagctacaaagggtgctgtccctagtctgggcatggtgctctcccccttcaaaggcagcctcgttgctttccttcctaccctcgtggactggatctaagctggcacatccctgtgccaggtggggctcacaggccctgggagagggcagcatcccttacccaaccctgcctgggggagtccttactatgatgctattcattatgcatgtagcattatgcacatactgttatgtactcgtggtgtccaaggtaggacaagctcaaggtcctgaaagagggacccccctgccatgggcatgctcagtttgcaggtagggcatagtccttgaaggatgcagaaatttcaacaaagagagacctgggaagacaaaatgagaatgcagttgtggaagcagatgggccaaggagagtgatggatccagtaaggtttgagtttcctggggagcagggctggaaaagtggatggagtcagatttctggatgtgggggtctggggaaggaggtaagggggtgctctggagccctttcatccctttcatcccagcagggggatgaggtgaccagggcctgcgccctgtgaggctggccatggggcctcccaggtccccccacctggcagcttctagctgccacaggttatttccccccctatgctgaccccaggactgaatattttatgaactggtttctcctgttctcaaaggaatatttatttgtttttgtttgttttgttttataatagctttattgatttatcatttgcataccacaaaattaacctttttaaaatagatactttagtggtttttggtatattcacagagttatgcagtcatcaccattatctaattgaaaaacatttttatcacctcaaaaagaaccttcagcccattagcagtcactccccattcctccctccctggcaaccactaaactactttctttctgtatagctttgcctattctggacatttcatataaatggaatcatgcaatatgtggttattgtatctgccttctttcttggcataatgtttgcaaggttccttcatgatgtagcatatgtcagtacttcatttctttttgtggccaaatcatattccattgtatgtatataccatgttttatttattcgtttgtcaattgatggacatttgggttgtttctgttttttggctgttgtgagtaatgctgctaggaacgttcatgtacaagtttttgttaagacctatattttcatttttcttggggatatacttaggaggggagttgctgggtgatatggtttcgatgtttgtcccctccaaatctcatgttgaaatgagattcccagtgttgcaggtggggacaggtgggaggtgattggatcacggggatggctccctcatgaatggcttagcactatccgcttggtgatgagtgagttcttgttcagttcactcaaaatcttgttgtttaaaagagtgtggcacctcccccatctcccttgctcccagtctcaccatgtgacttgctttttccccttcctcttctgtcatgattggaagcttcctgaggactcaccaggagcagaggctggaaccatgcttgtacaacctacagaactgtgagccagttaaacctcttttctttacaaattacccagcctcagctatgtctttatagcaacacaagaaagattaacacactgagtcatatgaaaactctgtgtttggggatatttgtttttaaattcaaatgaatagtacatgagtgtttaggagagaagccatccttggttgtccgaacttccggaagggaggctgcccttagcctggtacttccccagtgagatcctggggttcattggcactttggataaatcttttgcctgctggcttcagttttctgatctatgaagtggggttagtacggatctttgctcacctcaagggcttctgtaaatagctactacttgcctagcatatcaaggatagcaaaggacttctgcttgctttaggtactttcattcttcagccctacaagttgaatgttattgctctagttttgctgatgaggaagctgaagctcagagaggctaaatgacttgccggagttcacaatatgggtcgatggcagagcctgaacttgaacccaggctcaccagagtccaagtccctggcctgaacccttgcctcagatgtgtctctaagcaaggcagggcccagacatggccagttgtaggctctgaagcggagcatgctgtaggagggcaaaggatgctacaaaagtccattttgagctgtgtgactttagataagttgttccacctctctgagcctcagtttccccatccacaaaatggaagcaataattacaacttacagcaccacaacaaggacttgggaagatgctgtacatgaagtgccgggcatgataccaggcacacagaaggtagttggtagaaggttatagggcacacgaggaggggtgaagaggatgcagggtactgtggaactgtcggggagaagtggctggcttctgggctggtcagagcaggctttaaggaggagaccttgcttgggctggccaggaaggtgagcagaaggtggagagtcccctgggaaggcccagtgtttactgacctggtgctgctgaaaaccatgaggggtttccagggttctcaagagatctcccatgttgggagtttgtggacagcctctgctggtgcccccagcccttacccccaggccagcctgcagatgcctgagaggggggctcacatgactgcctcagttagcccgagtggtaataaaacactttaagtttattgtgacatttggatttaattaaaaagtacacacttagggaagtagaacataatggggagagaggcagggtggcttttcccctcctttcttccccaaactaattagcgttgtattttaaattgtttatgtgctgctaatcatcgtaataaatcatttatactgaaaaagacacactcggctgtgcccgccatgcgggttccgctcacagggctctatcgtgaacaaattgatctggaagtgaatttattaaccactagggaagaaatcattagtgctttctctaaacattccccaggtacgctttattgctgcagtttatgctgtaactaagaggagccttacccaggcccatgttgtaatttccttgcaaagccagcagcccactcccaagctgggggctaggaggggctggggagtccctgcctcctctcctatatgtgatctggtgaccccagcctcctttcccggtgctccttattccagaaagggctccctgtgaagcccctgcaggcccgaggccacggtggctgtattctgttgtctcttacccacagggtggttcacactcattcatgtttatgtgtcaggagtatggcttaaagttgggagctagccaggggtttggaaaactctggggctggggctgagggagtcagtgatctcaaagaatcttgtcatagaccagcttccccacccagagatggggaacacatgcactgtgagctgatgataggctgggaggcacaaatggggctcaacagggacccaggcaggagtggggggctgcagccgaagctgccaggaacatcctctgtgggctcatgcctccaaaggccttcctactgtgggcctggggccctttctagggtttggctagagcagtctgttctggcttggtgaggcccactaccccgtgcctccttgtccacctcacctgggtgcagggcccagatggtacttgtactccagacatggtctgacagatgacagacagcatggctgtcagctccctggctgcagactctgtgctctggataatgcagcctgcggccataccagcttgcccagcagccggcccaccctgctgactctcacacgggatgacactttccctttgcacttgggggcttcagaccactctcacttcacaggggctgcactgcaagacactcacagcaggctttctcccaccaggtttccggaagagacattcacttctgaacaaggatcttctgcctgggagcccatggctggtttaggatacagatcccaaactgtctgactccaaagcttgtattctaaacagcttcatctacggatgctccctgaacctcctcagccatgcggggggctgaagggaaatctggctcacgtgggccttgctttcagcgtctctctctcttatccaggtctgcaaagaagggctgaagcaacccccagggcctcaataggaagccccggggcaatgcctcaggcaggcatcccagaggcagtgctgtctcagccccagccaaaggggtttccatccctgccgctcttgggggtggggcctggattctccctcttaacccccagcccttcctcccctcacccagccccgtggctagcagatgggctctggcggcttcaagaaggaagcaggacccggcagctgcctgggtccagcttgccgggagggtcccctctttgtgcctggagaacacatttaaaagtttgaattcaaaattgattttgaagggccctaatctcccatcccctggtgctcatggtgtgtctgcagctcctgccagactctcgttttctggttcagcgcgctggtgctcacgtccctgatgctgtgaaattgagactcgtctgagagtccatgtcctcctcctctgtggagactgcaggcctcttgggagccctgtttcattagatgggtgacgcgggctttgcgggtgcccagggagcagctgagttgccgtcaggggaacacagcttccagatgctctccaccggtccccacagctgtgcagcttcaagcggcatcctgttaaggaacacaggggctggctccagcagcccaggatgggatgggggttggtggaagctacagactgagaaaggcttgggcctggggcttttctgtagcaaactccaggggtcgcttcctcccactggcccccagagacacagactatgctgacagggaagagtagtcatttttgtaagccaaaaagaccctcaggcagggagctggggaggctaggtctgtgccagaggtgacagccagagctgctggaattacagagatacccgctaccccctgagggctgagatgggtatttatgtgtaaagggaggcacgcagtggaggcaggggctggaggatgcgtttttgctgctcttttatctaaaggataaagggtttatatttgcatgagagctgttgttcctcagctggagccctgggatggcttctcaaaagcctggattgtggcagccatgacccaggagctgctgtggttgaatctgctttgtttgttagggccacatagctacaggtacctagggggtgtggcacaggggcagcaacaagcctgattaaggctccatctctaggggccctgcctatctgaattggcccactctggccagcagattcttgccagtaatatctggatagattccattcagtctcttcatgcatgaattgagctgatggctaaacaatgactgctgtggggcacaacactgggaacacaatagtggacaaggcatgtagggccccaagaacagccttcatggggcttttgttcttatgagagtacccaatcaatcagacttttttttgttttttttttttttgaaactcacagaaaagtaaaacaattacaaattgtgatgaaaaactcagaaggaaattactgaagtgtggggagctcatttaaataatgaaataaggaggtcaagaaaggcttctctgaggagatgacatttaagctgaagcttgaagatgagaaggagccaagtatatgcagaggcagaggcagggaagggtgttctgggaaggtaatagcatgtgcaaaggccctgaggcaggaaggagtttggagtatggctggagcacagtgtgggaggggaaggcagacaccagaccacatgaagatgttacaggctggatgaagagtctgggtgttattctcaggccattggatgttatggaagggtttcaagttgagcagtgacctgccctggttcatctggaagatctctccagctgccgtgtgaagaattggctgtgggtaccagacatcatgccatgctggcagtgcatcgagagacggtgatggctgtggaaatgcaagatgcaggtgggatgaggagcaagagttggcagggaaaggggtgagggggatggaagtctgaagacgacacttagtttctggccagagtgctgggtggatgatagtgtgggagggaggaagtctggggtgagggtacaggggccaggtttggggaagaaatcaggaatcctgctttggacctgttgtttttgagctatgtctgagactttctagagacaaccaaagaatggaaagaaaatgccaatacccatcctggagaaggagaacacattacagataactatgcaattaacgtaagcctcattccaagtgacaaactccagtgagcacatgcagcttctgatgtttctaaattccccccactaaagaaccacagaaaattatgtgaggctgtgagagcagactgcatctacacctgctccagaatcactatgctccagaattacatccaggccttcctgcaagctctctatgatctgagtgtttgtgtcttcccaaaattcttatattgaaatcccaacacccaatgtgatagtgttaggagatggggccgtttgggggtgattaggtcatgagggcagaaccctcatgaatgggattggtgccttcttaaaagggaccacagagaactcccttgccccttctgccacgtgaggatgcagcaagaagatggccatctaatgatccaagaagcaactctcaccagacacagaatctgttggtgccttgctctcggatttcccagcctccagaactgtgagaaataaatttcaattgtttatatgccacccagtctgtggtattctgttatggcagcctgaaccgactaagacagtccccttaggctgttgctgttgccccaaaccagagtcagcttccctcaacaaggaagatctgtgggggatgtgtggaaactcctcagtccctttatgtcatggtgagttcaggctttagatgcagtattcctaaggataggttattcttcaccaaaacgcactgcaaaaatgcagcatatgaagcttcccgctttgtactcctccacaggaaatggcccctctggggagctctggggatcagcagcccaacctttccctgacaaggggtcttttatattcctgcaaggagtgtttcagagccgtcttcttttggtagggtccagattgggtccaagtgaaagttcactttccccattgcttggagaaaagatgacgtgatgctgcctctggccctgggacacagcaggcagggtgtggatgcctcctggccagcagcctggatctgcagcctcgctttggccactggtggctttacccttgggcaagttggtgagttctctgcactcagggtcatgacaagcatatgttcctggtacagagcaggcactcagtaaggggtaacatggtttactgtcatctggttgaacatgactatggtggctgcaggtgctgggggtgagactggacagtgcttcccttaggccttccctcctgtggtgggctctagcgtgcaggagaagcttggcacttagagcagacaagcatcgctggacttcaccctgaaccaggcccctctccaggacttcttcagctccaaatgtctcaccctgagctgggcctgtctccaggacctctctgctccccgccctacccatcccctcattcacacacaaggccctggctgttggttgaggctcctgccatcattatagccctgggtctggagtccccagcccagcctcctcctgaggacgtgtgccatctcaaggcttctttgtccttctcaaagctgcgatgcagacatcttggctctgcttctacatggccctctgctcccttcccagccctgtgccctctttttacttagtttctggtccatgcccccttgctggctctgcccagaagccctttcaagatcccacagcagtcatagcatttgaagaaccaatagatgagtgggaaagtcctgtggtccacccagagacagtgccctgcatggacagtcattcctcttggttttagcccgggccctgatctaagtatgtccccagcccccaccccagcaccatctggcatccaggctgcaccggagaatccaggctgtgcagggaagccctgggcgtgtgctggatgggaacttgaactctggattctgacaggccaggattccaatctctgccctgcagcctcctagctgcatgactttgcatgacctgaaacttcccaggccaccgtcttctcatctgtgaaatgggggtaatcatttagtgcatcagagttaatatgaagattcattgagataacactgtaagatggttagcccagcacctggcacagtgactgctgagtaaatggtggggtttatgaaaggcatacagagctctgatgagggcatctccatctcagctccgtttttaaattgggtatcacatatatgcagttaaatgctcaaggctcaaatgttcagctcagtgaatttttgtacaggtatgcacccatatcaacactcagatcaagacataggacattttcagtacactgggctccttgtcctcctctcagttgataatatgtcccccacctcaccccaagtaaccagtattcttttttttttttttttttttttgagatggagtctcactctgtcgcccaggctggagtgcagtggcgcgatcttggctcactgcaacctctgcctcccaggttcacgccattctcctgcctcagcctcccgagtagctgggattacaggcacccgccaccacggctggctaattttttgtatttttagtagagacggggtttcaccgtgttagccaggatgggctcgatctcttgacctcatgatccgcctacctcagcctcccaaagtgctgggattacaggcgtgagccaccgcgcccatcctccaagcaaccattattctgacatcagatcggttttgcctgtttgggaactacatataaatgaaattatacagtatgtacctttttgtgtctagcttctttcattcaatattatattgtctgattcatccaggtagtatatattagtaattcattctttttaattgctacatactattccattgtacgaatataccataatttatttcgttttactgttgatggacatttatgttgttttcagtgtggggctactaagaagaaaacgtctatgaacatttttgtgcatctgttttgatggacataagctctcatttctgttgggcatatacctaggaatataattgttgggtcataagatacaactaaattttctcagctaattgctttatgctactatgccaaacattgttataagtacttcatgttgattatccaatttaatcctcaatcctttaaagtaggctgtcctcatttagcaggttagtaaattgaggcagagctgggaagcaccaaagccagaattcaagccgaggctgtgtgtctgcagggcccacagtctcagggcctacactaccccacctcttctcacaagctcccttgaggggtgagcagcaccagagtcaaagctgccagtccctctactgagctgactgccaccccatgggcggagcctagcctctcagccttcctctccctgccctcgtggggagctggaggccataggagcccctgcctctctccctcatcctcacagtgaacacgctgcctgcaagagggtgtgcagaggggcggtaatgagcgtgctctgggtggctgtagccgcgcgtttcaacagttgttctcgttggcttttgattccaaatgagtaggaaatgctattagttcaggcctcgcctgctgcatggcaaggccctggaataggagtgcagtgagacgagaaattgtggagataaaactggtgtgaaatggaggccttctcacaaggctggatgtgtccgtgcgaaatgaagttacttctgagaaaacgagatttaaagagattctgcagagttagattacactttcaaatttccttattaaagaggattgatgcctaggaggggctgctggtaggcttggtttgggatcctaccctgcagttcccgggcctgggtgtgggcccaggcaggcaaagcaccttacaaggtgacagggacccagacccccgagacccagagagtgagtctccccacctccagcagctgaagtaggcataaggattgtgggatcaacttctgggtaatgtctgacgttgcacgtgggtccatgagggtaacactagagggttcatgctcttccatttccttccatcttcaggcctcttacttgcgggttttgttgaaatcagagcttgattctaagctctgatccactttttgacactgtagtcttttaagagactaaacgtgcgtgcggctgcttgtgcatatgtgtgcatctgtgcataagtgtatatttatataagcacaccaaaacgcatgctcatacacacacatgcgtgtgcttagatgcatgggtatgtattttcatgcaacttactgagcacctactgtatgccagcgctgtgctgggtactgaaataaaactgttgtggggagaataaaacagacacagtccctcctcacatggacctagtgtacgtgtgtgatcatgtggacgtggggaagtatctgtgtgctgctgtgcatgtgtcctgcagctgtgtggcgagtgtctgcatgctctccgtgtgtcttctaagctctgtgaagtctcctgcttgggtctcagcccccctcagcatgcagccctgcagcacagcacatgagtccagtactttggccctagagatagactgccagggttcacaggccagctctttctcctactaaccccagcactttgggaagttgaggtgggaggattgcttgagcccaggagttcgagaccagcctgggcaacatagttgagaccttgtctctgaaaaaaaaaaaaattcctccccccaaaaattagcctggcttggtggtatgtgcctgtggtcccaccgatgcaggaggctgaggtaggaggatcgcttaagccgggaggttgaggctgcagtgagctgtgaccacatcactacactccagcatgggagacagaggaagaccctgtctttaaaaaaaaaaaaaaataccaaggctacacttgcctccagggctctttccagagcagccagagggtcctggagctgtcaccctctgagttgccacagcaactgcttcccatgtggctggtcactggaacagcctgttggacagatagggtggcttccttctacacatacttgcactgaccactagactggcctttgggtggagctggactatggccagtgccagggtgactttaaccacagtagaacaatcaaatcagttcgttgctcctcaaaataagtgtctctcactatcctgtctcatgtgttgaggagagtgacactaatcagagtgaacgttttgctgtggcccttagtccttagcacatcacataaattaactccgttctttctcatggtgactcggaaatgagtactgttttcatacccattacacaaaaaaagaaaactgagaaaatgttaatcgaagtcacacagtcaaaagtgtcagacaaacccacattgagagatattccatgaaatgactggcctgtactcttcaaaaatgccattgtcttgaaacacaaaagaaacgtttaggaattcttccagatgtaagtagactaaacttgacaactgaatgcgatgcagggcccaggatttttccataaaagatatttttgaagaaattggtaaaatctgaatgaggtctatagattagataataatgttatgtcagtgataattttctgatttcaattattatactgtggttatgtaagagaatgtccttgttttcagcaaagcatttgcaaaccgaaagtattagggggtatagaggcttcctgtttgaaaccaactctcaaatgatttagggaaaaaattataggtaagtaggtagaagtaggtagaaagatggaggttaaatcaaatgtggtaaaatgttatatgtagggaatctgggtgaagggcttacaggaattttttctactattcttgcaagtgttctgaaagtttgaaattatgtcaagagacaaaaagttaaaagaaaaagaaagcaagtgcccgagcagggatggtatcctggggtgactgttaatactatcagttcctgttcactgtgccctgggcaccagactctgtgctatggcctcatgtgcagaagaacctcattctatcctcaccacattctgagcggaaagaccactgtggctcccagtacacacatgccagtcagaaaggtggggggatttaatccaggccccccagctccttggagcagttccgacttgaaactaggctccctgatttcaaggtctgaactcttagcctcagtctcactcttgactctgacctttttgggagagtggggatgggcaggacaaaggcgtttcttcctggagtagtagcagagtgaaggccccgggacacaagctaacaagatccatttgcgggagggagaggagctgtgttccaggatcctgcagggggcagagccagcagtgccaagcaggacacactggcgtgtgggaggggctgcagatgcccagtggagttgccaggaggtggccacagtggcttccagcaggggagccacggggaagagcctggagtgacctggagctgggtgaggtagacgttctgggctggaagactggccttggaggagctcactggggtaagcatcccccaggctgccatccaaaccaggggcactggtagtactggagcctgtgggcttggcagtttgggaaagtccacgtgctggagctgaggggcagctgggctgggacaggtgggcaggagttgctggggacttgggtctggcctagtggactgctctggggtccatgtgaagatgagggcatttctcctccgggctggagggagagagtgggaggggcgggatgacctctggcagtgcgtccccgtcacctggactgtctggctttcccccagattaaagagtggagggtgagtgtctggcagccagatgagtcagactgggaggcttctctcccagcctggctgcctccttccaccagcagccctgcctccaccccctgctagaggtaggggttggagttcagcctgtttcccctccaatgttgttccccccacatcctgagacttaggggtgaccctgggttgagtggactggtttattctgctgggcccagcgcatgcatctgagtgtgtgcccaggcgtgcgtgtcggcgcaaacatcatccattgtgaaatatcagtgttttcatgggtgagtagtaattactgggtaatgctttaaaacctttcctgaaggagcgcaaagccatttttttctaaagtcaggagtacattaaaaggattaccatgtagatttgatttttagataacactaaaatggatcccaaatggacttcagcaaagggatgctatctccttaatggaaagtgcatggcccgaggctcaggtcccagagccaggctggggaaggagggagggaagaggtgtctgcaggggggcaggctggcagattgggtggggggctaggtgggaatggggaaggcagagcaggagggagggcctggaccctgtggggagcttatccctccatctggggagcaggagactacagagcccctcctgaaagcccctccacctttccaggagtgttttcaagtctcctggactagcccggtgagagcagacacagcatggatgccctatgaggaaggaaggctggctccactgttttgtttgtttgacccccagagctcttccactctcctgtgagaagcaagggattgcttccgtttttcttatgggcagatgaaggaagttaggcccagagagaccagggggatatgctctggaccccatagccacaggactgcagacctggagtctggtcccaggcccctcccatggggctgccctggctcaggcttcccccaggatgccagcctttctcgtgggaggtctctagacccaagggtctctagatgctctggggccttctcagccaggctgaccctggtgttccatgtcttggtggacatgggacactttggcagaagctgtgtggcttctataagagttctccagagccaggaatcagttcagcaccccagaagagggaggggtgtccaggtcttaaggtaacctgcctgtgcagaggccagcctgggcacgggcagtggggagggggacctgcggcagctggcagcttcacccctcatggcttccacagggtcctctaggtgccagatgcctccagtgaagagattgtcgaccagtgctggagtttacaaccctgcgggagccaggacaaacatgctggggtctgagctcggaagaccagcccgtccaagagccagggtagatggaagagagagtgggacagctgcttcacgtgctggggcctctcactgtctcccttcattttgggctataatttagtgggctagggtctcccctgagtacggaggttccagccattcacccatgttctggtaatagcccaaatatagagccctgggaggggctcaggaccactgggaagggagccaggcctgctgcaagcctggctgagcaaaaggaacgtgagccttgtaggggctgtagcgggggcctggcccaagattttcccagtcggtgtttgagtgcgtacctctgctggctgcatgctccctgcacagggcctaaggacaaggtcatgcccttggagccctaccctggtccaggtcccactctgggaggcccctcatttccccatccagctattttaactcctctcccatttccccacacctccctgtaggccaggacttggaaggagcctcacaagaccccttcagttctcaggggtatctgctccccagctgccctccttgggctctttcagagctctgtgccaggctgggccctgctagaagagacacaggcaggcccgaggacagagtcatcctgtgccccatccctctctcagaccaattaacctttagagctgcattaaggaaattaggcagcacactcaccagctaacagacaggccctgccgggactgcagggaggagaaggaggagggagccactggccctgcacactgtagcctgtgggtgggcgccagctccccagactcacctgtccaggagaagtctgaggagccagctgggctgagagcgagcacaggagaggagaaggagccctggggccagcttgacggtggctgactcaagcccctgtaactgtctgagcctcaatttccccatctgtagtatgagaacatttaactgggagaactctgagggctcttctgaccttacatctgtggattctgagaccaaggcctcttgtggcttgttctcccctaacgcccaaggaggagagaagcaaaaggaagggaagcagcccaaccattcagactctgggctgggggcagtgaggagggctgggaatgggagggacaccaggggatgggaggaaggccagagccctggagagagcaggggtcctttggagaggacggggccagtagaaggacagactccaggggagtgttggaaagccggggaggtggggaggggtgggcccctatccagctgcgccttggtcaggaacggagcatgcacacgctccctgtcttcacaagggttctcaggcaactgccacaggctcccgccctgtcaagtcacagagcagggcttctgaggtcctctgcacttccctcccagcctcacgggtccacgtggatgtccaggctactggacgacatatgtccccatctcctcctcaacggtccctgtggttccaggagaagggactaggaacccgtgcctctgtcacttcatgcccacacctgcacgtcgtgcctgtgtgtgaggggtgtgtgtgagcgcacatgctcgcctgccgcgacgggaggctctgccctgtggtgaacatcacattgggccctttgtacttggtgcctgtgtgtatgttgggaagctggtatgggccctgggagggactgatggctgagagatcctaatcctggtagaatgaggaaggatccagaggctcagagcctgccctcccccaggccagggcaggtgaggtgtgacaccgcctgaagcattcccaaggggagccccagccaggccctgccagctgcctccgcttacctgccaggagccccagagcctctgctccctcctgggagtgtcccaggggcgtctcacttccttcttgatgccatcacagctctacatggatagaccaagaggctgtagcacttcagctggagaaagacgagttggcacaaagatctgggggttctagaggacctcgtgggcctgaggagactacatttcttaggcttattgctgaaagagccaatgtgatggtggcttcacaagacgagcttcaggcttactccggatgagaccgcacaggggatagaggccatggtagggaggaacaactcagggaggccaggcctggggtctgtgtgtgccttggagcagagcagcctctggagggaccttcacagggccagggaaacaggctgtgccatgtagcccaaagggcaggacccggagccaggggaggaggttattggggagaaagcgagggctcctgggagccccaaacctagagggggcagcagagagaagcagtgagctccccattcttgggggatattccttgaggcccagagctacggggcccatcctgcgttgctgtctgtctgtccgtctgcaggcgtgccgatgctctccgtccagcccaaagggaagcagaagggctgtgcgggctgtaaccgcaagatcaaggaccgctatctgctgaaggcattggacaagtactggcacgaagactgcctcaagtgtgcgtgctgtgactgccgcctgggcgaggtgggctccaccctctacaccaaggccaacctcatcctgtgccgacgcgactacctgaggtgggctgccaaaccctggcctcccaagcccttgtcctgctcagaaagctccccatcctcagccccagcgtgactgtgcccccggccctagacccagtaccctgtgtgtcctctcattcttgactgtcctgcccctgccctgcttgccccagatacctgagaagtcacctgaggggaaggcccaggtcgttatgcccttggactcggtacccagcacaagtccagggcaggcatttgtaacctggggcccctaagttaagctttccgagggccccagtctggctccgcccccctgccttggccaggtgcttctgacccacctgatctggaatctgggaggggatacctcagaggggctttgagaacaggtgtggaagctttgacttcctcaggaccctcctccctaatgcagtctctttccatctcccagtgtccaactttcctttctagatggtccttgggagcaggcatccatttgcccagggaaactggcaggcagccatatcctaggagcagggccactgatgctggagcttcaagacctgggttggaactagctgtgagcctttggctcctaatcttctcccagcctcagtttacttccccgtgaagggtgaaagaatgatgcttccctgccttgcattcctctgagctctaactcaccctccctacaatttggatcctattccctggggccacctcccccaattaaccctccctgaggccatttatgacatcagcaaggctggaaggaggccacaaagcagggccttggctgagacccagcacctgcatttggctctgtcgcaggctgctggatggttgccgggcttgtggggaaggagggctcatcgcattaattaacaggtcggggcaagggcttcatggggctccctctgcccaggtctgggcatgttgcaagggggaggttatcagtggaagctccctcaattccccaaagatcctttgactgacctgcctgccccttttaacacctgcatttaaaagtgatgcagtaaaacagaatctgtgacttagtgctccttgccagggctggaggggagaggctgagaccagaagcaggggttaaggaagaatgttcaggctaggcgcggtggcttatgcctgtaactccagcactttgggaggccgaggcaggcacgtcactccagctcaggagttcgagaccaaccctgggcaacatggtgaaaccccgtttctaaaaaaaaaaaaaattagccaggtgtagtggctgcatgcctgtagtcccaactactcaggaggctgaagtggaaggattgcttgagcccagatgtttgaggctgcagtgagctgtgattgcgccactgtactccagcttgggtgccagagcaagaccctgtctcaaaaaagaaaagaatgttcctggggattcaccccttgaggacctagaaggggcctccatgtctggaggtttagggcatcacctgggggctgactctaccaggttaggacgatgtggcagaccatctgatgggttcacaggacttggagagagaggcccacagtgtaggatgggcttatcaggaaaaagcaccctcaagcatatagggccctgccagctactagggatggaaggtaatttttttttttttttttgctctggcagaggcaaggagtgactgtaggaccagctagaccagtgggctgggatgcgagcgtggcttccttgagctgctcaggcctggagaatggctgtccagagcctgcgccctctgcagcaactgttcctgggccgatggcaagaaaagcccctcttggcaggcagatgctgtggcctagcctttgtctgccttaatctgagccaccaggcagctcaagctgatgaataatggagccaagctcatctgcaggcgcctgagtttgagctggacaaatcggggattaaaggggccccccaccctcttctcagcctccttgcctcacttggggcttgctctgtctgtgtgcaggaaagaagcaaggaggagccgggatggctcagaccattgggacatccagccaagggctggcctgcatggggagggagtaaactccctgtccctagagctttacagccagcagctaagaggaggggtgcctgcctcaaagaggcatttgtgccagatgtccttggcgcttcctttgggcatcagttctgttttacagcatctttgaataggatcatccatccctattttacagaaggataaactgaggttcagagaaagaaaaaaagggacttaggcaagtaacacagtgagtttgtcatggaaaaaagatttaataaaacactttaattttggcaaggcacagtggctcacacctgtagtcccagcactttgggaggccaaggcaggaggatcagttgaggccaggagttcgagagcagcctggccaatatagtgagaccccatctctatttttaaaaatcaaataataaacactgtaatgttaaaggtgggaaaagcatgtcatgcagtggtttagagcacgccttctggaccaaggccctgtgactgtccaagttgtttctctgtgactcatattttaaatctttaaaatggggaataataatagtaccacctcctaggtttgttgtgaggattaagcgtttatctttgtaaagctcttagattagtggctgacacatagtgaacactacctaggtggttgcttagtgagttgtgactgagaatttacaacaggtttcacaactaccccataaagggtgtgtttcaggctttgttttacagatgaggtaaatgaggctcagagagactcactgacttgcctgagggcacacaacccaagattcagtctgcccctgaaattcaggcttgctcagggcccagcctaggattctcttggtggctccagggcttgaggacccttgtgggagcctgggagggggccttgggatgggcagtggcagccaactcctgaccccctacacaccctccctggaaggggatgtgctgatttattggcagcctgatctctgggcagaatctagatgctgccctcagtgctcttatcctattgcctgagcccacctgctgagcccacaagttggagtatgggaaggaccctggatggaggcaactcctttccccctgcccacccagcttcccagaatgctgctgagtcctctgcgcccttccctcggcaggctctttggcaccacagggaactgtgctgcttgcagcaagctgatcccagccttcgagatggtgatgcgggcccgggacaacgtgtatcacctcgactgcttcgcctgccagctctgcaaccagaggtcagtgctggactggccgacccaacacactccccagacgccagcctgaggcctgctgggatgggccaggagcacggcggaggcgtgcacgcaaatgcgggttgcgtgtgtgtatgtggtggtgcgtgcaggttatgagcgtgcatgtgctttatgtgttttatgtgtgtgtaagctcggtagccaaatgtgtgcactttaatattgggtgtgcacatctgtgtggcacatttctgtgtgaatataatgaaggcgtgcatgagtttactgtgtatgcatagttgagtgtgcatgtgcatgcatgtgtatttggaaatgtacaagtgggcacatgtgcatgatggaattaatatgcatttgtacatgtgtttttaaatgtctgggggtgtatgtgtatgtgcaacgtgcatgcatgatgaggtgagtatgcatgtgtgtatacatattttattttttgagatagtctcactctgttgcccaggctggggtgcagtggtgtgatctcacaatcttggctcacggcaacctctgcctcccaggttcaagtgattctcctgcctcaacctcccaagtagctgggactacaggcgtgtgccaccacgcctggctaatttttatttttatttttatatttttagtagagacggggtttcaccatgttggccaggctggtcttgaactcctgatctcaggttatctgcccacctcagcctcccagattgctgggattacaggtgtgagccaccgcgcccagcctgtatacgtgtttgaaacgtgcatgtgcatgggataacgtatcctcccacccccgtacccagtgtatagtatgtgcatgtgtgtgcatgtatgttccagtgagaaggggttcccaaatctggagggcaaagtcccctcagggagtggccactctctcctcacccagcccttgtgattctggttccagcccagcctattttctggtctcttggccccaactctgtgccctagccctgtgggagtccctggggacctaaggagccagagcccttcagccctggctggggcctagcaccagaaggcaggcgctcttctcaggagcccccaggtcaggtaggaacgcatacaagtgctccctgaagtgaggttcagagggacctacagggaacgctggtctggctgggggctctggccggacctgctgttaggagggctcagtgaacttacagcgccacctggtggttgaactgggatctgctggaactaggccagcgatcttggggtctcactaaaggcttcacccaccctggggacatctttagggaaaggaccggaatcttccattacttggggaggactaggagaccaatgaagggccttccttcggtaggagaggagatagtggaacggggttacctcctagaaggatgctctaggtaacttatcaattttgtttagaggaagaatgccctgtactgagccatcctcttaaactggggagagggatagacggatggaagaaacaaccattttatccctccttccttacccatctctgcctttttttttttttttttttttttttttttgagatggagtcttactctgtcgcccaggttggagtgtggtggcgtgatctcggctcactgcaacttccgcctcctgggttcaagcaatcctctgcctcagcctcccgagtagatgggattacagatgcccaccagctaaatttttttgtatttttagtagagatggggtttcaccaccttggccaggctggtcttaaactcctgacttcgtgatccacccacctcagcctcccaaagtgttgggattacaggtgtgagccaccacacccggccccatctctgcctttctccatctgtctccccacttggtctttttctgtttgtgctttccctttctccctctctgggactggggtaggctgttcctgcacctctccaccaacccccctaaccctacactcaccaacacaggagacctgactatggaagcctgtggcccaactgtctgtctgtcctaccacctcaggctacagggcctggccaaggttggggctggcctgggggaattgcccaggtgtgctgtggggacttttggcagttccctctggaaggttcaaggaacaaactccccccaccacctcccacatagctcacctcataggccaggccggcttctgtctgcagccccccccttacccactgggaccttcccatggcttctctctctcgcttggattttctagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttccgggaggttactctgcgttgttcacatgactgacacagacctggggcccctcccctctgcctctcaagggcagggcacagagcagggtaggggcctccagcatgtgctgttgctgggcaggggagcaaaaggctggctttaggggaagaagctgggaggaaggagacaactcagagcctccagccccagccagaggtgagacctggggtatcttccctctgggagagcacacactctggccctgagtaggtccctaagaagaggggcaagatgaagccttccctaccctgtgttccatcccctctgttgagaccccagactgactgcacagatggggacccagctctgaccttttccccagtaggaccacaaatcttgtgtcctctgccatgggagcaccatgctgaaacctctcttcccttttagggtgacagacagcacttgttgtctctgcccagcagctggggcccagctttctgctcttctgagtgagcaagaaaaatcctgtttcctttcgactcagcccatgcagtctggaggcatccatttattcagtcagcaaacctcaatagactctgtgtctcaatcccatgctgcaaccgggggtgtcctggagcaaatcagatgtgaggatgaatcatagatcagacaccgtccctgcccttggggagcttgctgtggggatggaaagcagaagccatgttgcggggaaagccaggaaaacaaagcacatcattgtgaggacggaatgctatgcggagacctgggacaggccagttccctctgggggacacaaggccatttgtgatgacttaagaaagtcatagatggacaagtcaatggacatacggtcagacagacatgtgctgcaggcaggaaggatggacacacaagtagacaagtgtgtaggcagagacaggcaggagaggtggaggtggtcaagccccatcactcagctccagccagaactgcagcagacaggcagacaccagggcgttttccacctcccccgccgagctagatttactcaaggcagcagggatgctgtcttggtcttggctgcagccacagtgccaagcacaaagcctggaactgtaaagataccttctcgctgggcaatattaaaaacagaggcttcttgaatccccaacctagacagaaaaagttgcatggacaggctccttcactatcaggccactccctcctccttcccaggggctattttcaccctagccacagcccacagcccacagcccacagcccacagcccacagcccacagcccagggcagagggagtcagactattgcctcaagccctgcctgctcctgggcagggaatgggctgggctgggctgggctaggctggattcgcacctcaccctccccaggcctactcctctacttgaaagtgaaaggatggctgggcactcctgggggcttgcaggaggctacctctccaagttgtggttttgtggtcattggcccagtttctgaaaagggattgctagggccgaggatcttggggcagaagttctcaactttgggggcatccagtttctgtgaaggagctgcaccctgtatgtgcgagaagagaggcaaaggccagtggagctggctgcagtgggtgtttgtgtgagccatgggtccaaggggacggtgaaactgggagctgtctgtatgtgagcacatgggattgtgaaggggtttgcgtgaggagagacacagagggctggagtttataatgaggaattttctttctcaacctgaaaaagcaaatgattttcctgcattgtagcagagtccccagtgccagactctccctggacccttaggtctaggatggctgtgcccaacccaagggccccaactcttacttcagagtttgctggagataaagttataatacaagttaattacatggttatcaagagataacggagccactcgaatgcagtttctgggcaattacaattgtttccaacagagttaccatattgcagcca

SEQ ID NO: 13459 - DNA, 49610 bp, Human
  misc_feature (1)...(49610): n = A,T,C or G
tccgcctcctgggttcaagcgattctcttgcctcagcctcctgagtagctgggattataggcaggtgccaccatgcccggctaatttttgtatttttagtaaagatggggtttcactgtgttggtcaggctagttttgaactcctgaccttgtgatccgcctgcctcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagcagtcctcctgcctcagcctcctaaagtgctgggattacaggcatgagccaccacgcctggccaaaaattttaatttatcaaatttattcctttactgatgctaataaaaatctgtggtggctcacgcctataatcccagcactttaggagtctgaggcaggaggactgcttgaggccaagagtttgagaccagcctggggaatatagtaagatctcattctacaaaaaataaaaattagctgggtatggtggcccatgttggtggtactagctactctggagactgaggcaggagagtctcttgaaccttaaggtcgaagttagggtcagctgtgatcgcaccactgccctccagcttgggcaacaaaccaagactgtgtgtcaaaaaaacagaaaaaaaatcgtttgtgtcacctgatctgaagaagggagggagtctggtgagagggaaagagggagcaaggctgcaggtcaggagtcaccagggacaggttatctaagctctcagtccagtgccattgtccatatatctcccacctaccgctagcctcaggaaaatggctcctcactttacccaaagtagatatggggtcttcctgcaagaggaatacacccataccatttccctcccttcaaacgaccatactgacccatggtatggttagtatttgggttgcaggtttatcacatagcgaggtactcctctctttgtgatggctctaaccttgataactacctgttttcctcggctgcttccgggacccatctttctgagcctttctttctttttcatcgtcgaagtcaaagaccagtgtgacagtacaaggttatattataattgatgcccaggaaaacagactgccgtattctgatctattaaaattcctgatttaggaataccgtctaggatttaagagaaacatctaatgaatgttaataatgacgatgagtggttttctaggaacccataaagtaaaaggctttaaaagggtggcaagattgtcactgtgcaactcagcaacgatttgtgaggctcaacgaaattcctacccaaattatttgcaattattaaacagaaagaatgaaaaatgaccttgaattacagggcgaaagatgggactgttaagactgtcttcgtaactaagcactgtaaagactgagacagctgcaagggaaagttttcctcgagctcttccagtgaattttgggaaaagggattgaatgtctgaggtctcttccagctctgaaaccgcagcgtttcgtacagtgttcatttttttttaatgggaggggtctcggggtcttgctctgtcgcccggtctggaggcttgagtacagtggcgcgacacgattacggctcacggctgcctcgaactcctgggctcaagcgatgctcccgcctcagcctccagagttgctgggactcagtgtctgttcttaactcccttcgtagaatccactttcctccagggcaaagttactcacttaaggaccttacggctcggctcggggatttcctgggtcaccacgcaggcgacttcagggcccaaccgtgtctcctcccccacccacaatgcacctcgcggttccctctaggtggcagttctgtcacgtgtcacccgacggagcgcgctcccgtttggcgcacgcgcagagtgcagcccccagctatttttctccgtggcggcggcgacgagcggaagttcttgggagcgccagttccgtctgtgtgttcgagtggacaaaatggcgaagatcgccaagactcacgaaggtaagcggtctttccctgcttacgtgttttcttcgttgctagcctaataaaagccttttttcctaggattctgcctttttctatggtttctttcgtaggagctgagcccgcgtttcggggccaagggtcgtctcctccgcgccagcggcgcaggccactgccccgcgtaatggcgtcctcctcttacacccccgacaggcgctttgttcagtgtttgggacctgctacttcagagtagcttctcttctctgaccagagggcctcgtttaagcggcttcctcagtaggattcgtgggcaagggatcggggaagcgggcgtggggagaaggtctcactcgcctctcgacactgtcgtccccatagtttgtgcagaagagggtcagaaaagcactgaaatacggcagccgcttttccggcagactgaatcgaatttggttaaaccgagattccgttactcctacccttgtgtgtcttcaagcgtcagttacttgtttatttttcttgcacgaaacgatttggggataaaatctggtagttgttttccctcccttagtcacttttagtataatattgatctttttctttggagactggttattggaggagcagatggaagaggaaaacataaattactttcattaatggccgaagctttcaagctagttgatcgttttatggaatacagagtgtgcaaattaggaaaacgttgggaatagactggagttcattaggaagtatccagagatgacagaaaatgggatcacttttcagaaaagacgaggcatgagaagttggaactgcattctttgatttctgacttggaatccgagattttcactgagaacgagacttctaagtcacttttgtttcatatgttctttctgggtatttggctcggtattagtctgtgagaggtaagagactgaggccatccaaaattttacagtctgataggagaaacagatgtgtatgttctcattctctcatgaggccagatgcatgcttaagtagaagaaaaagcagcatgttctgggaacctgggtaacggaatgattatgtttagggttgtttcactgaggaggttacatgaccgtgttttaaaaggatcagtcagttttaaatcgggaaggacatctgagcctgagaacatcttgtaacaaggtattgaatcgtgaaaggtgtgtttgagtagtagtccactgtagcaggaacagagggtgcaagtagagaagaaataaatgaatctggaaaggttggattaggaccagaatgtgaatggctttgaatagttgggtcacccagaggacctgaagtccagctttctgctatttatcaaacatgctaatgaattgtcaatgactttaatattagtataccattttaggtatttaggatttaaatgctctcttagtattcctaggctttattattttgtctttagactatctcaaatataaccttttgcaaagtaagtagaaaatataaagttgtgctgtttttgttcattcaggatgttattcatttggggatattgatagtatagctttgatacttatttattggtaacttcagtataagatgccctcagacaggaaaatcagaattctgatcagttttcctgaattttttagaaacccagctaaaaactttggtctattgctattcattggccaaacttgttatttttgagattattctatcaatgtgaattaagtgataccataagaaaatagcagaacattcaatacttgagcactgtctgtgcccatccctatgggatatgtcaggggatgataaatgtttagtagaaatacacataatactgacatagcttgttgcttccttcctaatggaactctagttcttcatggtccatcactgttttctcttgttaagccatttttgataaactgaagcagaattaatgctttttggggcagtgctgctatagtactcagtataaatgttatattgcttagaatagtctgttgtgttaagattttctcttctccttagctccaagattgagataaactgataactatttatttattttgctgtcatattcctttcaaacatttctttttttattttttatttttttttgagatagggtctttttctgttgcccaggcagaagtgcagtggtgcaatctcggctcacagcaacctccgccttttaggttcaagcgattgtcctgcttcagcctcctgagtactagtatcgcaggcatgtgccaccacacccgactaatttttgtatttttagagacagggtttcgccatgttggccaggctggtctcaaactcctgaccacaagtgatcctcccaccttggcctcccaaagtgctgggattactggcatgagccaccatgcctgaaccctttcaaacatttctattaggatcaggcctcacatcctctttaaccaatctgattatattttaccctggccaatgtggcttatgctttccaggattgaaatataaaaagaactggaattactcaaatcagataaaatcttttagatctttccacgtattatgtcaggtgtatggttatgaatatgcataatcttgccatccagcagttcttcagatactgctgactttggcatacaaacagggaacacacattattctctgttttgtaaggggaaaatggtttaaccaaaaatcctacatatcagcttgttttgccactaatcctttgaattagattttttgggacatcacaaagctgaaaaaagttttttccctaattctttgcttgataaatggctggaatagttatagttttgttattgtgtatcttgctgatctatatattttttcctgtgtttatttttgagaccgggtcttgccctgttgcccaggttggagtgcagtggcgtgatcatagctcacttaacctacaactgctgggctcaagtgatcctcccatttcagcctcctgagtagctacaactacaggcgtgtgctaccatgcctggctaatttttacaatttttttttagagatggggtctcgctatgttacccaggctgatctcgaactcctgggctcaagcagtcctgccttggcctcccaccgtgctaggattacaggtgtgagccacgatgcctggccttgaaattttttttaatagaattaatcatttaggaatcaatttatcagtattgtttgtagtgttcagtaaaatgatttatattatagttagttgtcctattggagttttgtttaatgaaaaagctgagggttgggattcagaatatacttcctgtttttctgtgatgtcttttagaagccttgtattttggaaatagttgttcaccggttatatctggctgaaggagagtagatatcacttagggaccagactgaaaggtgtaggtgagacattaacatctgagggcagtatctgtgtaacatgtaatgagcagtgattagaacactgaaaataattcagacgaaaaatgaaaaataaaaatcaaggaggaagaagtgctacaagttgggtttagcaggatctaaggcttagaaagaagaaaagggctgggcatggtgtctcacacctataatcccagcactttgggaggctgaggtgggcagatcacccaaggttaggagttccagaccagcctggccaacgtggtgaaaccccctctctactaaaagtacaaaaaaattaaccgggcatggtggcgtgagcctgtgatcccagctcctcgggaggctgttgcaggagaatcgcttgaacccaggaggcgaaggttgcagtgagctgagatcacgccacgccactgcactccagcctgggcgactgagtgaaactctgtctcaaaaaaaaaaaaaaaaaaaaaaaaaagaagaaaaggcacaggaggggaaatcagagggacagaattggtggggagcagttaaatagttttatcagatgtgaccttctgctatcagtgatatgaattgtttttctcaagagcttgatatgtaggtctgagttttaaaatacaggaggccaggggttgctcacgcatgtaatcccagcattttgggaagtcaagacaggaggattgcttgagactgcaaacatacagaaaagtagagagcggctggcgctatactccagcctgggcaacagagcaggactctgtctcagaaaaacaaaacaacaggccgggcacagtgtgtgaagacaggttttaataacactagggtaggctgggcacggtggcttacgcctgtaatcccagcactttgggaggctgatgtggatggatcaccagaggtcaggagtttgagaccagcttgatcaacatggtgaaaccctatctctactaaaaataaaaaaattagctgggtttggtggtgcgtgcctgtaatcccacctgcttgggagcctcaggcaggagaatctcttgaaccaggaggtggaggttgcagtgagccgagatcgtgccactgcacttcagtttgggcaacagagtgagactttgtctcaaaacaaaataacaaaaaaaactaccgtgagtagtaaaatgaacccctcatatactcatcacctagcttcaacagttacaagcttaggccagctttgtttaatttgtacactggtcacttctactcttcccattattttgaagcagatcttagacataccactttatccataaatatttcagtatgtatttctgtgtagggacttaaaaagataataccatgattacacctaaaattaaaataataaaatatctagtcactgttctgttttacccattcttttaaactttgtttttcagtttcagtcaggcttccaagaaaactgataacattttgattggttggtttctcttatatctttttcatttcacagtacattgtgatttaatgatttatctcttaaatctttttcagttcataggttcctcctgtctctttctttttccttgcacttcatttgttgcagaacctttgtcctgtggtttcgcacagtctggaggaattggggaaagtggctgtctaaactggttccctccttcccattactgctgcaatcaagatgttagggggcctacaagcaatggaagcacccagaaaattattggctctaagtatgagcatagttctgaaatcatacttcaggtttagattgtgctagtcatgggaaggaaatttttttttttttttttgagacagagtcttgctctgttgtccaggctggagtgcagtcgcacaatgtcggctcactgcaagctccgcctcccgggttcaagcgatacttctgcctcagcctcccgagtagctgggactacagacgcgcgccatcacacccagctaatttttgtatttttagtagagatggggtttcaccacattggccagactggtctcgaactcctgacctcaggtgatccatccacatcggcctcccaaagtgctgggattacaggcgtgagccaccgtgccggcctgccttagtgttattaaaacctgtcttgacacaaaaacctctaaacaaatgtttacagtagccttacttgtaatcactgcaaacagctcgatgtacttcagctagagaatggataaacacactgtagtacaatggaatactacccagtaataaaaaggcagaaactattgatgtgcacaacagtgtggaaattggaatatttaagggtttaaatgggttaaagagtgccagcttttggcagttttgtgtggccaataggaagtcctagtctcttcttgctcagtcactagcagacagtatcccttttttctttgtcttcacatctgaatgtattgaactatgagtccaaactgggaagggattaggctggaacaggatttgttcattttggtcataattgaagttggaagagattattagcatagacgtttctttgcctcaagtcttcattgtttttgacctctggttactcattttggtatgttctctcattttttattttcatagttgccaacccccgccttttttttttgagatggagtttcactgtgtcgtccgggctggagtgcagtggcgtgatcttggctcactgcaacctctgcctcccagactcaagcgattctcttgttgcccaggccagagtgcagtgctgtgatctcggctcactgcaacctccacctcccaggttcaagcgattctcatgcctcagccttccaagtagctgggattacaggcgtgccaccaccatgtctggctaatttttgtatttttagtgaagacagggtttcaccatgttggccaggccggctttgaactcctgatctcaagtgattcaactgtcttgacttcccaaagtgctgggattacaggcgtgagccaccgcgctcagccagttgccaagcagttttatgcattgatcatttgttgtcagaaatgatctatttgcatatttttagtcagtttatatttaagaaattataggaatacttacacaccaggctgtaacttagtgttggttttgaaaatacggagttagagacaacattgttattcccagagataaaaaatttgaagtggaattttacaaaccttggctggcatggataggggagagaaaaatttggaaaattacttttaattacttctacagattacctatttatttatttacttacttatttagaggcaaggcctggctctaacacccaggctagagtgcagtggtgtgatctcagctcactgcaacctccgcctcctgggctcaagccatcctctgacctcagcctcctgagtatctgggactacaggtgtgcacctgtagtgactaatttttgtatttttgtctaatttttgtagagacagggtttcatcatgttgcttaggctggccttgaacttgtgaactcaagtgatctgcctgcctgggcatcccaaagtgcccagcctcattaccttttaattaattaattaattaattaattaatttgagacggagtcttgctctgtcgcctaggttggagtgcagtggtgcgatctcggctcactgcatcctctgcctcttgggttcaagcaattctctgactcagcctcctgagtagctgggattccaggcacccaccaccacacctggctaatttttatatttttagtagagatggggtttcaccatcttggccaggctgatcctgaactcctgacctcgtgatccacccgcctcggcctcccaaagtgctgggattacaggcgtgagccaccatgcccggcccagattaccttttatgaaatattttaacatgcagaagagaataggacaaaatataatgaacactaacccactgctcagctttatcagttcttcattttctgccgtattttttcccacctttttatttattttgaaaacgaaacctcagacacaaagttaccttatttatgaatgtcatggtaataatttgtttgctcataaatatttgggtatgttatatttggtattttagcacatagtttattaagaaatttctgagtttttagttctctgaattgcataataagctgctgagttttatggaatctgacggcttaattttatggatcacatggtgtatgtgtaaatgtgctgcagtttgcagtgtgttaacaaagcccattaagctgtttggactttatatctatagtttccagcagacagaaaacaatgcctgatttgcatataaacatttaattgtactgcctataagaagttcagtaatatactcaccttaggattaattaactacaaacagctgcctagccccaggagattttgggctgggtaattttgttactaaattttaataagaacctagtcatgatttacatagatttcataccaacactatttcagtactttatgaacctttgtaattggaaaactctgatgctaatcagcaggtacataaaatcaatagttaaaattcagtagctgaaattagttccagaataagtgttatccaaatgagaaactagttgctgaaacttcaggatggaaaagttgtttagatggaaaataagagagatgcctgataagggggaaaaagcaagttgcacaatatgtgtagtgtgcagtttttataaaacagcacccctttcctgttttttagttgtgtatgaggtagagaaaagtataaaatgatgctctaaattggaaaatttggtaggggtgggctggggttggaaatgggaggggtgaagggccaggtaaaatagtttcctagggtgtttgttaatgatgcagaatcctgggcttcacagcctgagttggagtttcagagttagtgtatccaagacctaaggttctacctttgtaacaggtgcaccaggtcatttctttgtaggtggtccttatactagactaatgctgtagaggagattgcagactatttctcctgattcatccatttgtttcttacctaaatcctcatggaagtagcatttgtggtccttttacaaaaacctatttaggtaaaagtgataaatgcacctgtggtttaaaaaaaaagcctgaagctgggcgtggtggtgggcatctataatcccaactatttgggaggctgaggcaggagaatggcttgaacctgggaggcggaggttgcagtgagccgagatccagccactgcactccagcctgggcaacaagagcaaaactccgcctcaaaaaaagaaaagaaaagaagatgcccgaagggggtgggagtggggcaaatgtagattaaatttttcaaaatatgaaactacaaacagaaacaaaagtagagatcatagtaaaaagaaccaccctgctcatgtgaggatatttctggctgcctgggctgctataatggtttggggacaaagtaacatctgtgcatgtagtggtgctgtgtaacacaacacactataataattttgagatccgatcacaactggggctgctaaactcagcattaaaactattctatcattttgagtttctttctttctgtttgtttctgagacagtctctctctcatccaggctggagtgcagtggcagcaatcgtggcttactgcagccttgacctcctgggctcaaacagtcctcccacctgagccccctaagtggcaggggactataggtttgccaccatacctggctaattttagtattttttgtagagatagggttttgccatgtcgcccaggctggttttgaactcctgggctcaagtgatccgcccacctcagccttccaaagtgtttggatgacatgcgtgagctaccgcgtctgcctccagtttgtgagacgtgctcctgttcctttcttatgtggaaatgtgacccagccgtgccttagactagataaggacattttgttatcctgcacatctatcttgaggaactatagagggctttctcccttagctgggggggtgggaggttttgcaaatacaggatgctatttgaatctttatcttttgattcatgcagctagcaattgagcttttttattttttatttgatttatttatctatttattttttgagacggagtttcgctcttgtcgcccaggctggagtgcaatggcgtgatctcgacttactgcaacctccaccttccgggttcatgtgattctcctgcctcagcctcccgagtagctgggattacaggcgcctgccaccatgcccggctaatttttgtatttttagtagagacggggttttagcacattggccaggctggtcttgaactcctgacctcaggtgatctgcccacctcggcctcccgaagtgctgggattgcaggtgtgagccactgcgcccggcctaatttttattcatttatttatttatttgagatgagttttgctctttgcccaggctaaagtgcagtggcacgtgatctcggctcactgcagccttggcctcccgggttcaagcagttctgcctcagcctcctgagtagctgggactagaggcgtgcgccattacacctggctaactttgtatttttactggagaggaggtttcaccatcttggctaggctggtctcgaatgcctgacttcaggtgatccgcccgccttggcctcccaaagtgctgggattataggcgtggaccaccgcgcccggccagcaagtaagctttttaaaagtgcctggtgtcaaagggcttaattcagcatgggctggcaagaatttaaacagctatttgtcaggccatggaaatcttttgcaatcgaaactatttctttatacatctatgtattatttagattattaaaacaaaacattactttgcaaaattaacctggtgtcaggaaagactacaaaatggaagactagtctgtatttaaagaagagcaaagagtgacaactaaatgcagtgtatggtgcttgattggatcatgggttaaaaaagaatctatagaagctgttactagggcaactggggacattttaagctaggttatatgtttgttagatgatattttgtcacggtttttttttttttttttgagagatagagtcttgctctgtcacccaggttggagtgcagtggtgtgatctgcaacctccgcctcccgggttaaagtgattctcctgcctcaacttcccaaatacctgggactacaggtgcatgcccccacgcccagctactttttgtattttttagtagagacggggtttcgctatatgttggccaggttggtctcgaactcctgacctcaagtgatcgcccacctcctcctcccaaagtgttgggattataggcgtgagccacagcacccagatctgcccacctcatcctcccaaagtgttgggattgtaggcgtgagccacatgcccagcctatcatggtttaatttctagagcttgcttacgctgttgtgattactagtctcttatatggtgcaattattgtacattttctgtatttaagagagtattttgataattacctagtaaagaaatgcattgtgttgggagttcttttggaaagtgaaattaagaaagtctgtgttatctttttatagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgtaagttacaaattatgtacaagaggcagttatttttttgagagagcaagaaatatgaataacttttgttgcagccatctggtttaatctggagaaacatttttgggatcttttagaggataaaactactggaggtatcctctctaaggttcagaaacttcactggaaatgctttgttctgagaatttatggtaaagactagtttgtttatccagtgaagcacctgccagccattacctttataaagttaagagtaaagtaaatccctaccattacttatcagctctatctagagtagcctgtgtgagaagtgacttaattgtaaatagccatctgtccttgtgatttgattactgacttgtacttgatactgtttttctcctcttggtatcttaatgtgaatggattttcttttcttatctttttttttttttttttgagacagtctcacctgtcatccaggcttgagtgcagtggactgcaacctccgcctcccggtttcaagtgattctcctgcctcagcctcccaaatagctgggattacaggcgcctgctaccatgcctggctaatttttgtatttttagtagagatggggttttgccatgttggccaggctggtctggaactcatgccttcaggtgatccacctgccttggcctcccaaagtgctgcgattacaggcttgagccactgcgcccagcctggaatttttcttagtactgatattgatgagcttttcatgtctgtttgaattcctatggaggaggactgcctttcattttgaaatctgttccctcaaagcattttttatgtattccaggtagcttatattttatcagaccattccaaactccaaatttggtgattcagttacagataaattttattttatgtatatagattatcaaactggtttttttttttcgtctcactctgttgcccaggctggaatgcagtggtgcaatcttggcttactgcatgctccgcctccagggttcatagcattctcctgcctcagcctcccgagtagctgggactacagatgcctgccaccaagtccggctaattttttgtatttttagtagagacggggtttcaccgtgttagccaggatggtctcgatctcctgagctcgtgatccacctgcctcagcctcccagagtgctgggattacaggcgtgagccaccgcgcctggttattttttatttttttttaatttttggataggtgatgtatatttctttttttattattattatactttaaattctagggtccatgtgcacaatgtgcaggttacgtatgtatacatgtgccatactggtgtgctgcacccattaacttgtcatttacgttaggtatatctcccaatgctatccctcccccctacccccaccccatgacaagccccggtgtgtgatgttccccatcctgtgtccaggtgttcttattgttcagttcccacctaggagtgagaacatgcggtgccaactggttatttttaagaaattcaagtcacattttatagttggctctcttcctcttttttttttcttgagagaaatttaaaaatcccaaaaggtgaaatttctagaagccagtcatggactagttagcactttatttgggggtctcataccctaattgtaaaagaaagtgatagctataggtttcagaagctgagggggaaattgtcactttatctttaaataaaataagtgaggtgttaagatctggagaattaccccgtgttgcactttttattttttatttatttttattacaatagagatgagatctcactatgtatgtggttttgttttttggagacaaagtcttgctctgttgcccagaccaaaggcagtggccagatcatgcctcactatagccttcgcctcccgagatcaagcaattttcccacctcagcctcctgagtagctgggactacgtatgcacaccaccacgcctggctaatttttgtattttttttggtagagacagagtttcaccatgttgcccaggctggtcttgaactcctgggctcaattagtcccttgcctcggcctcccaaagtgttgggattatagatgtgagccaccttgcccagctgggtctctgttgcctaggctagtctcaaaactcctacactcaagccattctcccaccttggcctcccaaacagttgtactttttatactagaaaagtaacagtataacattgttctgtttaaacatactactaggggcaaataaatttaaaattaaatatttgtttctatggttgttaaattgtgttaaaaaacatgagttaaaaaaagaaagtagaaagttctaaaataagctgtagttatcaaattgaaaaaacattttgtcttctgtgaaaaaattaaatgcacaggtttttctagtccatacctactttatcttaattgacgtctatagaaaatattccttgcttaatcattttaaaagtaaagataactttactgaattgaatttaatagatttttgaagtgaaagaagaccaattgtgtttctaagttttatgaaggagggcttagacatcacactgtcaatagatcttttgatttcattttgaatctttgcatattctttctaatttttaagttctaacattttgtttatggctttttggggggttttcattgcaggatgacgatgactattcatcatctacgagtttgcttggtcagaagaagccaggatatcatgcccctgtggcattgcttaatgatataccacagtcaacagaacaggtgatctttcattttaaaagcatagtttattcagctaaagaaaagtgaatgtctgagttcccatagaaatccataaattttaggatgctttaaggataattataaataataacttattttgtaaaggtgtaatctttttctttttgacacaaggttttgctgtcttgctcaggctgatcccaaactcctgggctcaaggattcctcctgtctcaacctcccaagtagttgagattatacacacaggctgtcatgcctggctgtaatcatttaatgaagcattgaactatggaaatgtggatatgtatattaccttgtttccatgtgccttatttttttatatttaacatttatctgtgaaacggtacagaatattagtaggcatgtattaaacatttgtgctttatggtgttctgatttttgtttatgatattctgttttgttattttaataaagtggatattaagtgagacatacctcttttcagtatgatccatttgctgagcacagacctccaaagattgcagaccgggaagatgaatacaaaaagcataggcggaccatgataatttccccagagcgtcttgatccttttgcagatggtaattctttcccacttttctataagtattcagaaatttatttgtattaagttgtctttagccctttgattttttttggcatgcttctgaatttgcttttctttttaaaaatcccccttactatagatttgtatagatgtggttgaagtcacagatgccatattcttcatctttataatgcaagttttctttccaggtagaaggacaagaaaaaaatgagccaatgccatagaaacgcaaagggttaaaggttttacttttacttttgttttgggtacgctttctatacttggatcaaatgtatttttctgctcaaaatactttcaaattattgaaagttttcattccaaatcctagatttttaggattgttacccttgagaaactgtttctcacactagagctccccccatagtgctctaaatatagcttagtaaaggcacctactttgctctaagcatacttaaagttaaaacaaaagtatgtatacgaagagtttgatatttttaatagttggagtctgttttgctaattttagtgtgcaagtcagcacaaggggcatagtgagcctgatggaagctttcctcaggtgagtgagtttcacaatcaaaattaggtgcctgtttcttaaaattagattctgctgcaggtttacatactagacttttcagcctgcatgaattagtagggatattctttttttacttgcataattgtaattgatttaaacatgtatgccagaattcacaggcccatactaactgtccttaatttctttcctacagcagtactgctatatgccagtcctgtctgcattcttaagggtgcagttcaacacatcctctctagattatggtgaaaaagtattccaaaggaagtcttatcagagctagtgtcagaaagaatgacactaccaattgggcatgatcttcagcataggaaatgtcttagaattttattattttttcctaaattgtgatgctatactacttgtatagctagttaccacatttctaaagcatagtgtgcctctgtgaatcttgttatatactgtttgggcttctgtaagatattttgaagtttgaaaagcaaatactgaaactttaaccaagagactgacacatctctttgtacaccacgttgcttctgtgtgcatcataataactggtagaagtaatatatttaaagtaatatgtttccagttttaatttatgctttctaagaaataaaaatatgttttctgggtcaacaaaacttaaagcatgaagccctttttagtaacgtgacatcagaataagattataggtatatttttaaaatcagattttctaaactacaattgttttagaacactgtatgaagaacttatctagtcatagttatttgtagtcaggattttaacagcttgcaacaggtaatgttttgaatataaatatctttccaaagtgttactaatggtaaagagataattttctaggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagggaaaacccctgatcctaaaatgaatgctaggacttacatggatgtaatgcgagaacaacacttgactaaagaagaagtatgtaaacctgtctcctgttttaatggttgtgaaagaatataaatacagttgtgattgagagactgttaggtttcttttttgctatttgctgcacaaataatagtattaataaaaattaactgagaaagaatcttacccccaaattataccaccttccaagtaaaacttttcatttctatatccttttctagtcctgggccccttggctgtatatgtttgtatgtatgtgtctcacaagggattttttttttttttttttttttttttttttggacacagtctcactctgtcatccaggctagagtgcagtggcgtgatctcatctcactgcaatctctgcttcccaggttcaagttatcctcccacttcagcctcccgagtagctgggaacacaagtgtgtgtcaccatgcctagctaatttttgtatttttagtagagatggggtttcaccatgttggccaggctggtctcaaactcctgacctcaggtgatctgcctgtctcggcctgccaaagtgctgggattacaggtgtgagccactgtgcctggccattacaggggtggtttctgtgtggagaaggttgatggtgtgtatctgaactcagtatgttagggaaaagtcagagttcagtgtgagattctgtaagtttcggtttggatgtaagtggagaattttgaataattccttttggcctacagagattatgccattttgtctaataactgcctactttttgtttgtttgttttgagtggagtcttcctttgttgcccaggctgaagtgcagtggtgcgatttcagcttaccgcaccctctgcctcctgggtccaagcgattctcctgccacagcctcccgagtttctgggattgcaggtgtgcaccgccatgcctggctaattttcatatttcttttttttttttttttttttagtagaggtggggtttcgttatgttggccaggctggtctcgaactcctgacctcaggtgatctgcccgccttaacctctcaaagtgctgggattacaggtgtgagccaccgtacccagcctcctccattactattatgaatatataatagattttatatgttgaatgagttaaatgggatggtaaaaccccattttaacagtacagagtgaattaaatgtgcatccattatcactatgcatatttacataatttgtcagtataaataaaacaattttattatttttatcttttaccatttttctatcttgttccatagtcttaattgctatttatatgagttttgaagaaaaccctatttttcagtggaagcattatggttctccattgttgactgaagattttacttcacctccagtatataaactacagtgtgctatgttacgaattctgaacttgcttatcttttgtttagaaaggcattatgtaaaacgaaataaagacgcacagactatggaaccagcgagcgtagaaaggagatcaccagtacatagaaaagagaatgagcaaagtataaaataggatgttaagtggaagtgattgcgctaatggtagaaaaatacattgaaagcattttaaaggtaaatactcactgtttttttcagcgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagaggtaatttctttttgttttttgttattactgttaaaaaatttttttctgttatggactgtattagtctgcttgggttgccatagcaagataccacagactgggtgccttaaacaacagacattgatttttttcgcagttctggaggcttgaaatccaagatcagagtgccaacagggttggtgtttgttgagggctttcttgctgtgtcctcacatggcctttctctgtgccagcaagctctgttgtccatgctcttcctatgaggacatcagtcttactagattagggccccaccctcatgaccccatttgaccttaatttacctccctaaaggcccagtctccaaatacagtcacactgggggttaggacttcaacatacagattttgaggggcatgcaatttagtccatattatggaataaggaaagttctttttagaatattaaatacagacctgtaggtatgttacattgtggaggttgagtatgatatagtggtcttccttatcttctggatagataacttaagcccctcactactggcagcaaatagtcaatgctactcctttctcttggccagtctactctcctacctttttttttttttaaacatttgttttggaggctgaatgcattggctcatgcctataatctcagcactttgggggtccaggtgggaggattggttgagctcaaggagtttgagaccagcttgggcaacagagggagaccctgtctttacaaaaaaaaaaaaaaaaattagctgggcatagtggtgcatgcctgtagtcccagctactggggtatggggggtggtgggggctgaggtgggaggatcccttgatccccggaggtagaggttgcagtgagctatgatcatgccgctgcattccagcctggtgacagagtaagaccctgtctcaaaaaaacaaaacgatggcatctgtaaaatctttcttagaaatgtatttcctagttctgtagaaatggttgtattagatgttttctatcatttaataatatacttgcagactaaaagatataagtgctgcataaaagtagctaattatgttaaactgtcatatgtgcctttattatgtttgtcattatcctgaatagaaaggtctttaaaattgattttttagaaagcacttgaaaatatttaatcattgctagaaaaataaagcggctgggtgcggtggctcacgcttgtaatcccagcattttgggaggccaaggcaggcggatcttgaggtcaggagttcaagaccagcctggccaacgtagtgaaaccctgtctctactaaaaatacaaaaaaaattagctgggcatggtggcgtgtgcctgtagtaccagctacttgggaggctgagacaggagaatcacttgaacctgggaggtggaggttgtagtgagctgagattacgccaatgtgttccagcttgggcaacagagtgagactttgtctcaaaataaataaataaataattaaagctactcttttgcttatgcaccatttcccttcccctcttggagactctcatcatgtaccattaatttttttctccatactagattatcagcaccagcaaacatgttttatcgtgctttgtcttaataacagcaacaaaaaacctgcagaaaacatctcttaaccccattcacatccgcattcagctacaatcctgtttctatatctttttagaacaaagtgctttgttctttgtttttttcttgaggtagggtctcattctgttgccaaggttggagtgcaggggcgcaataatagctcactgcagcctccacctcctgggctcaaatgatcttcccacctcaaccccccaagtagatgggactatagacacgtaccaccatgcctggctagttttttatttttttgtagaaacgggtctcaccatgttgtccaggctgatctcaaactcctgggcttaagcagtccatctgcctcagccttgcaaagtgctgggattacaggcatgagccacagatgccttgaatgagttgtttgtacttgctttccctgcttacatagttctagtcttatgtaatttctagtctttttatgtagttctagtctattccacctaaaatctcttgtcaaggtcacttggcccctaattgataaatttaaaaagtgtattttcatttctcacatgatttagcataccaagaatatttgacatttcttcatacccttttctctctcagtctctgggttttagtctttcttgcttcccctcaaaatctcagtggctactactccttagtcttgtttgctggatcctcattcttcttacctctgaactttggggtgttatagtagtgctgagtcttttggattcttttccatctgtgctcaatccctaggatctcattcttgtctttatgtaccgtttgtataagatagctgccaaacttacaaatctgtcctctgcttctgttccgcagacttgcgtatttgttcagcttgacgtatttatttggctgttcaatgggcatttcaaaatcagtatttctaaaagaaaattattgattttcttcgcatacatgtcttctcagtcctgctcccctggtctttcctgtgtctgtttggctcaagcaaaacattaagggctgggcagagtggctcaggcctgtaatcccagcactttgggaggccaaggtgggtggatcatttgaggtcaggcgttcaagaccagcttggccaacatggtgaaaaccccgactctagttaaaatacaaaaattagcccggcatgttggcgggcacctgtaatcccagctacttgggaggctgaggcaggagaatcacttgaacccgggaggtggaggttgcagtgagaggagatcgtgccactgcacttcagtcttgcgacacagcgagactctgtctcaaaaaaaaaaacaaaacaaaacaagaacaacaataacaaaaaaacatttagggagtcatcctatactccttattctcttaccccatatcctacccatatacattttcttggcatcacctttaaatatattaaagagctagccacttttcatgatctctgcctctaccatcctagtctaaatcactattagctctagcctagactgctatagatttaatttataaaccaagaaaaaacctatcagatcatgcagtatttccccaaacccagaacagggatatataaaacctaatacataatttctaaacaatttagtttaaggtgaggacttctcatttgcttggttatatgtaggagggatttggttctgttcaatataagtaactactagctttatttttaattttaattttaatttttgagacagagtcttgctctgtcacccatgggtagctggagtgcattggtgcaatctcagctcattgcaatctccgcctcccagactcaagtgactcttgtgcctcagcctcccaagtagctgggattacaggcatgtgccatcacgcccagctaatttttgtatttttagtagagacagggtttctccatgttggccaggctggtcttgaacccctggcctcaagtgatccccccaccttggcctcccaaagtggtgggattacagttatgagccaccatgtccagccaagtaactagtaactttaattctatggatgacattcagtactaagtttgagaaagagaaagaagtttgtcctcctgttaattgtttaactgtatgcacataactagacacaagagctgatatctttttttttttttttttttttttttgagacaacagtcttgctctgtcacccagactagagtgatgattttggtcccctgcaacctccacctcccaggttcaagtgattctcctgcctcaccctcccaagtagctgggattacaggtgcctgccaccacgcctggctaacttttagtagagacagggtttcgcagtgttggccaggctggtgtcaaactcccaacctcaggtgacccacccgtcttggccttccaaggggctgggattacacctgtgagccactgcgcctggcatgacaactaaatatgctgatatctttcttattaaaactacagagactcggccaaacgcggtggctcacgcctgtaatcccagcactttgggaggccaagcgggcagatcacctgaggtcgagaggttgagaccatcctggccaacatggtgaaaccccgtctctactaaaaatacaaaaaattagccaggtgtggtggcaggcacctgtaatcccagctactcaggaggctgaggcaggagaatcgcttgaacccgggagacagaggttgcagggagccgagactgcgccattggactctggcctgggtgacagagtgagactctgtctcaaataaataaataaataaatacatccagaaattaaatcagagacacgactttatccatcacacggcggcccgtgtgcagctagccagcaggtccatggtannnnnnnnnnnnnnnnnnnnaaaaaattagccaggtgtggtggcaggcacctgtaatcccagctactcaggaggctgaggcaggagaatcgcttgaacccgggagacagaggttgcagggagccgagactgcgccattggactctggcctgggtgacagagtgagactctgtctcaaataaataaataaataaataaataaataaattaaatcagagactcagacttttttaaaaattctgttcatttaatacaactgtaccctagtcataattgtaggaattacaatagataatagaattcatttcccacctttccttataattcagcaggagggacagatgccagaatggagattttaaacaatttgtgtgctttatttacctaatccagaatttttcaaccctgagtaatagtaaaatcttttttttttttttttttgagacagagtctcactctcacccaggctggagtgcagtggcgtgatcttggcttgttgcaacctccgcctcctgggtttaggcaattctcatgcctcaccctcctgagtagctggaattacaggtgtgcaccaccacacccagctatttttatttatttttattttttatttttagtagagatgggcttttgccatgttggccaggctggtctcaactcctggcctcaattgatctgcctgcctggcctcccaaagtgctgggattacaggcatgaaccaccatgcccagccctgagtagtatgtttttaagggaaaaactattgagtcttaaacttgtttaatggtaccatgcaaatttgcaaacataaaggtagatgaagtccttgtgtctataagagctcccaactttcccaactttttttctttttttttttgagacggggtctcactctgtcgctcagcctggagtgcagtggtgctatctcggctcactgcaaactctgcctcccgggttcacaccattctcctgcctcagcctcccgagtagctgggactacaggcacccgctacaacgcctggctgattttttttgtattagtagagacggggtttcaccatgttagccaggatggtctctatctcctgaccttgtgatccgcccgcctcggcctctcaaagtgctgggattacgggtgtgagccaccgcacccggccaagagctcccaactttaaaacaaatatataaagtacattacacatcctgtggaatacttacgaggcagtatataagtacaaattttgttttctttacactcaactctatgctactttgatatgatactatctttattggtggagattcttttgctattacatgcagtcagttgtccaactattactctctgtttgaactactgtggaacccttgatgttacttaaacccacctctcagcctgggcagcatagtaagactcttatctctccaagaaataaaaaattaactgggtgtggtggtgtgcgcctgtatgtagtctcagctactcaggaggctgacatgggaggatcacttgagcttggtaggtggagactgcagtgagccgtgattgtgccactgcactcaacctgggcgacagagtgagaccctgtgtcaaaaaacaaatgaaaatccacctctcatcttttttcattaatcttgccagcatcagctagggtaatattatttggtacacatgtaactgtacatacaaactgatctcaagattgaaatcatgtgacggtatctggttataattacataggtggggcctggtgcggtggctcacgcctgtaatcccagcactttgggaggccaaggtgggtggatcacgaggtcaggagttcgagaccagcctgaccaacgtggagaaaccctgtttctactaaaaatacaaaaattagcccggcgtggtggcaggcacctgtaaccccagctactcaggaggctgaggctggagaatcacttgaacccgggaggcagaggttgctgtgagccaagatcatgccccggcactccagcctgggtgacagagcgagactctgtctcaaaaaaaaaaaaaaaaaaaaaattacataggtgatctaaagcatgtttatattaattaaacacacacaattaaacaaaacatcaacaggactattttcttagaacacacgaattccttctcccctaaatatgtgtctctaagccccactttgagaagtactaatgtaattagagctgaaagccttcgattactgatctagatagagaaacctcagtgatttcccccagtcacagagctattaatggcatatcaaagattcatatcgataatattttgtttttttaagctgggacttttgtcagtgcttcggattgaaactttacattgtttttaatcataaacatttgctagaaagtaggtatcttttcctataagtagaggtagtgtcttctaacttttcattaattatagtgcatagaactaaaacatttttcgtttaaagttttttattttatggaaattttctaattatttctgtgtgggtgtgtgaaataaaatttttttgcttttttaagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagaggtacttctagtggagtatgggtgtgtgggtgaaatgttgagtgatatgtttacagactgaaatgtgttctgtttattcctgggtggacacgtataaataaccagctgcttttgggggacagattaagaatagaacagttcatatgcctaattttttccacttcttgaagtggtttaagatttaaggaagaaccttaggtaaaagtaaagttagtaggctgtaacctttgattttgtgtgtttctttagagatagggtcttgctcactgtagccttgacatcctaggctcaagtgatcttcccacctcagccttcttagtagctgagactataggggcatgccaccatgcctggctaattttttttttttgagatggagttttgctcttgttgtccagactggaatgcaatggcgcgatctcagctcactgcaacctccacctcccggattcaggcgattctcctgcctcagccttcctgagtagctgggattacaggcatgcgccaccaagcccggctaattttgtatttttagtagagacggggtttctctatgctggtcaggcgggtctcgaactcccgacctcagatgatctgcccccctcggccttctgaaatgctgggattacaggcatgagccaccgcttccggcccctggctaatttttaaattttttgtagagacaatgtcttgcttcattgcccagcctggtgttgaactcctggtttcaagtgatctgccaaagtgttggaattacaggcatgaaccactgtgcctgacttaccctttgttttttattatggaaaaatgtacataacatcaaatttactttttttgttgttgttgttgagatggagtcttgctctgtcacccaagctagagtgcagtggtgcgctctcggctgactgcaacctctgcctccccagttcaagtgattcttttgcttcagcctcctgagtagctgggattacaagcgcccaccaccacacctggctactttttgtatttttagtagagacagagtttcatcatgttgatcaggctggtctcaaacaactttaaatgggtcaccattttaggaatattctattttagaacttgatagttttgagtataactgtttgagaataaagaatattattttaacagtgattaaaattgtggttttactcactctttctttttaaagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtagaactgtctcattggacataattgtttttttctccataaattatttaattttttcctttgtggtattctgtgtactattaatgtcaacttctagtaagaataaggagatatacaaatttaagtcttggtttgcgtttataatataaaagcaaataataggattgatcttaactgtcttttatctcaatgtatgtaataatacagtcttgtactatagattatataaaaatttgcttttcttggtaggtcacataatgagtatgactcctgaacagcttcaggcttggcggtgggaaagagaaattgatgagagaaatcgcccactttctgatgaggaattagatgctatgttcccagaaggatataaggtagtacatcaaatttgaatgaggtggtatttaggatatacatttattttaaatagtgaaaaaaattgattaagcttgcattggctttgcccaaatttactattgtcattccattctcttagctatttccaggtatatttcagttccatatagagatgaaaagaaatgaacaacatgaaacttttattactttttgaaagacatctcaaagacttgtgtatgggtctatcggttatactttgagaactgctggtgcttcagttttctagcagtcccaggaataagctcgttgagattgtggttattttacttggtgcttcaccaagattttatatacttaagtttatggattgtcagtggacacaaagaattttttttttttttttttttaaaaagatggagtctcactctgttgcccaggctgaagtgcagtggcgtgatttcggctcattgcaacctccgcctcccaggtttaagcgattctcttgcctgagtttcccaggtacctgggattacaggtgtccaccaccatgcccggctcatctttgtatttctagtagagacagggtttcgccatgctggccaggctgatcttgaactcctgacctcaagtgatccgtccctctcagcctcccaaagtgctgggattacaggcgtgagttaccgtgcctggcctttttatcatatcaacctaaaatttattttgaactataaaattttctaggtacctggtactcagggagtatttgttagtctgaagatagtctgtggtcgtatagctgacatcataaccagggggaaccagataactttgtaagtcatctgatggcctttacagagctttttctgttaatgactattgatttttaacagttcatgagtatgttttttgttgttttgttttgttttagagacagggtctcactgtgttgcccgtactggagagcagtggcgctgacatagctcactgcagccttggactcctgggctcaagtgatcctcctgcctcagcctcctgagtagctggggctacaggcatgcactaccatacctggctaatttttttattttttgtagatacgggagtctcactgtgttgccaggctggtctcaaactcctaggctcaaagtacccacattggcctcccacactgctggggattataggcatgagccactgtgtccagccttgttttgtttttgatcccctgttatttgtgttagagtatttgtttcaagtttgcatgaagttttgccttaaagctttttgtagcctccacataatgctgtgggtatagatagaactgtgggtatagatagacagaacttactgttgactgcctgcatgtctttctcagtcgtagtcattgatttccttagtgtcactaggaggaaaagtctcccttagtgaatcctactaataagcaacgtccttactagtgaatataaaaatatagtagacctttaaatccttaatggcaagtgatgcctgtggacttgacattgatttctctaggcctcacatctttagagtatccactttatccaaaatgcttagtggtctgtgctggtgcagacgttaactagcaacaaaaaatatctgtgcaaagtacagatagcatcaatataaatttaacataatttaatctttaatagacaaaacaattttaggctcactggagaagacgtgtataggtttattgacctctccaagaagttgtattttttttcttttactatatattaaattatataaaatagagatggggtcttgccatgttgccaaggctggtctcaaactcctgggctcaagcgttcctcccatctcagcctcccaaagtgctgtaatcctggcctgtccagaagttgttttttttttttgaagtctgttaccagctttaaaaaaaaaaaaaaaaatttctttgtgattttcagcctgcattttttgaaattttactcgttttgcaaaaggtttgatcaggtggtgtgtattttatagggctttggcaaacattttggttttagtttttatgcatttaactaatttttgtagagttttacacttaaaagattttgtagtgcaagaatttatgtgacattttaatactaaaatataattttttatgttttatgccccatatgagcttatttccattttatataaatcttatgaaacattatttgctcgactacagcattttttggaattgctgactcagattttataattttcaaatttttaataatttgacattttgacccacaacatgtttgaatgtgattagtattttctaagctcttctcttgtgtttcctcagttccctacaccacggatataatcagttagtggatgagaagtatatattttaagtttctaattaagatagaaaagcaagatagatgttgtctccaagcaaataaaaaccttattagctaataaactaaaatattttaagtgcaaatattgttcattatgctgttttttaagttaagaaaatcctaaactgtcttataacttttattaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggtaagtgatactagcagaaataaactattaattgtgttccagaattataaatcataacatttcaacttcccttaacatttttttctttttactataggttgatgttgatgaatcaacacttagtccagaagagcaaaaagagagaaaaataatgaagttgcttttaaaaattaagaatggaacaccaccaatgagaaaggtaagtcccagtttgttaaattgtcatgtttgttgcttatttatttaattaaaaaaaatttgtagtttttgtagagacagggttttgccatgttgcccaggctggtctcaagtgatcctcctgctttggcctacctcccaaagtgctgggattacaggtgtgaggctctgcacctggccatgtttatatttttaaaaatgtttttaattttttcaccaggaaatgtagaccacaaaatagtagtgaactattggtatagcccgctgtggagtgtggtctttcctttactctcccaaatagcccaaattggtaaaggttatttagaaagccttccccataaaaaattaacttttggtagtgttatatttttgtgtttaggaatttataattactgtcttcatctttatcaaggacatagcatgaggggaaaaaatttatgtagtgtgaaggatttaacttttttgcttgtttttattattaatattatatatatatttttgagacagggtcttgctctcttgcccaggctggagtgcagtggtgtagtcttggctcactgcaacctccgcctcttgggttcaagcaattgtgcctcagccttccaagtagctgggactacaggcgtgcaccaccacgccctgctaatttctgtatttttagtagaaacggggtttcaccatgttggccaagctggtcttgaactcctggcctcaaatgattaacctgcctcggtctcccaaagtgctgggattacaggtgtgaaccaccatgcccagccgtttgtttttattattatttaaatactcctgggctcaagagatcctcctgcctcagtctccgaaagtgttgggattacaggtgtgagccaccgtgcccagctggagttagcacaaaattctttggttaaaaaagctaataaaaatgctgaaaaatgagattctcctttttgttcttaaggcctttaaaatatgcttaaagcttgaagataattagtgaaattatgtgagggattatgttaacactatatgtgccttggaaatggaagatacttcagggaaatgaaggcatttagtacatacctctgtggttcgttctattaaattactcttttgagttaacataaaatttctatcacaggaattgaaattccagagtaatttggatggaaatgaactcatgctgtctatgtaaaatgtgtgtaaaagtaaacactaaaatattaaagtatggaaaatcttctttgagtaatttgctcattcaaaatgtttgattataaagaaaccacacctattactctgctctttttcccaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataaggtttgttctccttaatagtgtttctgatagtttaaagttttaactttttcagttaatcaatgttaaatttacatattctcctagaccttttcctttgcacaagtacacaccatacatgtacaaatacagttttatacagatgtacagatgttagtttttgtcatctttgccgtaagaggttcatattatttaattttttcatttgcttttattaaaattagattaggatgagaacatatgagaactaacgccagttagtattaagaaccagttttttcaccgatggtaattatggtgcagtatgttcatagggtgtataagttatttctttaaaaaatattgaatattagtgtgtcactaatagctctcttaaattttcatctctgtctggagtttgaacttgtataattaaaattcttaaacagttcgtcccttgattaacaaaagtcctgataattctaaatttcttatgtatgtttaattctgtacatgagcatttcatcagtaattgatgtgaaagtgtagcttcttctcttttctctttttcagatcctcgtggtcattgaaccgctattgattgatgaagattactatgctagagtggaaggccgagagatcatttctaatttggcaaaggtatttacatttaatttctagagaagaaaatttatatctgtttatggaattgattatggaaagaaatggttgaagattaatattaccaactcatgactgtcctttctttgtttacattttaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtaagttgtaatgtaactttgtctttttttttttttctttaggagacagggtcttactatgttgcccagactggactcaaacctttgggctcaagtgatcctcctgctcagcctccttagtagttgggactagaggtacacacacagcctgtccatgtttaataggacagctgtcctaaaatttgggctactgatttggggagataaatggaaaggcatagctctacaaactatagattttatgatgggtttgttatattatctgctgacaggctatggttcatgttttgcttttacctaattttgtttaatgtgaacatattctgcagtttggctaaatagttgatatattgagagaatctggatgatattgtgtaacttaggtaatgttggggcatagttaaaacctgtgtttggttttgtaggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaaggtaaatccaccaattaccttttgatttatcttcattaaagttaaggcgacataaatctaaattactaaagtacatatattttttatttaaaaatagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtaattattccagatttgttaatgtaaactggatatgtttcatggttctaacagaattttaaagtgtttttaaaaatcaacaaaaaaaactgtatgttacacgaatactgtttgatttgtttttaaattttattttttaaaatcacgtaatcagcaatgagtattctcttcatttcaggtcagttgatttattattactatttcttaaccttttaggtggtaaaacagtgttgtgggacagatggtgtagaagcaaactacattaaaacagagattcttcctcccttttttaaacacttctggcagcacaggatggctttggatagaagaaattaccgacaggtaagcttttattgtaaaagaatattctcaaaagtcctttcaactcattctttagtcaacttgaatgcatgttgtatattattttttgccttgattatctcacagtttatatgtgcttgattatgaaaggagatggattttagtcagccagttaacttccattttgattttggattcgaggattaatacttaactgtgaattgatgtttttgtctggtacattcagtgctttatctggctagatgaaacatggacacagttttaccttgaatcatgttaacttatactcatttttcgatgtttggtcacttttctcttcaactttaataagtagcaatgaatcattcttaccatgtttattagctaaataagtagtatatttagagtatttggttttcatgatgttgctttatttccttggaaaagcagtctaaaaggttttttgtttttctgttctttttagttagttgatactactgtggagttggcaaacaaagtaggtgcagcagaaattatatccaggattgtggatgatctgaaagatgaagccgaacagtacagaaaaatggtgatggagacaattgagaaaattatgggtaatttgggagcagcagatattgatcataaacttgaagaacaactgattgatggtattctttatgctttccaagaacagactacagaggtaatgaaaactattatggcacattgctactaactttaatatttgtagaaaagcatattagttgtcaagcaaatttttctagaatgcaattgaatttgaagtaatttttaaaatgctcagggggttaccaaacgatattattctacctcaagttttaagatttgatgtaaaaaaacagcaacagatgtttgggtggttagaaaaggttgactcttagtgtatttcaactgtgcagtcataaaccaaatgaatatgtcttttttttaaatttattttttaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggtaaacttttgcatcaaattcttacttcttccccaaatagtttaatgtaaatagtaacattttaacattatttgttttattataggaaaaattgatgggacacttgggtgttgtattgtatgagtatttgggtgaagagtaccctgaagtattgggcagcattcttggagcactgaaggccattgtaaatgtcataggtatggaatttgctggttacataagactttttcttgttttaactttctttttcttttttttttcgtaagtaaaatcttatttaggagttgggaggtttttgttagctttttaaaagcacttcaagattgtagttaagtcgggggatgtcacaaaagtcttgtttcccaaaacccatttatattttactttaaagagaaaaaaagggtaagtttaggacctacatgagaggtgggagtagtcacagctcaaaaagctttgaagtcatggaatacaggaccctagtagaaatagtgtgtcaggtgaaatatattctgccatgttctgctgcggggtgaaaaggcaatcctaaagttttaatttagttttagaacaatatatatatatttaaaccttgaattagcgattatgacaggttttttgcttgtgatcagtttcaaggaatataatcagagaaaagtgaactgatcaaattattgtctttatttacatacccaagttttaaatactgtccattcagttttctaacccgtaatacagctatattacaaatggtcttggatatggagagcaaagtttttattccattagggcagtatgaagaaaacaaatggtttcttatatttaatcttttttttaaattgattataactgttgccaaatgtaactcctgcagagtttagaggctctgataacctagcagaagtcaaaatagctgactgtgagagagccactgtttgtttttcctcattttgtaagaggtatttatgcgatacacatgtttaaactattgtatttgcatataatctccaatgcaaccctatcctctatacttgaagatagctacttgccagaaatcatttacatggccacttgtagggctctggtttgcagggagttttaaaccatattgtttgtcagagaggcatgggaagagcaatggagagagaatcagagcaagtgattctagttagagcaagagcccctgccagctgcctccttttttctctcttcgtaggtgtaaataccatccaagtatgccctgcattgcagggagactggagatctgtttgttttgcagttaaagggtaagggggccctttctggaaatttttgctttatttacatgtttacctctggcttatattgttgtgtatggccggaacataagctgtccccatatttaaatgtcagtgcacaaatatatttcagaatcaaacaaaacttttttgttattgagtatccatcatcctttaaatcacttcactgatttctttcatttctatacataatcaaaaattgttaataaaagttaaaaacgattctgagtctggtcagaatctggggctttctctttccctaggcagctgtaagtttatatttatacatagtcatatatgacattgctaagtaaaaggaaagtgaacaaaagttgcaattcaaatgttgatagtttattgacttctattaaataggtatgcataagatgactccaccaattaaagatctgctgcctagactcacccccatcttaaagaacagacatgaaaaagtacaagagaattgtattgatcttgttggtcgtattgctgacaggtaagcagattacccacacatttttataagcagtatcaattttcaaatttggccactttgtattcaattagcaaaatttccttaatgtcactaatataagtgtaaaagattaggctatccagtattaatattttcagtcaaatttcaatttggatggtaatgggggtggcaatgtaattttaggactaaacctgtaagactaactcttcagcctttctgaagagtagtaagttttatttaatgcttaaaatgagttaatcatgtttttagaactgaatttgcaaatttatccttaaaacttttcttaatgtcacaataattaatatgtgtattttttaaattaggggagctgaatatgtatctgcaagagagtggatgaggatttgctttgagcttttagagctcttaaaagcccacaaaaaggctattcgtagagccacagtcaacacatttggttatattgcaaaggccattgggtgagtgttatttacttccattaaaaaaaaattactttataataaatgcattgtggtattggaaaatacttccatgtagaaatctcttttgaggcatggtctgaataatgcagttgagaaagctcttcatttaaccactgaccttctgattattggaatgtattgttaaattctttttttttttttttgagacggagtctcgctctgtcaccctggctggaatgcagtgattcaatctcggctcactgcaaccaccgcctcccaggtgcaggcgattctcctgcctcagcctccccagtagctgggactacaggcatgcaccatcacgcctaggtaatttttgtattttttagtagagatgaggtttcaccatgtgggccaggctgttctcgaactcctggcctcaagtgagccacctatcttggcctccaaaagtgctgagattacaggcgtgagccactgcgcacagcctgtagtcttaaattcttaattaaaatagatggaagggtttaagacttactttaattacactttaggtgttttcagggagggaaacagtaccattttcagaaaaatttaaaatgtgtgctggtcttctaggatattgcttaaactattaaggcaagtttttagtctcacaacatcatttaagtctcatattaatgctttatatgttttaaaaatcttattatggattgtttgagcccaggagttcaaggttacagtgagctgtgattgtgccactgcactccaacctgggcatctgggcacctgggcgacagggcgagaccctgtctctaaaaaaaacaacaaaaatgctattctaacattactccacggatttaactgaattatagctgctttgtgagataatctgtggtggtttgcttccactccatcacaactaaaataggaaaaaacagtcattgtagaaaacgagacaccacatgtccatgtggcttaagaaaatgttttcaaggaatatgacatgtgaatgtctgattaattaggtagaattataccagacaacaccccctcccctaacacatactcattcctctcctattttggtagcataatatttatttcagtggtgatggagtcaagacatttgcaagaatagcttttgtgcaagcttttagccccaatgtccctctaagtttatgtcaaagaagaggcaaatagatgcagcaaattgtgtggaggaaagataaaaggaaaagagattttatatggtttataatgggagactacaattcggatattcccctcaccactcctacctagttctagtgcccattttgacaactcagagaattactcactttaaacatttagttaaatttctttatatttcagaaagtttaagaactgaaaattacatttgaaaattgagttaacttaaaatgtttagaatttgtacagctatgacctctgatcttctcagagtcaacttttttaaactgaccttttaatttatatgaaatttttatatagaaacaacaatgccagtgacttgaaagtattgcattttataaaattactgagttccctgtaattattaatacttaaaagttttcatctttatgcatttttttcttccataaatttttgacttataatgtaacagcttgttgacccatttgtttttttcagccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggataggtaagtgacttgaactaaatacaagaaaataattataactcttccttcattttagaacatcgtgaaatagttattagatgactttttactgtaacatagttaaagaaaaaattgctagcctggagtcttaggacattgtaaatatgacttattattttaaaataatgtgcacgctgtagtgattccccagactttctttcaagttctcccatcccctttaaatctcttttcttatctattgaattaaataaattttgaaaagggttgattgataatcttttgttttcaaaattggtcaaatatagttagaggacatgatgagcagaagctaatgggcagagacctgatctttttagctttttgttgcaggtaaaggacaggtttctcttaagcctttgaattactgaacaatagcctgccagaactacactcttcctgttgcaggtccctggtgtttcagatggtgaccaccagtagagtactgttcaagttatttgacagattgctaataccttttaccatctagactgacgtacagccttaaacacagaagtaactgaagaaagtgcaaaggaaagtgcaagcgtagtaagggaaagaactgtttcactggctctttatttttcaggagagataagttactcaaatcagagcccattcaaatacttttgtgtacagatttaagttattcattaataaccttctgaaagggagacttaactggactcgacaagttaccagaacgtatatatgcaagacatggagacaaagtaagaattgtgctctgtaaaagcctggctgcccagggctaaaaaaaatgagggtaaatcacccttgctctgtattccttagtgagaagtgcctgagcaccatagtgcagtcattaatgtatgtcacctgcagttaaaaacttttttctgtgtactaagaagttaagggagtaattccattgaaaattactaaatgaaaagaatacttcagttggaaattttattaatgaggaatactgcttcattcttatgctgaatgacattattaaaataaataggaaaaacaagaatattagtaaatacaagtatttttctcttttctctttgatatggtctgtgttactatctttggagcaaagtgtggaaactcatttttttttttggacggagttttgctgtgtcacccagtctggagtgcagtggcatgatctcggcatactgcaacctctgcctcccaggttcaagtgattcttctgcctcagcctcccaagtagctgggactacaggcgtgtgccaccatggccggctaattttttgtatttttggcaaagatagggtttcaccgtgttagccaggatggtctccatctcctgacctcgtgatctacccgccttggcatcccaaagtgctgggattacaggcgtgagccaccgtgcccggcctggaaactcattttcatacccattgcaaatcccattgtgttagccagcgagctcatacttggttgaataattgtggaatgaataactcattgatttttcatgaacataaattcagttaacataggagatgatagttatttctgtaggtttgaaaaaattattgatcttttgttcctctccccaaattgagttattgaatgaaacttaaactttacgtgagaagggaatttaactttaatttagttacctattatataccagtatctgaagtactagtaaagatttaagtttataatcaagagtttaaaatgatttgggaggccaaggtgggaggatcgcttgaccccaggagctcaagaccagcttgggcaacatagcgaggccttccctatctctaacaataacaataaaaaagaaaaataatttttcttttttttttgagacagagtttcactcttgttgcctaggctggagtgcagtggcacaatctcgactcactgcaacctccaccccccaggttcaagtgattctcctgcctcagcctcctgagtagctgggattacaggcgtgtgccaaaatgccctactaatttttgtatgtttagtagagacggggtttcaccacgctggccaggctggtcttgacctcctgacctcaggtgatccatctgcctcggcctcccaaagcgctaggattacagacatgagccaccatgtccggcctgaaaaataattttaaaaaagagaaaaaagtttaaaatattactgtttattattcatatgttagaaccacatgcctnnnnnnnnnnnnnnnnnnnncctatagtgggtcgtatttacactgtttattattcatatgttagaaccacatgcctcctctttagtagcataataaagccaagacttcacagagccctcctgctcatattccttttaaaagttaattagatggccaggcacggtggctcacgcctgtaatccctgtactttgggaggctgaggcgggcagatcacaaggtcaagagatcgagaccatcctggccaacatggtgaaaccctgtctctactaaaaatacaaaaattaggcaggcgtggtggcacacacctgtaattccagctactcaggaggctgaggcaggcgaattgcttgaacctgggaggcagaggttgcagtgagccaagatcacaccactgcactccagtctgggtgacagagtaagactccgtctcaaaaaaaaaaaaaaagttaattagaaaatatggcttaattgttgagccatagtgaatcttgagtaattaaagcaaaagtcctcaagtggaagctattctaaaggatatattagatatatgaaatgttagatgacttcacatctattcagtgcactgaattagtaatttagtttctaatgggccggtgaatatttcctgtaaaactaagactgtatctttaaggatttttccccctttcttataagaccgcatcttaaaggacttttttcccttccgttgtagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacaggtaagttaaagattttttttttaatcggtgattttttttttttaaataatactttaagttctgggatacttgtgctgaacgtgcaggtttgttacataggtatatatgtgccatggtggtttgctgcacctatcaacctgtcatctaggttttaagccctgcatgcattaggtatttgtcctaatgctctccctcccctttccccccactgcctgtaagttaaagatttttaaaagattacttagcaagaaaagtagtgtattgaattaagttacttttcctgattatcattagggtatattgtgccatatggtagaacaattgtgtggtgacaggggagtgagttttgtctcttccattgcagcttaagagcagtgtaattagtaggttcccccccccccccaactccccaagggaaataattttgaatcatatctttatgttttcttaattttgttaaggttatgtatgttcttaaaaattgaaataatgtaaccgttcaattattttagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacagcaagaagagtagcctcaggggatgttcccctcaaactagcacaaccattccatcatcgtagaaaagtagcacttttgctaaactgtcttgaatattttgtacttacatagcgcctttcatctcttgatttctcaaaatgctttatgaacacatttaaagaaagtggtttaagtcttgtccaacacttgacaggtctgctgtgtttagcaagtgaggaatttaactttacttcaaaactgctttctgcctattaggagtgaggatacctaagtaatgctgatagaacaggacaatgttgggcttttctccatgttataagccactactcagcaatgcatcagtaaatacctattcacccactgtatgccagccactgtgcttatatgcaggggatgcaaaggtgcatgagacctgccctctacctttaagaacagtataatggagaaggggagacaaaccttgtgacagattccttatgtactgtgataatacacagtggcagcagctaaaatgtctaggtttgcttagctttgtattcagtaataataagttgatctaagagttcagcataaactgaatgaaatgccatttaatggtagaggaaccaagcattaaggcagtactacacttaattttttaagcaaatatgtaaagtatattttcaaacttttctaatgttatggccccaaatttcttagttttggcctttttactacctatactatttttactgttttgttttgtctccatgtggtagtacttctgtgaactctaaagggaaaaaaaattctgcaagcagcattagtatataactactactgtaagtaaaactgcctattgacactttaggagttcctgcttcagaagcttagttaagaaacagcttgtggccgggtgtggtggctcatgcctgtaatcccagcactttgggaggctgaggcgggcggatcacgaggtcaggagatcgagaccatcctggctaacgcggtgaagtcccgtctactaaaaatacaaaaattagccaggcgtggtggcgggcgcctgtagtcccagctactagggaggctgaggcaggagaatggcttgaacccgggaggcggagcttgcagtgagccgagatagcgctgctacactccagcctgggcgacagagactccgtctcaaaaaaaaaaaaaaaattgactttcaacaaattgatagtgagcattaagggtttccaagttggatttgtaactcctcatcattccttgtatgacaactttctgaatatatgtcactatgtagtaaaattaaacactccaaactcatctttctgttgttagaagttttcagcggtacttccatgcaactttaaatctcactgctctctatggttgatgtcaaatgaccttcagtaatgactgagaattgaatacaaatagattacaaagccaaaatttgatgttaaatgactcaggaaattttagttgtattttcaattcaagtacttagtagcctacgtttgcttggcctctggttctttatggaaaataggctttgtagtggcattgtggagcaaaggagactgttacaccttaattaactttttttactgatgcaaataatttgaggatagagaggagggaagtagtgaaagctatgacctaaaacattgggaccaaatagaggctcacagatatttggattattttatgtgcttattattaaataaggaaagcattttgtgatatgtggaagacgctatgtgaagttttacctatcttctcaaagaccttttcttttgtattttcttttggtgtttcttaaagccaaacaaagaaatgttcttaaggagacagggtgggtttttctgtgggcctttgttggtttttctgtgggccatcgccctctaatggaattgatctctggctgtttgatttttttcatattgtatttttaaaatttgttgtacagtgccctgtgagcaccaagtaccactagatgaataaaacgtattatatctaaagtcttagtagaccaatttttaatcttagttgactctgtattgttatcacactgcactctgttgtggttgtgccatttttgcaaaattgagctctttcggttgttttcgaaataagggaacttagtgttgaaaaaccagagaactttttctttaataagaaactaaaaaagttgcagccacataggttcagtttggctctttggtttccagtggctctcaaatcccctaaggttaaaagaaaacactacagctaccctagggtttctcaaccttggcattattgacatcttgaatcaaataattcattattgtgggggtgctgtcctgtgccttgcagaatcttgagcagtgttcctgacctctacctattgagatgccagcagcacacccccatcccagtgtaataaccaaaaatgcctccagacattgtctcatgtcccttggagagcaaaatctccctagggtgagaaccactgagaccattgtttaagcaggacttacatgtttaataaaattaaagcatgatatataaagcatttgattttaggcagcagttgtctaggaagtaactagaaatacaacttagcaaatacttaaatgtctaccttggggtaaagctccgcataagtcctggggagagtaagctgtgaaaatgtgtaagatgaccccgcactgatcctcagagcatcttgtgacagttgggagccatgttggcagctcgggcaggagtgctggaggtggcttggtgctccacttgggatgctggtcttcaagcattgtgttctcacctgtgagctggcgataggtgggttatatggtacggctggaagaggagggcaggcagggcacagaaaccccttcctccccttttaaaaaatttggataggaagccatggagggaatttaatgtgacttgatagagaatttaggtttgcaaggcagtcaagatttgtaggcaggagggaataagtaagtaaaccagagtgagtgtagtcagtgacatctctagtgttcttgctagaataactaagttttaaaatttattttgtggattctaaaaagattttgaaaggacatgcttgggccttggacagttacttttttatagcctggctgattaatgaagttctggaaggaaattttaacatgttagctgagaggctggcgaggggatttaatctaaataggtttgtgctaggaaaaaacttgtaaatagaagaaattgtttctataactgcccaaactttgaaaaaagttgaaagactattaaatgagcaactgtatattttccacttaaattcaacaattaaaattttgctattttgcttttgtgtatttattttaaatagtgaatttcttgagacaattttcaagcagtattgctgaagagaagtttggactagataaaatagaggaggaagctaatgagctaaacaaagtgggcgactgcttgaatgaatgaataatgaggcagagaagtgtggaaatcaagcacagatggaagggttttcctgaagaggaggagcagcatctttccctgagtacataaggaaaaagatatggtgggttataggcatgaaaagttcatctatggcatgtcagaatttcaaaacagttttcttggtgctttagaaacaagtagacatagtgaggaaaatgagacttgtgtaaaaaattcatgcaaaaaagctggtgaagtttaacactcagacactctggtgtctatagtatgtataatgtgtaatgtgtaaaccgatgctttacatagttttgatcacagaagcagaatataatttatacatttgggaagaaaagcacttagcaccaagatgatcaccaaggaagaactgttcacatgccacatatctaggccattgttactcaagcgtggtctggagattggcatcaatgtcacatggggattttagaaacatgcttgtaggctccatccggaacctgaataagaagctgcatctttgggctgggcttggtggcttcgc

SEQ ID NO: 13460 - DNA, 8100 bp, Human
gaaacctggtctctactaaaaatacaaaaatatagccaggcatggtggtggccgcctgtaatcccagctactgaggaggctgaggcaggagaatcacttgaacctgggaggcagaggttgcagtgagccaagatcacgccactgcacttcagcctgggtgacaaagcgagactccgtctcaaaaaaaaaaaaaaaaaaagtaacacaggaaataaaaccaagacaagatgagctctctgtgtctctgtgtgtccctccccagacccaaccctggcgtcccccagaggtaacccctcccaggaactgggcgtttgccactcccctgcacgggtctacacctctgctacaaacgtgtgtccctaagcagcggacgccttttgaaaacaagtcaactgtatcatgctacgatattttttctgatgtttgtgctgtttctgagacagccttatgacaccttcccctattctgtagcattctgttggctcactttgccacagtgtatgcacccattctcccacaaatggacttttcatttgcttctcaatgtttgctaccaaaaatctccctgcaataaatttattttatatatccccttgtatgtgtgtgagggtcccctaactgctcacaaatatctcagcaactccgccctccccactcagacctcatttccctcctaccagacatgctcaaaggaaactgggagcaacacaaagatgactttgaatctctgtccaccacccctagactgtatgacacccgcaagtgacaacctcccctctctggcctcggtttccccctctgtaaaatgggggatggcctaccttgccagtcatggcaggtcaatataaaacaacttctggctgtgcacagtggcacatgcctgtaatcccagcactttgggaagctgaggcaggaggattgcttgaggccaggagttcaagaccagcctgggcaatatagcaagatcccatccctcttaaaaaaaaaaaagaagaaaaatatatgttgttgttgttattattgttattattagagacagagtttcgcttttgtcacccaggctggagtgcaatggtgtgatctcagctcactgcaacctccacctcctgggttcaactgattctcctgcctcagcctcctgagtagctggaataataggcatgtgccacaacatctggctaattttgtatttttagtagagatggggtttcgccatgttggccaggctggtctcaaactcgacctcaggtgattctcctgtctcagcctcccaaagggctgggattacaggcataagccaccatagctggcctgtttttttaaaaaaagaattccagtaaagagctgatcatggttctcactccttgaataccaggaacaccatctcgtatcacataatgagacagggagacattctggtcctcatctcacagatgaaaaatgtcaagcttcgaaggatcaaagtgcccacctagtcacacgggtagtcagccacaggtcagcctgccttatttattcttcatgagtatttatagtgactaacatttactgggcgcctactgtgggccatttctgtgcatgtgacaacccctttaagtccttgtttctaatcccaagaagcaaggaaatggggtcagggaagggacaaggtttgcccaagtccaggcagggggagaggtcaagctcagaaccatcacctgcccatgacacatgcccaggactcaggttccctaggcttccttccaaaggctcagcagtgacgagccagcccttgaaccagcctcttcccccacccaagcagccacctctcaggggaattgtggccaccacaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggtatgtggccaaagggcaggaactggcgggaggtgggggaagctgtggaggctgcagagagggcacaggcagagggaagggggctcagggaaaggggaagaggaggcagaggataggggacccagggaagatgcctatagaaatcgtatctgtgccaagatgggccaaggtggggctggagggagcccagcgaaggagaaggggcgtccacagtctcacacagggaggcaggagcaagagtcacctcccccacctcctgttccccacaggccaaaataaggaactaaagttgctcttgactgagcaccagggctgggggcaggaaggggacttaggggtagcagcattcagcgtctgtcaaggggagaaaaagctttctctgccttaaacctcaggtgcctctctctgttgggagtcccttctcagcactgggggaatgggtgtctcatggactccccctcacctgctcaaggacagctggcaggggctgtggccacgctaacccaggagttcagagaaaaaggttccccacccaaggggacactgggagcaaggattggagttcacgtctgagtcttaagcccgtgacgatgagggtgctcggcccctctccccatctcttcctccttctctcttcctcacctccctcctccacctacctccagaagaggggactggccatgtgggaggcctggctgagagctggggcttcccagaggagcccggattggacactgcagccagcctgagccgcctcgtctcactcagagacacccccagtctccaccccgctctgagccccttcaatcaccagcagcccagcccaaggactgaactcacccctgacccctaggttgacacatacaacttacagagaatgagggccaggcacagggtcacaggccagggcaggccacagactggctcctcagcccaggcagggagaggccagggagccaagagtttgaacccagtgccactcctgactgcctggtgatgctggcaacccgcctgccctcccagagcctcagccatccctcctgtaaaatggggctaaggagagaacctacttctagggttctgtgaatgattacacaagaaaaagcgccaggtgctgggcctggctgaggctggggtgcaaaaatggaccgggaaggctgcgggaggaggggacgcctgcactgcttctggaaggagctgtctggacagcggtcctccagtgcctggaacaaacatccaaaatccagagagttcacagggccagagtacaaagtgggtatgcgggaggggggcaagagatggcgctgcagaggtgagaagggcctcccaggggtcttaccatcccagggagtctcattctcctctcccaggatatcctcacccaccccaaccaggtatgtcctctctccttcccaggggcttcttcactttcccgcatcccccctctccccaggatgtatcagcccctgtcaggggctctctctctccctccccacccaggagagtcctcaccctcttcccaggagtgctggaactgcaggggccagggctggggaaatgtgtcaccatccccagtccctgacccacccaccctgtctctccacaggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccgtgagtggcccagccctggcccctactcccactgtcccgctggggacactcggtttatctttgaagtggggatagagccagtaccttcaatgtgggtttcaaaccggcttggacagagggacggacattctcctctgcagagtggggtctctggggggtctggggccttgcaggaggtgggcggggccaggaggctagggagggcaagaggggccagggctctgagccatactacctccttgcagagccgccccccaggcccttcctggacatgggggagggcaccaagaaccgaatcatcacagccgaggggatcatcctcctgttctgcgcggtggtgcctgggacgctgctgctgttcagggtgagccccctcggacctctgagtcagccgggcgagggcctgggccgagggacccccaatacccaggtagccctctagagcctgaggttccccatccaaaacttgggagaatgaaagcacccaccatataggggctgtgggagttaaatgaatgaatataaagaagggacttgaactggcgctgagcccagggggtgtcttcaatttagtttccccttctgggctgtcctcacgtccacctccccccaagaagagtctcattcttctccctaagagtgtcctcactcccctcctgccctcacccaggagtgtggttaccctccaggtgtagccaagaccagggaaggtggggcctggtcctcccagaatctctgatctgtaccagcctctccttaggcactacagaaagtgtgactgttattgttattattcatggagaatagtaagggagtggagactcaagaagacgctagcttgggaggccgaggcaagaggatcacttgaggccacaagtttgagaccagcctgggcaacacagcaagaccctatctctacacacacaaagtcttaaaaaaaaattagccaggcatggtggcacacacctatagtcccagctactcaggaggctgaggtgggaggattgcttgagcccaggagttcaaggctgcagtgaaatatgatgttgccacagcacttcagcctgggcaactgagggagaagaaagagagagagagagaaagagagagagagagagagagagagagagagggcgagagggagggagggaaggaagggaagggaagggaaggaaggaaggaaggaaggaaggaaggaaggaaggaaggaaggagaacactggttgtagactcagagagaactgttacataaccagtatgtggccttggggacatctcttaccctttctggaaaagtacttcctggcatccaggagggtctgaaagatattcacctccccctgctcactgaggcacccaccccacccacccctacagaaacgatggcagaacgagaagctcgggttggatgccggggatgaatatgaagatgaaaacctttatgaagtgagtgaagggtggggatggggtaggggcagttgtgttaggggtgggggtgttccctctgggggtggctgggggcagggaccccaggtgtcagggtgctgatgttcgctgcctcatttccatcccagggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgcagaccttggcaggagtcgtggatcttacggaaaccgcctctcccacatgtccctcagacccaggagtcccagcccaagccactccctgcccactccccacacctgggaccaggtagccagtctgggctgccctcctgggagaacaagatgtctcttgggaaggtccccagaccaactgaaggactggtttggccctctttgcagggcctcaccctagggtcatatccttaagcaagaaggggacaagatcaagatggctgtggctaccaaattacttacacttttttttttttttttttttttgagacagagtctcactctgttgcccaggttggagtgctcactgcaacctctgcctcctgggttcaagcgattctcctgcctcagcctcccaagtagctgggattacaggcgcctgccaccatgcccagctaatttttgtatttttagtagaggcggggtttcaccatgttggccagactggtcttgaacctctgacctcaggtgatccacctaccttggcctcccaaagtgctgggattacaggcgcctgccaccacgcccggccgctttttttttttttttttttttttttgaggcagagtctgactctgtcgcccaggctggagtgcagtggcgcaatctcagcccacttcaacctccacctcaagcgattcttgtacctcaggctcccgagtagctgggatgacaggcatgtgctaccacacccagctaatttttgttttagtagagacagggtttcgccatgttggccgggctggtctcgaactcctgacctcaagtgatccaccatgcttcggcctcccaaagtgctgggattacaggcatgagccactttatgcgtatttaagccttggaaacacagggactatcttgtggattggggctagtacagaattcagactgcagccttttcccgatgcgttgacttacagaaggggcattttggagggtctgtggtcctaacctggggatagcagggagatcccggggcaatgacagagaggcacagagacacggatttcctgagaaagggagaggagagaggctgagacccagggatcatgaaggggacgagcaagggaaggaagagatgatgagaccctgggaatccgggagagagacagggacgtggagagaaagggacagagagagagcgagaaggaaaggaagagacagaagggagaaggggcaaccgaaaatgggcacgaagaggcccaggcacagcaacagctggggaaatgacagagactgagacggagatgcagaaagatacagagagagctggagagggtagagaagggctttcggggagaaagtgatggagggacagagaggagaggtggaggccaaggagggaaagaccccagtagagaaagacagagggacagagaaggggatgcagacgcaggcgggagcacacccacagaggcgaaggaagggcgcaagaccatgagaaccacagacgcggaaagccggggaggtcgtggctcggtctagggcgcacggggagcagggcttgccccccagcacctccggggaggtgaccccagccgggagatgcgagtcccgcggagcccgcgcccggcggacggaccgatggacaaagccggggagagctcgggcgcggccggggcgggggccggtgcccgcagggacccgggcgcagcggggaaaggaggggcgggcaagcggcgagaaggggaaggaagcggaggtgccgggcgggcgcggggcgcgggcaggaagcggggaggggcggcggggcgggggcctccggaaaaacgccccgacttcctgccccgccagagccaggaagcgggagccgggacccagggcccgggatcgccgagcccgacctcgggcgccccgccggtcacctccgcgcggacaccaggtactcggtccccggccccgcccggcctcctcccctcggctgttgggggaagtggggaggaggagggaggggctggggcgct

SEQ ID NO: 13461 - DNA, 8100 bp, Human; identical to SEQ ID NO: 13460

SEQ ID NO: 13462 - DNA, 19272 bp, Human
tatccctttttttttttttttgagatggagttttgctctgttgcccaggctagagtgcattggcgcaatctcggctcgctgcaacctctgcctcctggattcaagctactctcctgcctcagcctccctagtagctggaactattggtccctgccaccacacccagctaattttcatgtttttaatagagacgtggttttgccgtgttggccaggctggtctcgaactcccgacctcaagtgatccgtccatctcggcctgccaaagtgccaaagcgtaaaccaccgccccgagtggctggcattgtttattatgtcgctgatattgtcccaaatttggccattgggagttccttctagttggtttctgtgacttttgacacaaccccatcatttttcaagcagttccttacttctggccccacagaatgtttacttctggccccacaaggctcctcttgtgctttcttgcccagccctggatcagctatttctccagggacccctggttcctttcatgggaaaatgatgtttacagaccatgggcacccatatgcccattgctagtaggtgccggtgcttctatgccctctagtggtcggagctgggaaataacacacccacactagtgtactgttacccacatttcacaaattaggtaaatgaggcacagaaaagttagacaacttgaccaacatcacagagaaaataggtagtagaactggaaaacaaaaataatgacagatgcacaagtcctaacaagcaaaagtaacttcttcacacatgcatgttagcagaaagccacaagcccaatattccagcatagacactctctttggaaaataaccagaattccacagcaataaacacaatgataaccatcacgtactcaacacccgcctggacactgggctcccacatattcccaacaactctgcaaggaggattttaccatcctccttttacaaatcagggaatcaaggatcatagaagccaagtgacttgtccaagtcaacatagttaagtgacagaaccattagctgagcccaggtctatatctggatataaattccatgcttatgccactatataagcatttcccaaaactgattttaggtgaaacataaataaacttttaagtttaactgtgtttattttaacgcatgacaggaaaaaaaattaagcacacatcaaatctctgatttcatggacaatattgcataagacaaaaatattttgtcttcagttcctggcctcaagccatcctctcacctcaacctcttgagtagctgagatcacaggtgtgagccaccaagccctgctaagacaaggatgttttgtaaactaaatttaattacaaaaaaagtatgaagtaaataataataaaggtggtaaagctgtagagaaaatcataaagttggtctagaaatgtctggggtctggatgacataatactacagcaccatgcagcttcattctcagttactcccaggaaattagagtcacataacactgcagaaagaacaattcagaatcttagacccgggctttagccctggatgtgtccactcctaggaccccaaacatctctgtgacctccttgctggaggtaaatccaaccttcccagacgtgtgagaacactaggaacatcctgcacacatagaggggtttctctgtcacagagaaaataacaccaggtttgaggaccccagggactctctgtgtggtgctgacagacccaaggcccagacacagcagaggtccgtgctggggagagcgggtcgtcctgttatggaacaggggtccaaacaagcttgcttctcagagcatcttctggggaactgaatataaacagaaagggaagaggaggagggacaaaagagacagaaatgagaggggaggggatagaggattcctgaacagagaccgcacccatgacccacgtgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacaggtgaggggaggactccctcggagtggatgggaggagggagcacagagactggctagggtctcctggggaggacaaggctctgagaggagacagagggcttttgttgaagcctgaggaaacagaacaccagagagggacaggggtcacaacaggaaagtcacactaaactgggattgataaaaagggaggaaaatcaattgatcatgttttccaagttaatcatcatttgtcattaccatttgaaaaaaaagaaaaatgatagaaatcagaactgcattaggatgacactccaaataaaaatataacaaggaaactaaatgctgcccttactcaccaatcagaagttgaaaaataaccaccagatacactcattaactcatccacaagcatttgcaatcaattttagtcaatggcatacaacaagcatcagacaagtctcagtcatcacagagcttatgctgtcatgaagaggaaaacacacacacaaagagatatagaatgtgaggtcaggtgttgacaagagccctggaaggaacagagcagggaaaggtcagaaagaaaagacccagggtctgtagagggggtgtcagggaagggatctcccaagaatgccctgatgtgagcaggacctgaggccagtggggagggagccatgcagacccctggggaagagcattccacacagggaaatgccaaggtcaaaggtgctgaaggaatgggggtgtcacactgctgactttgactcagtaggacacacacacacacacacacacacacacacacacacagctccaacgtggaggggtgaagagacctgctcaggacccagggccctgtttttccaccctaatgcataggtcccaatattgaccgatgctctctcctctctcctagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtataccgtgagtatttccacatgacctctgggtgttgggggtcagttctacttcccacatacgggattgtcaggcctgggttgtgcctgtggccctctctgcattacatcctgtatcagggtttggacatttagtgcaggacacacacgggggagacaaacttccacagatcagaattcctttcctggatccagaccctgcagacactcgctgcagaggaaggacagtctgatggggggactcagcagggcgaggtcagtgtcagacaagcaccccatggtctccccatggacctgaccctgagaaagaccctggagaactggatcagggcctggcctgaggggtccccctagggacccctcagagagaagctcaactcttccctgaactgagcccctgtacaaagccctgtccctggttcctgattccaggtgatcctggggagtctgtgccagggctgtgtggtggcctcttgggcagggctggctgggagcaaggatgtgagctatccaagggccatgactcctggagttggtcaccagccaggtccgagcacccagagcctcatctagctgaggatagggcctcctccttcacttgaggctcagcatggaaaggacagatggaaaaaattactagtgcatgagcccactgccctgggggacacaggttactccctgggaagttcagagtccccaaggggaggaacagagaagagaggatgctcctggcagctccatgtccaccagggatcaggcccagggccctctgtcttggaagcaaataatcatagataactgttcacttgggcagctcctctgtgcagagctgagatcaagtaattgtaaatattttgaggttaactcacaaacaacctcacagccaaatagcacttatcctacttatagaaaggaaattgagggacagggagacagtcactaacaagggtcacacaggccataggtggcagattagagacatatgaggtctgtctgcagccacagccccctcctctcctcaaccgggggtgatggggctgtttgttgttaggcatctgcatctgaggccagtcatgggttcacttccttttgtcttgtgcatccgcagctcagaagtggagattctggtctggaaagtaagaagcaaacagagaattaatcagttttactctagaactaaatcacctgcctcaaataacagagtcagtgctgggattgtccaggcctctcccttcgatccacagtcccctcactgcacctgaaatcctgtttcccgatgtgtgggtgtcactcccatgggaggataaaagagaggactttgctttctctccccactcacaccctgcaccagcacaggcccaaagtgagacacacgctcgctcaggagttctctcttgaaaaagggaagaaaggaagaaggaatgaaaaaaggatccataacctctttagagaccggctcctggatgcagaatcctatgaggttctggccacacctgtttcttgtccctcaggggctgacacccatgttccatccctctgaacccctgtccctaaacctaccccatctcatgtgactctggggttccttggtcattagagggttttcaggtctccctggtcctggtctggggcagccaagaggctcctggtccctggggtctctgaggtcactgtatcccccactgctcactgccatgggtatctctggctctttctgctcctctctgtccctcattttcctcccctttcattctagctgggatgccctgccctgcacagcttcctccacccttaggccttccccagaaaacccctctaacaaggctggctgtcctgttcccttcctgctcacactgtgtcctggcccacatcccaggcaacagagaaggcacagaaatcagccggagcagccgcccctgccgggctccatcacgagccaatgtccccaagtcaacaggagaatgagcttccactgtgtccccatccagggctctttcccccagtgaggccgacatgtggaacaggccacgggacagggacaagcgactcctccatacagtctctactgactcaccaggcagtcagaggcaggatgacaggtctgctttccccaaggcccagaggctaatttcatccattgacttccgtcctcatcttggtgtgaggctcacatcctccagtcattccccaggaccttccccaggtggagccggccaggcaggtgctgtctgatgggtttgctgcccattccacatacactactgtgtcctcatgatgatgccattgtcataaggtggggtcccttggactgagaagtgcaccagccactggagtctcacatagactctgcccagtttagatgaacttaaactctcattgtgttttctcaggttaacaggagaggaagaaagcatttcacatgactgtttggggctccttccctatttgcctaactgcacaggaattaggggcagggagctctttctaaatttactaacataacacacgttgcttctaatttggcatcgttccttcctttatgtaactgacacacacctaagacttcctctcctactggttctatcctcctaagaggactcatatgcctctctctactcaaggagttgctaatttcaaaccaacttcagcatcttcatttgacgacaatatgatcctgctggaattcacagcacacctaaaccttagtatgttatcaagaaaaatactacttccagcccttgatctttgatctttaggacattagtaacgatctccacttatggaaaaaattaaatgtttcccccaaagttcttttattttttactatattcagaacataacatgaggtctaaactcctgacaaacttttcaaagcaaattacaacactacaggtcaagcatcccacatccaataatccaaaatctgaaatgctcccaaatctaacactttttgaccactaaagtgatgctgaaaagaaatgctcactggagcattttagattctgggttttcaaaattagggtgctaaacgggtaagtctactgcaaatattcaaaaatccagaaacagtcagaaatccaaaacacttttggtcctaagccttatgcgtaagtgatactcaatccgtatgaactataggtaccaagctgtacagcaaatctctagaacctcatcctgtgtataactgaaagcgcacacccattgactaactccccattctgcctctcccaatccctggcaaccatgattctactctgattccatgagtgtgactactctagggacctcatataagtggaaccctacagtatctgtcctgtgagtgacttattgcatttagcataatgtccaatgggagaaaatatttgcaaaacttctcctcaaatttctgtctcatatctgtcaaacacacatggtccttgagagtcagatttgcagcatttcatgctccccctttccaccactcagctgtgcatttgcaaacatccacatgtgtttatggagagagccacagggtcctcacctgccctccgcagagggagaagaaacattaaaggccaaagaaaaggaacacggttctgctgggaaattcaggcagctcctgcctgtccccctcactgtcttctagatcattctctgaattctgctctatctgtaggtgtcacaggctcaagtcagtcattattaaacacctgggaaaaactgccccacctgtggttccactgcctgatgaccgaactgacctccaggcttgcccctggtgtcccctgtgttatttctgctgaaagatccaatcccaggccaggctgcacagtatccttggggtttaaggacaataagaagtcccatcatcacccatctctagaatgtccttagaaaaggaagccacacagaaaatacagctaggggggcaaagtaggactaaagcttgaaaagacccagcacctgaatgtttcaggtgaggactccaagggaagccaggcaggcagctggtcagggagaaaccaggagaagcacaaggggctgtgaccccgggtcctgtgtctgtccatgacccaatgctgctgctcaattcacacttgagaaagactgtgcttctcccacacagagcaggtgatctcacacaatctcagccctcaaatcatcgtgcatctgttgtgtgacacacacacctgccaggggcttttaaggactcaagggggctgagaggtgagagatgccaactctgattgaaagatgcctgtggaggaatcaaaggtgccacacagggcaatcttctctctgttttctgcacagcggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctgtgagtatcttctgttcctctgtggcccaggctgccagcccaaatccacacagccagagtccaggtctctcagtccctctcaggtctaaggactcagaccctcacccaggctggccatgacttcctgccctgagcaaacctgggcagaccaggccttgaccaagaatgggaggggaggggctgtctcctgtgctacttctgctcaaacacccattcccatcatcactcatctccaggatgtccttaaggctcagggttcacattttctgatgggagaaacaggtgaatgtctcagactttggctcaggggacatagcgggggtttggttgagacttcagggttgtgacatggctcagggggacaccgtggcccttccacagaccaggaacttatgcttccctctgacaacatcacctgtggctttattctctttcctccagatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggtaagtggatccatgaagcactagcatcacattttcaggtggagtctggctctcagagaagagccaggaagaaattttctttcccaacctgtgtccaaggggcacacgcaaatcccaaattctcccctgaaccctcccaattcacctctgcagactcttttccccttgtttttttgttttttgttgttttttgttttttgatttctcatgtctgactttgggtccatcctggaatgagaggagggggctccctcagcactgagccctgtgtagtgaaaggggcttcacagagaaaaaaggaggaagggtcctcagggtcaagttcctgctctctgtcaccaacaattccctttctgtcacttctttgtgttcttttacctactccataagctacaagggacaaggaggttttgaaatgagctcacactttttccttaaatgagaagaggaagccccttgggtgatggaggagcagctcagactctgcccccatctctgctcccagcacccccagtgactgactgaccccaccctgaagccacctaaggtggaaccagggcatatggagaaggtgcccaggtgtctgtcctgaatcaggctaaatcaagatgctaatcaacaccaaagcctcccctggatcaggccgcaggaaaatgggaagacatggagcctcatgacagactgctgagctgtgtcctggctctgaagtcactggctgtataagactgtgggcacagcacatgggacacagcacagaggacagcaagtgacgcacacttggagacatagggagattcagccatggggactctgcatggcagggaaggggcagtgccaaaaagtgtgtatttatagagaggataagactaccagccactatgtatctaatataggacttaccttttcaacccttccacgtgtgcaggtccgtagtattaaacacattcccgttgttctgctaccatcaccaccacccacccacagaactctcttcttcctcccaaaatgaaactctgttcccatcaaactcctgggcagagctgcccacctgtgacccacagcctgacccctgaactcacctctagacttgcttctggtctcccgctcaaacccccatccccatcatcacccatctccaggatgtccttaaatagcaaagcctcagaaaaaacacaccttggctgggtggtgtgggactgtgcagctgaaagaaacagcacctgcatgttccaggtgagtaccccaaaagaccaggcagtcagccagtcagggaagaaacaggagaggtgccagaggctgtggctgtcagtcctgtatctgcccaagactcaatgcttctgccctattcacatttgagaaagtctgtacttctcccacacaaagcaggtggcctcgatctccgagccctcagatcgttgtgcatccgtcttctgacacacacacctgccctgggctcttaaggacttgggtggactgaggggtgggagatgccaactctgattgaacgatgcctgcagaggaatcaaaggtgccacacagggcaatcttctctctgttttctgcacagcggagctgcccaagccctcggtcactagcaacaactccaaccctgtagagttttctacatataagtttaagttatctgtgaacagagataattttacttctttccgatttggatgtctgtttatttgtttgtttgctgcctaatttctccagctaggacttaaaatactatgttgaagagaagtggggcaagcaggcatccttgtcttgctcctggtcttacagggaaagctttcagtctttctccattgagtatccctctattatgttgaggtggtttccttccattcacagagtgtttttatttataaaagaatgttgaattttgtcaaatgcttttattggctaaatcttattactaattataggtctattcagatttttttgtgtgttccaggaatttgtccgtttcatctaggttatccaatttgttggcatacaattatttaccgcactcttttaatctttattatttctgtagaattggtagcaatgtcatcaatttttttgagagtaggtctcactctgtaacccaacccaagctggagtgcagtggcttgatcatagcttacttgcaggctgaaccccctgggctcaagtgatcctcctacctcagcctcctgagtagctgggactacaggcatatgccatcatgcctggctagtttaaaaaaaaaaaaatgtggagactgtgtcgccctatgttgcataggctggtcatgactttctggcctcaagcaaccctcatcctctgacctaccagggtgctggaattaaaggtgtgagccaccatgcccccattttcatttctgattttagtaatctgaatcttctctttttttctcagtcaacctagtaaatgattgtcaattttgttgatctgttttgaagaaccaacttttggtttcattgactccctttattgtttttatagcctccattttatttatttcagttataattcttattgtttccttcattcactatctttgggttgattttgttctttttctatatcctgaatttgtaaagttaggttgttgatttgaggtctctctttaatgtaagtatttaccactatcaatttcttgcacaagattcttaacttctctgagccttcaattcttcaactgaaaattgcaataattctcatcactaagaaatgggtggaaaaaatgaaaattgaaataacaatgcctgtttcatagtatcgttttgaagatttaatgtaacatttgattaagccttcagcaaaatgccacacacaaagaaaagcttcacaaatattagctattattattactactgttaccattaaccttaaagtcaggtagtcctagagtcaaattctaaatccacttgtcactaaccatgtgactttggataagttttctcatcaccctaagcctctgtcttttcatctgtaaaatggaaataatgtctacccaagagagttactgtataaatcaaatgagatacaggtaaagtatttagcacagggcctggtatctaggacatgcccctcaacagtagctaacctagcattaaccatcgcactgagatgactggtgagggctaagcaccaaatggaaactcactaggacatggttactggctaaacatgggagagaggaaaaacagtgcaaagaatcaagcctggtatgttagctttcatccactgagatgcagccaagatgggattagaggtacaagataattcactgggtaaaacagccatgagggaaggtggagcagcagtgacaggagagcctaagagagccctcagaccacgatgcagatctcattcctgagaaggagaaagagaaggagggaagttttacatagcagtgcagttctgagtttccccaagaccgatggggagtccttgaacccctcacccatgagagtgaagcagggtctcacagacctgggcttgctttctttcccctggtgggagcccatgggaagtgagttctctgtgcaaagaacatagtaaattcagaatgcactagcctgggccttctgtccatcaagtccctgccatagagctccaacaggctcttattcatggctgccacaattgagacactgagaaaaagatgcaaacataaaaatatagaaagttctaatgacatgcaaaaatagcaatcagactttctcaaattttcaaagccttcaaaaatgtctgagtgcagaaagaacaggatgaaattgacagaagactgatcaccaacctagaaacgtggtaagagagaaaaaaaattgcaactttcccacaaaactagtgtattccttgaaggaacaagtcaagcctacttcatgttgacagctagttcttggggaccccactgtagaataacatcaccttcattccttctctcttcttcccacaaggaagtgctcctgtcctctcagctgtggccaccgtcggcatcacgattggagtgctggccagggtggctctgatatagcagccctggtgtattttcgatatttcaggaagactggcaggtatgatcgcctttcctcttgccatgtttcctgcagggctgaccaccatgcttgggaaaggaaaaaaacttcttcacctgtatctgggactggatctccttctaccgctaaactcctgcttctcagcactaattcctgcaggtctcttcttccctggtcttcatgctccctgtaccccactgtctcctagatataattatccccagcctctgctcatttgtttcctagagtcaatacattgtcaaagcctcttcgtcctttttcaacatctctcacttttgtcagtctctccattcccatcaacctcaataattgttcaacatcctgcttgaccccttgttgtaaggttggaatccttcttgcatatgactgcctcattatcttcctaaaatctagttcactcacctacttaaggagccaaagggggccaggcacagtggcttatgcctgtaatcccagccccttgggaggccgaggtgggcggatcatgaggtcaggagatacagaccatcctggataacacagtgaaaccccgtctctagtaaaaatacaaaaaattattcaggcatggtggcgagcacctgtagtcccagctactcgggaggctgaggcaggagaatggcgtgaacctgggaggtggagcttgcagtgagccgagatcgtgccactgcactccagcctgggcgacagtgcaagactccgtctcaaaaaaaaaaaaaaaaaaaaagaagccaaaggaacctgctctggcctactagttaagttcaaatttcttctctttactaattcttcttacttcctttccctctacttcccagtataattcctccatcttaattagaatctgactctctacacatccctgcccctttaccccggatgcacatagaattcttagtttcaatgttacacctaaaaacagggtgatctcccctccactacctgccctgtggacttactcacacccttcatcacaagcaacctcttatttcatggagaacacagactgtgtagtattaatatgtgaactttggacacatcctgcatgtggctgagaaccttttcctgacaatcaattcatgtgttcataacagatacagaaatgaagaaggcaaggtccctacccccagggaacataaagcccaagacaggagataagacctgaaaaataatcatgataccaaagtagaaaggagcgaatgccacaaaaattcagataaatctgatgggaaatatagctacacattggaatcactccgaaacatttttaaaaacggatgctcaagccccaaccataaattctgatctactgatctggagtgggacccaggcattggtaatttttaagcctctccagacgctactaatgtgtagccacgatggaggatccctgttctaataggtaggacttggggctaaacccatggtttttagctaggaggattagaattacctctggagctttttcaacatacatgggcctatactttgttggcctaattcattaatgggctccaccaagaactcagtaatctaactgagaaacagaaactaaaaggaaaagccgccttatttgatatgttacattatatgggaagcactgtcaaatgataagtgatgctaaaccttctctaagttatatttatggttatgttattgatgtgagtgttccaaaaattataagagattcccagaaatctaacagattataagccataatgtcatatgccacagaagtaactaaatgtctatgggagatgcattctttttttatttttatttttatttatttttatttttttttattgatcattcttgggtgtttctcgcagagggggatttggcagggtcataggacaatagtggagggaaggtcagcagataaacaagtgaacaaagaaacaagtgaacaaaggtctctggttttcctaggcagaggaccctgcggccttccgcagtgtttgtgtccctgggtacttgagattagggagtggtgatgactcttaacgagcatgctgccttcaaggatctgtttaacaaagcacatcttgtaccgcccttaatccatttaaccctgagtggacacagcacatgtttcagagagcacaagtttgggggtaaggtcacagttcaacaggatcccaaggcagaagaatttttcttagtacagaacaaaatgaaaagtctcccatgtctacttctttctacacagacacggcaaccatccgatttctcaatcttttccccacctttcccccttttctattccacaaaactgccattgtcatcatggcccgttctcaatgagctgttgggtacacctcccagacggggtggtggccaggcagaggggctcctcacttcccagtaggggcggctgggcagaggcgcccctcacctcccggacggggcggctggccgggcggggggctgacccccccacctccctcccggacggggcggctggccgggcagaggggctcctcacttcccagtaggggcggccgggcagaggcgcccctcacctgggagatgcattcttatcataatgaactctcatcagatgtttaaccatactcattttcaatctttgtcattcactgacaattgttttttgttttgttttgtttggtgggggggttgttttttgtttttgtttttgttttgagatggagtttcactagttgcccaggctgaagtgcaatggcgtgatttcggctcaccgcaacctctgcctcctgggttcaagcgattctcctgcctcagccccctgcacagctgggattacaggcatgcgtcaccatgcccggctaattttgtatttttagtagagacggggtttctccatggtgataaggctggtctcgaactcctgacttcaggtgatccacccgcctcagcctcccaaagtgctcggattacaggcatgaaccaccgcgcccagccccgacaattattttgattcttccttccttaaagcatttgcaatcagctaccatccaaaattgcttcttcattgaggatatttacagaaaatactccgacatgtactcttgaatacaagtttctgataacattaaaatcataccattagactatttaagaatttccaaaattttaacaaactgatagcttcatgaaactgccaaccaagagcaagcagagaattcatttcatgagactaaaagataataatgaaaataatatttttatgattttttatttgaaattttgtggattctttgttttgtttcccagatttcaggaaacattttttctttcaagctatctagagcttcaacaattttgcgaacaaaaattgaaacatctatattttctccctacctgactgctccagaattcggaaattattcatgaatatttatatgtttataataatatcgttatttgcacaaaaaatatagttattaatattgttataaaataattattattgataaacaattatttgatgatcattatttaataatttattaatatttattaataaattaataattattatttaacgactaattgtaattgttaattaatattaatattatataataaatataatagtatagttatttgctcaataaaaatctgctccctttataacaggatacatttgaaaacactggttatattacccaggctttgattgggatgttatatttgggaatatacatagatgaacccataggcactgctggcaaagtctgaagtcggccttggtttggcttcctcatgtcaagaggtttctaaaagtttaatctgagattccttataaaaacttcctgtaaaacaaacttgaaaagaccccaggctgggcacagtagctcacgtcgataatcccagcactttgggaggccgaggtgggtgaatcatgagatcaggagttcaagaccagcctggccaacatggcaaaacctcgtctctgctaaaaatccaaaaaaaaaaaaaaaaaaaaagctaggtgtggtggcgggctcctgtaatcccagttactcgggaggctgaggcaggagaatcacttaaacctgggaggtagaggctgcagtgagctgcgctccagcctgggagtgcatacataggcctatactattcatgtgcgtacatgggcctatactattcatgtgcatacatagggctatacataggcctatactcctattcaaggagaatcgcttgaacttgggaggtggaggttgcagtgagctgcactccaacctgggcaacagggcaagactctgtctcaaaaggaaaaaaaaaagactatgtggtcacctgctactcttgttgcacttatataaagaatgaggccaagttcgatgagactaaacttatttggaaaacaaatatgtcttactgggattatctttggtagaaataaagatgcctatgaagagaaaaattatgttgaaaaaaactatagtacacctgttatgacatcacagctctgcttattgttttttattttcattatccacctatagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaatttgttgtaattctgtctcttgatgtgggttcacagccagccacggccagtggagtctctcaggcggcgtcattctcactccgaccctcctgccttcctctttcacttacaagggcccttctgaatacactgagctcgcccagattatccagaataacctcccatctcaagatccttaactttacttatttgcaaagtatttttgccaaataatgtaacatgcacatgttccagggattaggatgtggacatttttaggaggtcattattctgcctaacacaagtaactttcataaacatcacccacaacaaaaatttgctttgccttccttctgtgtctcacctttctgcctgaatcacaggccagagcacaaacttcaaggtgaaacacaccagctctgctgtgaactgcctggatgatcctggaccactcacttcacctcccacagtctcttctcatttgcagcacaaggatgacacttactgcatcagaaaatgacagtgcaagagtaaattaagatactaaacacagagcgtggtacctgatgagccctcggtaaacattcctttcagtctcttcctttcaacatcctgtttctttcaccctcacc

SEQ ID NO: 13463 - DNA, 15148 bp, Human
agctccgttgcataaatacatgcctgctttgccttatgtccatcaaaactctgctttatataaattttacctaagcttcactcttcccaaaatcctatattcaccctgtctcttcctttggtcaggcactccagagttcctctggagagctttaaaaaaaaaaattaaattcaatgaaatgacttaaatgaattaagtgtaaatgattcagaactggtattagaaattattaaaagtgggggccaggcacggtggctcacacctgtaatcccagcattttgggaggccaacgcaggtggatcacctgaggtcaggagttcgagaccagcctggccaacgtggtgaaaacccgtctctataaaaatacaaaaattagccaggtgtggtggcaggcacctgtaatcccagctacctgggagcctgaggccggagaatcgcttgaacccgggaggtggaggttgcagtgaaccaagatcacatcattgcactcccgcctgggcgacaaagcgagactccaactcaaaaaaaattaaataataattacttaaattataaaaagtgaatataaattacccaagtacctggagatttccagttagacatgcatatattacccactttgaatacatatggaaatatgtatgtgttggttctggaaaaacaattgagataatgaaaatattttctcaagttttagaaacagtatgagataggtttcaacaacattctacatgaatgtaaaaccttgatttaaatatatgatcttatgctagaagcatggttggttttaatttttctaacagatacgagtcttggcttattaataattaacacattttgcagccacagtatcagtgtggggtaaaattctaatatttgctcttatgttttaaattctcagtctttccaacataagaaaatagctacacacatttcagtgtttcctttttgcaacaagttaacataattttattggaccacgttatttagttgttgggccttgtaaggattaaatgagatcatgcatgtaacactacagtaacagccacatgataaatgtccaaataatatttacctgtgcctggcacagagcaggcactcaaaaaatattttttagagcatgtgacgcgccatgaaccagaggagccactttaaatggacaaacggggatctcattttttttttttttttttaatggtgagacaagccctgagaaggcaaatggactgcctaaagctacacaggtcagcggggcaggtaaatctaaattggcaaagtaagggctgagcgaacagactccgacactagaaggcagagctgaactaacttctgctaaggtcccgcctctgccgctttgtcccgcccttatcttctcccctcctccagcgcctcattcccttttcgctcgccccggccgtgctgaagcaacttccgccctgagaagggtggggcttccgtctcccgctctcgcgactcctggcggtgaaggacggaagatgatagccacatttcttcctcgcccttcccctaggttccctgtcacagttccgcccttactactcccacttccggccagggaacagccacttccacccggaaaaggggttgttccgccgtggggcgccagctgtggcccacccatcctgccccgtactttcgccatcatagtattctccaccactgttccttccagccacgaacgacgcaaacgaagccaagttcccccagctccgaacaggagctctctatcctctctctattacactccgggagaaggaaacgcgggaggaaacccaggcctccacgcgcgaccccttggccctcccctttacctctccacccctcactagacaccctcccctctaggcggggacgaactttcgccctgagagaggcggagcctcagcgtctaccctcgctctcgcgagctttcggaactctcgcgagaccctacgcccgacttgtgcgcccgggaaaccccgtcgttccctttcccctggctggcagcgcggaggccgcacggtaagcgggggctccgagctggaccgggcgcgaggcggcagggccggacgccgaagcctcagagcgcgtgcctgagggccccgaggcgcccggcgcgggcccgtcccgccccctagagccgcggccacgtgcgagcggcaggcccggacatgcccggtcagcgccgtccgggaaccgagcgtgggccccggggggcagcggcggggtgcgtggggcgtccggagtcccggggctggggagtggggtcgcgcaggatcctcacacgcaggggccgggctctgttagtgcgatccagagaggccgtgggcgtcggtgagctccttcagacccgcaggagccggagcccggcgttgaaggggccgtgggaagtaacggggggtaccacggtttaggatgcgctggagcgaaaggattggggtggggtccgtgctcttggcagtcgtctctgccaggcctgtgttcacatgcttgactttctccctcagatgcctggagttactgtaaaagacgtgaaccagcaggagttcgtcagagctctggcagccttcctcaaaaagtgagtttggggactgaggttcaaaacgggtggaggctgtcgccttggcctgcccatctgagccccagtgtttgccggtccctggcaggcgaggcttgtttggggcctccgtggctcctttcagcgtgaggcctggcttgtgttccggttccagcctctctttgtactctgggcacagcatagttgtgttgaggggagggcatttgggatatggggtagtttgtggagatgactgaatcgtgcttttcccactgttttggtcttaggtccgggaagctgaaagtccccgaatgggtggataccgtcaagctggccaagcacaaagagcttgctccctacgatgagaactggttctacacgcgagctggtgaggaacttaggtctttggctggagagtggggagctgggtgacccctggcacaaaccatacttccctgtctcctctgagctctttcccgccccaagagggagagaaacccttggttgtgtcaccacttgctttgtgtgatgtgacattcgataacttggtactccaagtttttatgacattctaagagctttgtgagaggaggacctgtggctttgagcctcaggggaaaccagagacagatgaatgttcatattttgcttacaggtggtttaatcctttctatatacacggaggcagactccctgggtttggatccatcttttacatctggctgtgtgtcctctggcaagttggttaacctgcctgtgcactctctcatccccaaaatgggactaattattgtaccagtactagagtattgcaaggattgaatgaatttaaagcagagtgtttagaacgtgtctgttgcacagtagttattcaggaaaaagccagttgtctttactattgctcagatcatcaagttagccttctccatatctctaacaggctgtttctaactaaatggttggagatctggccaggtcagtccctgctttaaatcttgacttctgatcttatggacaccctgcaacctcgtgccagccccgtctcttttcgatcttccaataataatttacgtacagtccctgactagtgttagttctcacgtgtcttaatatttcagtactcactaaatcttcactttcaggaagatgtaacagggtgggcggtggcagtgccgtgttatgtcaaggtgacagccttagcaccgaccttcactaataaggggcctcggcctctccaatcttaaaccttctctctctgtgaagtggggactccatcctgaccacaacttgtctccagataagaagtaggtgggaagcagggtttggaaatcggcaaaactcctccatgaccctgaaaagagttggccttggtacaggttgcttggcccttcagaatatgaagcattttgtagatttgtggtacacttgtgcctcaaatgtctattggggcccactctttcaggccatggagtgagcacagaggaccagcataactcagccgcggcctctgaggactgaaagatgaacttgctgaggtgggtcgggttgctggcataccacctacccaccgtttgttttagacagaaaatggggcggatgaagagaagctgacttccctgggcgcacagcagtgacaagccctggaagttacatatctcctccacctgtccccccatcttgctttggcagtgcctcaagggtcagttggtcagagcagctttggatctgggattagcctttctcatttgctggggtgaagacacgttctgcacataccaaatacctccaaagtaggactgtatgtgtcttgtacatttttttttttttttttaacatggggagggattaacaagagatggcattaagaccttggataataaacctagttgcatctgctggtcatggtagagctgctgtggtcccttgcagcccacagtggccctgcctggaaacctcaagcaggatgtgcatcttctgcctgcctactgatctccatcacttggagtaccccaaaggcctctttttcacctcacttgcccagctgtcctagcggcataggatggttgtgtggtagaccagaggcctgttgtgtatatttttgttgggttatagccacccctgtgtatctacatgcacaagggcagagttgtagttgtggcagaagctgtagcctacaaagcctgaaatatttcctacctgaccctttattatttattttcagggacagggtctaggcctgtcacccaggttggagtgcagtggcacaattatagctcactgcagcttcttgggctcaagtgatcctcctgccccaccctcctaagtagctgggactacaggtgcctatcagtcaccatgcctagctaattttttttatttgtagagatggagtctcactatgttgaactcccaagctcaagcggtcctcccgcctcagccttccaaagcactgggattacaggcaaagttgaccagcctctattctagagtttaacatgttccacccagtttggcagtcagcttatactgatcatgggagtgatcttgttttaccaaagaggaagctgtggtgcagacgggcgaagggacttgctgcaagttaccctgggagggcttggcagggtggctctgtccaaaactaggttccctgctatattcccttttttctactcataagagtctggcctattttgcctcctcagatttgaggctaaagtgtgctaaagcagcgcccttgctgagcagggccaaattgtggagacctataggaatgagtgtgaggtagacaggtcttaatcctggggtttgggggtaaagaggcccatggtagaagatggggccctcttgagggtggtctggaaatggagcagagctgtaggagtaagcagtcccaaggcagtggtgtaggaggcagggcaaggtagaggaagaacccgcaaagacttgctctcactggacgttcaagggatggccgccatgggtctttatgaagggggtggtgcagtgtagccccggacaggcttttttttttttttttttttaaacagagttgcactgtcaccaggctggagtacactggtgccgtctcggctaactgcaacctctgcctgccgggttcaagcgattctcctacctcagcctcccaagtacctgggactacaggtgcccgccaccacgcccagctaatttttctatttttagtagagacgggttttcaccatgttggctgggatgctctcgatctcttgacctcgtgatccgcccgcctcggcctcccaaagtgctgggattacaggcatgagctcccgcacccagctggacaagcctcttgctgtcttaattctttaaaggacctgctgaagatggagatgtgggagtccagtttggtgtcctggtgtgcgtctgagagcagctgctgaattgggatgtctggaaacacttcttgtaggttggaggctgctccatctctggctcctgcatggggctgggcacccacttgtgctatgatagtagaaagaatgagatctgggaggcatcacagaagtgagttaagggatgaatcaaggtcaggagagtggtttcttacaagttcggcagagaagggtcagctagagtgtgctggggaagttcttccctgcctttgactcagtaggtcaggatgggaccaccggtctggactttgctgagctgtgatgactcctaaggagccgtgcttggttggtctgccccgtgctcagatccagagggaccctccctctcggtctagcaggaacacagctgccctcccttgaccatgaactcacagtagagtggagaggggtggcctcctttacagttccaggtagggggtgattcctggacaggggttcctgagaggagtgggttgccatcccaagaatgcacacagcagaggagcagaaggcctctagcatggaggaactggaggagaacccatttgtgacagcaacttgctcgcaattggccctcatgagtaccagctacggcggtctgcatttgtgcagctccacatcaaaagctggggctggaaccttggtctccagggggtgaggaaaaaggtcagtgttttaatagaacgcggtatttcaactcttagcattttccaatttgtgaagttaataacccttcctctcccttctagtgggtcagaaaaaaataattagcatgaactgggatagcaagggaggagcttgtaatatctgaccaaggttctccatgccaaaaggtttttatacagccttaagaaaaatttaagcctccattgaagaacctaataggcctttgggaggccaaggcaggcggatcacctgaggtcaagagtttgagaccatcctgaccaatgtggtgaaaccccgtctctactaaaaataaaaattagccaggcgtggtagcaggcgcctgtagtcccagctactggggaggctgagacagaagaattgcttgaaccccggaggcagaggttgcagtgagtctgagatcacaccactgcactccagcctgggcaacagagtgagactgtctcaaaaaaaaaaaaaagcacctaataggccttatgggagcttgttctctaccagtcactgtgctcaaggtttaagtaaagtgtctcctttagtaccgcagcacaaaccacctggaggataggtgggtcctgtgtccctcctgaggaggaacggtgtcaggattcaagctcctgtctgactgctctgggcgctagtcccaacccaacaagactgaggttgagtgtcccatttctggtgtacagccgctttgggcatctctgcgcttaggagtgtgtgccttattcttaaaaagcaagataacagaggcccggcgcggtggctcacacctgtaatcccagcactttcggaggccgaggcgggcggatcatgaggtcaagagatcgagaccatcctggctaacatggtgaaaccccatgtctactaaaaatacgaaaaaattagccgggcgtggtggcgggcgcctgtagtcccagttactgtagaggctgaggcaggagaatagcatgaacccgggaggcggagcttgcagtgagctgagatcacgccactgcactccagcctgggcgacagagtgagactccgtctttaaaaaaaaaaaaaaaaaaaaaaaggccgggcgcggtggctcatgcctgtaatcccagcactttgggaggccgaggcgggcggatcaggaggtcaggagtttgagaccagcctggccagcatggtgaaaccccatctctactaaaaatacaaaacattagccaggtgtggtggcgtgtgcctgtagtcccagctactcgggaggctgagacaggagaattgcttgaacctgggaggcggagctagcagtgagcccagatggcaccactgcactccaacctaggcaacagagaaagactccgtctcaaaaaaaaaataaagcaggataacaggaaaagctattctgcgttccccagtcctgggtactgtagttcaaatgggagagcaggtctccacccagagccccagggcacaaccagctacagggcccagagggatggcagcagctgctgggtatttgagctggtctgaaagggtggaggtttccagtgatgtcactctctggcaggattgtggggggtggcttacgccaggtgagtctgtctattggtcctggttatgggcacttattaccaggcagtggcgtagggggtagggcctggagtgaggtggggattttaaagtgagcagatgccagaggtagtgagccaacagcagggctgtgctcttggcccccagcagagcatggttgtatagtatcagctgaggattggttccaggatgaaccccaatacccaagtccacagatgctcacccttactataaaatggtgtaatatcggggccaggggccgggtgcggtggctcaaccctgtaatcccagcactttgggaggccaaggcaggtggattacgaggtcaggagattgagaccatcctcgctaacacggtgaaaccccgtctctactaaaaatacaaaaaaattagccaggcgtggtggcgggcccctgtagtcccagctactctggaggctgaggcaggagaatggagtgaacccggaaggcagagcttgcagtgaaccgagattgcgccactgcactccagcctgggcgacagagcgagagactccatctcagaaaaaaaaaatatcggggccagcacagtggcacacacctgtaatcccagcactttgggaggccaagatgggtggttcacttcactccaggagttcagccagagcaacatggcaaaaccgggtctcttcagaaattatctgggcgtggtggcttgcacctgtagtcccaactattcaggaggtcaaagctgcagtgagctgttaccactgcactccagcctgggtgacagaatgatgccctgtctccaaaaaaaaaaaaaagtataatatttgcatatatcctatgtagatgttttacttttgagacagagtctcactctgtcacccagtctggagtgcagtggcatgatcttggctaactgcaacctctgcctcccaggttcaagtgattctcctgccctgcctcagcctcccaggtagctggggttacagcgggtgtgccaccacacctggctaattttcttgtaatttcagtagagatggggtttcaccatgttggccaggctggtctcaaactcctgacctcaggtgattctcccgcctcagcctcccaaagtggtgggattacaggcgtgagccactgcgcccggcctgatcccatatattttaaatcatctgtagattacttatagattaatacaggccagacatggcacatacttatagtcccagctacttaggaggctgaggcaagaggattgcttaagcccaggagttcgaggctgcagtgagctatgatcacaccacagcactccagcctgggtgacagaatgaggccctttttttgtgttttaagaaaaaagaaaaagcactaatacggtgtaaataattgttacactgttttgaattgtagtttttttcccctaaatatttttgatccacccttggttgagtctgtggatatgaagggctggctgtatctggacctgatctcagggcaggagtgggctgggaacaagcggtgtgtaagaactgtttctgggcagaagcagcccaccccacacagactactgcctggcacttggcagttatggaagaacccccaattcccccacttgatctttagaactagaggaaagaaatcactagagcagactcagaccaacttgctgatctctgggtcccaggaacaaaccagactctgctctgagctccagagctaggcaggaccatgtgatggctgaaatctgggtgcttcctgcatgtgggccccggtgccatcacagtggcaggacagggcagttcctccagagctgtgtgacacggagccagtgagtaccctctggcacctcagtttcactctttaaaggagagtagcacttgacacacctgttgagtcctcagagtaacccggccctcaggtgaagaagggtggagagatcgaaaagcatttggcacagggcctggcagatgtgtgctccagttaatagaagcgtgcaagcgtttctggggaggctggtgtgtcgactggattttacggagctttttttgcaggcaaggaggctggctggggtggaccagggacttgcccaagccagccttccctgtgtctgcagaggggctggtacacattccaagcagggggcacccactgcacagagtgtctgccctgcccttgttatcctgagctctccagactgaggtggcccggagagtggcaataggtcccttcactcctgcttctctggggcccatggagatggtcacagctaggctccacccctacataacctcaggttcaattcaacagcagtgctgctgggatagtaaccactaaagaagttggccctggagatggtgggagtgcccacccagggtgcagggctgtttgtcaaggaagagctagccgggggggtgggtgaggagagggggctgtcagtttctgggtgttagtgtgtgttttcagtttcccttcttataaaacagtgagaattagctgtttacacacaaggaattgtttacctgagaccttgatcaagacccttaaatctccctctcacactacccccagcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatgggtaagcagggtagagggggctgcattgatggagtagccttgaggcccggtcatcaattccccaacgaatggtcctgcatagtctgcccagcccctcaggcccctcctatcagaggcaggcaggaggggattctgcagaaaagcaaacagcacggggcctcaccccgacctctctggctgactagcccaggctccaggagggtaatttagcgactatctgctttcattagcctgctcgttaacttttcccaattgatttttcggggcttttgatctaaatgcttgcacaaacaacaccccgtcagctcccaggggggctcccactactgcccccagctcgttagaatgcacctgactagggccctcagtgggacttggctggcggcaggtggctttttgagaagcctggctcacagccaggagggaaggggctgagaacaggacctgtgctcactggggcctgcatgacccttccctccccacagcggccgcaaactgacacctcagggacaaagagatctggacagaatcgccggacaggtaaggcctgcgtttggggtggggctgggtcccttagtcgctgcccaagcatttccaaagcccatactttgtcaggtagacttatttccttctctggagggcacagcccagggtgctggtggggtcagaggagggctgcccagagacaggagaaaggacagtcctgtctgacttttcctgttggtgctgcttagaaatttggaggcaggctggctgtggtgtctcacccctgtaatcccagcactttgggatgccgaggcaggcgaattatctgaggtcaggagttcaagaccattctgaccaacatggagaaaccctgtctctactaaaaatacaaaattagccgggtgtggtggcacattcctgtaatctcagctactggggaggctgaggcacaaaaatcacttgaacccgggaggtggaggctgcggtgagccaagatcatgccattgcaccccagcctgggcaacaagagtgaaactccatctcaaaaaaaaaaaaattggagggaactccagcccaggtgccactgggcatctatccacagagcacatagctgtacccgtagatgactccccctccccaggtcagcctgcgatgtttccccttagtcctcatgcgtactgagcatcacatgggctgcttgggagaggtggagataagggaggggggctggttcagaacccaggtctccattcagatcctggctggccaacaccctggggcagagtggccacacccctggtgccacagtctcctgtcttggcctccctgtggccaaaatctacccttggccacctcaagcatggtagtgaggagtcagtgagctatagtacagcaggagcacccagggcctggcatgagctcaattctgtatcactgactcaggcctcctaggagccttggagcatttagtcagtcaagtgtcacaaaagaatggaaagtgtcagccctctaggagttgggggtggtctggaaggagaaagctcttccaggcagagtggggcttggcgcacacatcattgctggtggttggatgttggccttctcacatggcagtgggcggaatttggactccactccgccactcccttcttttttttttttttttttttttttttttttgagacagagtcttgctctgtcgcccaggctggagtgcagtggtgcaatgtcagctcactgcaacctctgccacctgggttcaagcaattctcctatctcagcttcccgagtagctgggactacaggcacacaccaccacacctggctagtttttatatttttagtagagacagggtttcaccatattggtcaggctggtctcgaactcttgacctcaggtgatccacctgcctcggccttccagagtgctgggattaaaggtgtgagccactgtgcctggccactcccttgagacccagtttccacgtctgtgaaatgggggaatacccacagtgagaattagatgagatagatgcatttgaaaccacaaatcggggtgcccacctgtggtgggtagttaggtagctgttacaaagtgccccagcagagacccccttgactaacttttattcttccatcttttcccacaggtggcagctgccaacaagaagcattagaacaaaccatgctgggttaataaattgcctcattcgtaatcctggtctgggtctcttttttgagtctcttgctctgtcgcccaggctggagtgcagtggcgccatctcagctcactgcaatctccgccttctgggttcaaatgattctcctgcctcagcctcccaaagtgctgggattacaagtgtgagccactgtgcctggtctggtttgggtctcttgattgttcttcaggggcatgaggaagaggcgcttcctcccttcccttgggtgagggggcccagggtgattgggtggctgtttacccggcagccagtcgggccttcccaggtcaaacagttcccatctgggtttggaggaaggacccaggggcccttgtggctcactcccccacatcctgtctttgcaattgtcagaaagtgagaaacgaaaggatggctgtgagctgtgacctcagctgggcctgggctgcagaggtggcttccgctggagtaaagcaagagggcccagggttcatgctcttccctggaaggtagaaaaggacagaccaccagggagcctccaccgcaaactgacctgtgctgcctacacactaactttcctgggcctggggcctgcacaggctgaatggtccttgagccttcactctgcatctgagcggtcttgggcccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtccctcccagttgggaagactaaactggtttggccaatatctcccaggattcccctgtccaaattattcctgggatctgacccatttcctggaaaggggcgagcctgggttttgaagttcaaactagagtttaaatcacaactctgcccctaatcccacgtaaccctgtgcaccttatcctctgagccttcgtctcctcgtgtgtaagcctgctaactcctgagagactggacaagatgccgtggagagccttggctctgagtagctctgctgctggacagttcagttggcagtccccaaacgtaaggcgtaagagtttaagaagtatcggccaggcacagtggctcacacctgtaatctcaacactttgggaggccgagacgggctgatcacctgaggttgggagcttgagaacagcctgaccaacatggagaaaccctgtctctaaaaataccaaaattagttgggcatggtggcgcgcacctgtaatcccagctactcaggaggctgaggcagaagaatcgctcgaaccccggaggcggaggttgcagtgggttgagatcgagcaattgcaatccagcctgggcaacagagcgagactccatttcaaaaaaagaatcaataaaaatgttaaaagcaccgttgtttacactcagcaactctgtgaagtaagtgccgaaaagtgctttggaggtaggtaaagtaagccataggctgggtaacttgccagatatcccacagctggagccatcatatgaacccaagcaacccagctgcatcctggacctagccactccaagggctctgtgcctcagaaaagaggcccaaagggttgcactctagctgcaggccagtcactccccattctgggctctagtttcctcttttggccattaatgaaaacatttcccagagctgacatgagaactcaatgccaagcgtccggtttgcacagcagcaggcattgcgcttcccaggtaggaagcaaggtctaggtgtcccgagcaggcctgcaatcccgcagccgcgccgctccagccactggggagcagtagagggcctagaaagaagctcagccaccgaaggctcttgaaggtgaattcctagggcttccaggtctggagccaggc

SEQ ID NO: 13464 - DNA, 31166 bp, Human
atagcctgaaataccatctatatagccagagagttccaaattgcctatgtccagcttgggtctctcttctgatttccagacttgtacagatctgggcagaaaccttagttatgcctgaatctttttcctcgcactcaaaccaaactatacgtaagttttgtccgtattactttcaaactacatccagaatctcatcacctccactactcctgctctggctggagccaccatcacctccctgttttcccccatactccccacaatcaacacagcagccaaattttgttaaaatgtattggggctgggcgtggtggctcatacctatatgagcactttgggaggaggattgcttgagcccaggagttcaagaccaacctgggtgacatcgtgagacgctgtctcaattttttttttttttgagacagagtcttgctttgtcgctcacgctggagtacaatggcacgatctcggcccactgcaacttctgcctcccaggttcaagtgattgtcctgcctcagcctcccgagtagctgggattacaggcgcccgccaccatgcctggctagtttttgtatttttagtagagacagggttttgccatgttggccaggctggtctcgaactcctgacctcaggtgagccacaagtcttggcctcccaaagtgtggggattacaggcgtgagccaccgcccccggcctcccgtctcaaacgttaaagagaaatattcttggagttaatctacttctgagagttatttagctaggaaaaggggatatttgctctataggtaagacttgccctaatcttttttttttttttttgacttgccctaatcttagggtatttacttgtgtggagagatgcagtgaggtagcggtggggatgtatttctcaacccagcgcaatgacattatcttcaatttgaggagtatttacgtgggtgaaagatccgccacagtccacagtatgcaaatagacaggtttgcttcagtccgggatgcaaggacctagagggtgtgtgtgtggggggtgggggtgggagggtggaggaggaatcgagttaagggggatatttaccctggcgaggtgattttccctattctgaaatatcaattcttgggcggacagtctgcccctcctctcattctcagagatagttacaaagatggaactatcttctcctttctagtcgtgagggagagatgtgtgtatccctgcgtatttagtagtattcaatcggacaagaaatcatgcatcaacgcaggagtgacatttaccagctggtatcgtgaggaggtgggcactcggttgcacagtacacggtagtccctctccaaaagaaagacctgggtgaagttcttaccttgcaggaaggaagcagagccatctggccgcgacagcaggttctgttcgcaggcaaagtgccggaggctgcagccaggaccccgagggctggaccctgttccattttcagcacggattttggcgtcagtatgcatctcctcctccatcgcgccgagcccacgtgcggctgcagttgtcacttccgcctggcagcgcgcgccgcaaacaggctgcgtaaccagtgcgcacgcgccgggctgggccatcctcctgggcgtccgcacgtggcttagcgtttaccaacaatctggctccgcccagtcccacctcctaactctggcaacgccattggacttttgggaacagaaggcaggccttggcattgatccgctttactctgggcccccgggccctaaatccctgaggccctggtcaggttgccctcttctttgcctgttacaggagtaactacaatgaggcgattggagaaaattttgggtagatagattttttttctccaaatctctgtgcattctatctaccacagaacgggaagaagatggttttcttgtcagatggtgctggagtttgcgtcaggcacatgaaggggcagccccgaatctagcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctgtgagtacctgggccccaggcggttttcccaaaggggattagggatgtaaaggctatcttcagagtgtggggtccctgaaggatatgaaggaagggctgtcacaaaagggaaaaagagtgggagactccttggagaagacaccgaagggaagatctgccacttccttaggagacgaaaagaacttccacttctttaggagaggaaaaaacccgtttgcaacttctttgtgggccctgagggagacgacttgaagagagagatgggggttccttattagctgccactggtattcaggggaggctccttggaggaacaggggaagatcgcaagaccttctccctcagggtttggagaatgaaactgactttgtaagggagggactttcttctgggcaaagatccctcttcaagaagaagaaagaagagaacaggtccctgtcacaggctgcatagggccttgtatttctttgctcctttgccacaattctgattttaaaatgaattgtgtaaaaaatttgtttgattcctgtgtctcttgatcgaatatcaagacagggaattcgtgtgttctggacactgtacagaggagacgattaatatttgttgaattaatgaggggaaaaaaggagggagagaggtacagacagggcactttgcccacatttcttagaaacacttgagaaggctttgtttcttgtcaaaagggtcacaatcccttcaggtggatgctgctaagggcaagattacactgcaaaaaacctaggtggaagcctatctttagacggggagaggcaatgggttgcagaagagctttgaactacagttgacagataggagagtagtggttacatgggtggatgcatgtccttgctctgccgctttccacttgtgtagccttggcaacggactgcacttctctggatctatggagctaattttcctctctaaaatattaacagtggccacctcatagggctgtgaaaaatcaatatgtaaaatgctaaggactggacctggcacatcctaagggcaataggaatgttgatagtgagggtggagggaagggacagaaactaaccttggagatggggagaagaaaggggtgaccttgggaaggcctggattggtgaggccctggggaaaaaaatctgaaaagatattgtgaggttgagtctgatcctctgatccccaatccataaggaggggaagatggaatctgtagaaagaagctctgggtaggggaacaaacgggaggagggtgaagaagatgggccaggagtaggacgtagtaggtatctaggaacggagtcacttgaaacaggtaaatacagaagggctgcaggagcaaggtgtgggtagggcagtctcttgcctttgggctggagaccttttcactttttttttttttttttttttgagcagttcatatcctccacagctgatctcagtcccaggggcccattggctgggcaagtggggcaggaggtgggcaggactggggcaggctagggaaaggtcatttatggctgattaaatctttctctcctgtctcaatctcttgattacctttcctcttgcttcccctacttcatttttggtggggagtggggagggaagaagtccctactttttatttatatatatttaaatttgtattatcttaagagttattgttttttcccctttatttctcccacttgttctttctctcttcttctttctttcctctccttctcctctcctctcctcccctctcctttttcttttcttttctttttccctttcctttcctttccttttctcttctcttttctctctctctttctttctgtacctctctttcctttttctttttttttcttttttgagacagagtttcactctctcgcctaggctggagtgcagcagcatgatcttgacttactgcaatctctgcctgccgagttcaagcaattctcctgcctcagcctccctagtagctgggattacaggcatgcactatcacgcctggctaatttttgtatttttggtagggacgaggtttcaccatgttgtccaggctggtctcgaacttctggcctcaagttccgcctgtcttggcctccaaaagcatgagccactgcgcctagccttttctttttttgagacaaggtctcactctgtcacccaggctggagtgagtgcagtggtgtgatcatggctcactgcagcctcaacctcctgggctcaagcaatccccccacctccacctcctaagtagctgggaccacaggcacgtgctactacgcctggctaatttttaatttttttttttttttttgagacggagtcttgctctgtcacccaagctggagtgcagtggcacgatctcggctcactgcaacctccacttcccaggttcaagtgattctcctgcctcagcctcccgaatagctgggactactggcgtgcgccaccatacccagttaatttttgtatttttagtagagatggggtttcaccatgttgaccaggctggtcttgaactcctgacctaaggtgatctgcccgcctcggcctcccaaagtgctgggattacaggcataagccactgcgcctggctgcgcctggctaatttttaaatctttgtagagatggggttttgccatgttttccaggctggtcttgaactcctggactcaagcgatcttcctgcctcagcctcccaaagtgcaggatgacaagcgtgagccaccttgcctggccatattattaaattatcatgagtttaagtttaagtagccacaagtgggctgggtgcggtggctcatgcctgtaatcccagcattttgagaggccaaggtgggcgggttgcctgaggccaggagttcaagaccagcctggccaacatggtgaaaccccatctctactaaaaatacaaaaaaattagctgggcgtaatggcgtgtgcctgtagtcccagctacttgggaggctgaggcagaagaatcgcttgaacctgggaggcggagattgcagtgagccgagatcgcaccactataccccagcctaggtgacagagcagccctctgtctcaaaataagatagccacaagtggttggtggctgccacattagatggtgcagggtttttgttttgttttgtttttttgttttttcgaggtggagttttgctctcattgcctaggctggagtgcaatggcatgatcttggctcaccacaacctcctcttcctgggttcaagcgattctcctgcctcagcctcccgagtagctgggattacaggcatgcaccaccatgcctggctaattttgtatttttagtagagacagggtttctccatgttgatcaggctggtcttgaactcccgacctcaggcgacccacccacctcggcctcccagagtgctgggattacaggtgtgagccaccatgcctggctaagatgatgcagttttatccaggtggagatgaagaaatagtcagggaaaggttgagaggctgcatattgtagacagattggattactgggttcactggggaagattggattagaaggaggagtggggctgctttacttgtccccgacttcttgcccctgctctgcccactccttcattgaataccctgctgccctgcagatgtgtttgcctgattttcacctcccttcctgtctctgttatcatagcagacgttttagtgctcagggaaaggaggaggaaggaaactcagattgtcaaggaattgtgagtcagtttctcagccactaccccaggcctgggcttggctaagtcatttcacctctctgaccctagctagtggggtgaatagagtccctaccctgttggaagtcaggaagcccctggagctcgctctgtgctaattatcggtgactatttctgtgacccagctcttcaggggcagcctgtctgggggttccagtgccctgtgcagtatctccaagtggtaggtactcagtgtatgtattagtccgttttcaggctgctaataaaaacacacccaagactgggtaatttataaagaaaaagaggcttaatggactcacagttccacatggctggggaagcctcacaaacatggcggaaggcgaatgaggagcaaagtcacatcttacatggtggcaggcagacagagtgcttgcaggggaactcccctttataaaaccatcagatctcgtgagacttattcagtataatgagaacagcacgtgaaagatccacccccataattcaattacctcccactggctccttcccacaacatgtgggaattatgggagctataattcaagatgagatttgagtggggacagagacaaaccatgtcagtgtgtattgtgggatgaatggagatggtcattacagtcttctaagtgtatgggtccatctcttacttgctagtgtgttaagaaacctggcctcctttttcacatcttgaggcactgaatggtttacaaatccaactctaattttttattatatttaatacaccaatagtgcaaggcctttattggtagtactctcctattacagatggagagactgaggctcagagaggtgaggtctgaacttggagctctggactccaaaacccagtttcttttcatggtaccaggctgccaggaggagaaaggatggagcttagattcaagtcttgcaacattcttcttagtccagtattggcttattttgttttatatttttttgagacggagtcttgctctgttacccaggctggagtgcagtggcgtgatttctgctcactgcaacctctgcctcctgggttaagcgattgtcctgcctccccctctcgagtagctgggactacaggtgtgtgccaccgtgtccggctaatttttatatttttaatagagacagggttttgccatgttggccaggctggtctcgaactcctggcctcaactgatccacccacctcagcctcccaaagtgctggggttacaggcgtgagccaccatgtgtggccgggcaggtgatttttcttgtctttcacctctttccacttcagtccccctggccatctttcccttccttgaatgtgcctcctcccacctggaggcctttgtaggtatgaggtccttcagatgatggctgacatgacacttcctcagagaagcgttccagaccccaaacaccaggtctctgtctgtgaaacagggacagtgatacctgcctaatctgcacgcctttcccttctcacgagatattctgggaagggggactcaactctttgctctgtttgagggcagagtgcctttgagctcaggagagagtgggtttgggtggccttagctaccctagatacggaggacttggagttaactggcaccatccacaaagccttgcatgcactggacctgaacaagttgcttagcccttgaggcggcgcctcagctaccacctgtctttgatggagttatgataacagtgcctgccccgtctggatgccttatgggttcagtgagcgcataggtgtaaataaagtgctttgagtggcacctcagcatgtagttattctctgattgacctatagcagccatgccagtcttcagggtcccagggcgccaggctttcttctcttgccttggagccttggtttttccctaggactgaagtgttctgaccccttggctgaactcccccttctttaggaagctttccctggtgtgccatctgatgctggtgcttcctggaggggtactatctgatcctagctggtgaggcattcctgccagagctgcggcaggtgctttccccgcctctccaccagcctgtgaggtggatgccatccccacgagggcacgcaggttcacagagactggctcctgtccaaggccgcgtggctggaaagagacagaaccagattcaaacaccagcagtttaaccctagagaccctcatcctacctcctatgtgggtaaccactatacatcctgcctcctctgaaatctcccgtttttttttattttaaaattttatgtgagtatttacttatttatttgctgctgttgttattgttttgagacagagtcttgctctgttttcacccaggctggagtgcagtggtgcgatcttggctcactgcaacctctgcctcctcggctcaagcgattctcgtgcctcagtctcccgagtagctgggactacagacatgcaccaccatgcctggctaatttttgtgtctttagtagagatggggtttcgccatattggccaggctggtcttgaactcctggcttcgagtgaactgcctgccctggcctcccaaagtattgagattataagcataagccactgtgcccggccaaaattttatttatttatttatttttttgagatgtagtcttgctctgtcacccaggctggagtgcagtggcacaatctcggctcactgcaagctctgcctcccaggttgacgccattctcctgcctcagcctcctgagtagctgggactacaggcgcccgccaccacgcccggctaattttttgtatttttagtagagatagggtttcaccttattagccaggatggtctcgatctcccgacctcatgatccgcccgcctcggtctcccaaagtgctgggattacaggcgtgagccaccacgcccagcctaattttatttattaatttatttgagatggagtctcactctgtcacccaggctggagtgcagtggtgcgatcttggctcactgcaacctccacctcccaggttcaagcgattctcctgcctcaacctcctgagtagctgggactataggtgcgtgccaccacgcctggctaatttttgtatttttagtagagatggggtttcaccatcgtgatcagcctgacaggctggtcatgaactcctgaccttaagtgattcacctgcctcagcctcccaaatctgctgggattacaggcatgagccaccgcacccagccatattatttctgtattttcatttggcttacctgtcaacttgacacttttttgtttttttaggctagtcaggtgaagcaatgtgagtaagatcacctgtcttgattataacttgtgtgttcagtgtttgtcattcatccctccctgtctctagccttcagttcagggcatgatttggagcaaatgttcagtatctgtttaacaagaacaatcatgagaaatacttactcactagttgtgtttatgaaacattatgtgccaggcactgggctgagcaatccacacaggtcaactcggttaatcctcatgacaacccctgagataagtacttataccaccctcggtgtacacaggaggaaactgaggctcagggagtttttctttaaaaattttttcttttttttttccttgagacaggtcttactttgtcacccaggctggagtgcagtggtgtgatcttggctcactgcagcctcttgggctccagcgatcctcccacctcagcccctcaagtagttggggagtacaggtgtgcaccaccatgcccagctaattttttgtagggatggggtcttgccatgttatccaggctggtcttgaactcctgggctcaagcgatcctccctccttggcctcccaaagtgctggtattacaagtgtgaaccaccacacctggccttaaattttatttatatatttatttttgtagagacgaggtctcactatgtttcccaggctggcctcgaactcctggactcaagtgatcctcttgcctcagcctccagagtagctagaattacaggcgtctgccactgcacttggctcagggagtttaagtcacataatcaggcagcggtctgctcagttagagtccatgcgcttagccatggtgccttcaagtgactccaccagggtcaccccagtacttcctgggcagaccagaccatccagagcgggcaggttgtgctttcctgcatggtgggagaggacgtggcatgaagctttgtgtaaatctgtgcagcctctgccattgtaaatcactggccaccgggacagactcccccacccccttccaaaaactagaggaacagatgggtggagtcgcatccttcctctgcaggcatttggccacccactcccattatggagcatttcctcaggaccaggcacagcgcggagccctttgcatagctcactgaattggggcagcaaccctggggctggggactaccattatctccaccagcccagcaaagaggggaggagggtacagccgagacccagctccagtatgtggagcacactggggtgccgtgaagatagctgtccagcctctagaggctgacagtcctgccctgacacagtggtttgttctcagactctggcctcccctcttagtgcccgtctgaagacttcagccttcggtcctcttccatcagcatgctgtctcccctgtgcctcagtttccctctctggagtatctgctggggccacagtttggttttattgttctttgagacagggtatcactttgttgcccaggctggagtgcaatggtgcagtcatggctcactgcagccttgacctcctgggctcaagccatcctctcacctcagcctcccgcaactccagtatctggactacatgtaaatgccaccattcccagctaatttttttttttttttttagatagagtctcactcttgtcacccaggctggagtgcaatggtgccatcttggctcactgcaacatccgcctcccaggttcaagccattctcctgcctcagcctcccaagtagctgggattacaggcacctaccatcatgcacggctgttttttgtatttttagtagagacagggtttcactatgttggccaggctggtcttgaactcctgacctcaggtgatctgcctgcctcggactcccaaagtgctgggattacaggcatgagccaccacgcccagccttcctggctaatttaaaaatttttcagagacgggggttttgcctaggctggactcactatgttgcctaggctgatctcgaaccactggccttaagtgatcctcccacctcagcctcccaaagtactgggattacaggcatgagccgctgcacatcgccacagtttgattttagtatccactttaaggtgcagttagttcttcccagctcctcttttccctatctcatacagtgtagtcacttccctttctcccacttctcaccttcctagattttgtttttctctctcttaccaagttttgagtatgtaatacgtcccagatcggtgctgaacccctggtgtgagttaacttagcaacttttcacgtggtgttctgcagccttcttacagataaggaaattcagagaggtgaagtgtttttgcagagagccacacaatgagctaagaaattagaacccagggcagttgaactccagagccagggaacttaaccgcccattcatgcattcactcaggaattccctcttgagtgcctgctgtgaaggcaacctggacgctctctctgccttcctgggattgtggtgtgtgtgggagacagacacgaaacaaagcaatcttctaggtcagtgtctggctatgctgggtactcagaagggtgaagcactgtgctgcaagaggccggctgtttcctcctcacaaggggaggcctgcagtgacattgccaggcctgaatctgccctgccattgggagtgtaatttcctcacgactacaaatgcaaataaatacacacactgaacatgctaccccgctagaactgtggacagcttgttcactgcagttaaaggaagacggagggacacatttgagcacgcatgtgtgagatccagcttgtggcaaaccctgccattctttaacatctgtgggaagtgaagccaccattactgacctcggaggaatcccgggagtagtgggaagaaaagttgcagatgtttgaaaatcaggctgcaggggcagttggggtgaggagcatggatgtctaggagcctgaatctcagcgttggaagcccagttctgatgtaatttttttttttttttttttgagacagggtctcactttgtcccccaggctggagtgcagtggcacagtctcagctcactacagcctcatccttccaggttcaagcagtcctcctgcctcagcctcccaagtagctgggaccacaggcatgtgtcaccatgcctttctaatgtttgtatttttttgtggagacagggtttctcactgttgcccaggctggtctcaaactcctgagctcatgtgatcctcctgccttggccttccaaagtgctaggattacaggcgtaagccactgcccagcatccagcatccccacctttttttttttttttttaaatttgtggtttggtgcaggttattttacctccccaggcctcggtttcctcatctactcaagggcaatggcagataatcaacctcacaaattccccgaggagttagtaggcttgtgcctgccaggctcagctggcttacagcaggtgcttcataagggggagctattgcaacgcctcggctggttctaggctgcctagctccagagctaagagtcccagtgggttcatatccctttgagcatttataggcttctcacaggtctcctgggctttctcagccattcctcatccgacctgaggaggtgtgatgtccttgcaggactcctccagcccctctgagcttttttttttgtttgagacagcatgttgctctgttgcccaggctggagtgcagtggtgtgatcatggcttactgcagcctccacctcctggggtcaagcgattctcccacctcagccttccaagtagctgggactataggtgtatgttaccatgcttgagtaatttttaaaattttttgtagagatgtgatctcaggctggtcttgaactcctgggctcacctgggctcaagtaatccttgagcccaaagtgttgggattacagatatgagccaccttgccaggccctgagctccttctgtcttccatgaaggacacactattccttgccttttgtctttttttgtgtgtgtggcagggtctctgttgcccaggctgggatgtgttggtgcaatctgggcttattgcaacctccgcttcccggattcaagtgattctcctgcctcagcctcttgagtagctgggattacaggtgtgcgcaaccacgcccagctaatttttgtatttttggtagacatggggtttcaccatgttggccaggctggtctcagcctcccgaagtgttgggattacaggcataagccactgtgcctggccactttttgtcttttgcatgttctatacaccttgccgagaatgtgctttccctgcctcctggttatccctcaggtttcagctctaacatcacttccccagggaagccttaccctcgctttcttctgctataggataatatgaaccaccatcattgttacttgtttagtgtctgccctccctgctaggcagcaaggacagatatcttgcctgtcttaggtccccagaacccagcacagggcttggaacatgtcaggtgctcaaatatttgttgaatgagtcagtctgggctcgcagagggagctgggaccagagtagagtggacactgaagcgtatgtagcagtttgccaggcgatagggaaagagaccttcttgtaaagcaagcagagatgagagggagaaatgagaattgctaagattgttttgagcatttgttaggtggcttacagatgctttgctgaacattttattcatgtgatcttgtttaagcctctcatttccatgaggggttctccatttttatagacaaggaaggggacacgtggagaggggaagttactttgccatatcaccctctaagggatttttttttttttttttttttttgagatggagtctcactgtcaccaggctagagtgctatggcgcaatctcggctcactgcaacccccacctcccgggttcaagtgattctcttgcctcagcctcctgagtagctgggactacaggcatgtgccaccacatccggctaatttttctatttttagtgggtacagggtttcgccatgttggccacattgatctcgaactcctgacctcaagtgagattcgcctgcctctgcctcctaaaggcagtaagggaattgaacctaggcagtctgactcttaagagctcaaagacttaagctctgtcctgagtagcttcgctggtgtatggtatagggatcagaagagagctggtctgtatgcctagagggcatcctgcagtgggcatgtgtgtctgtggtcacagtgggagagagagaggagggggcatctgtggccagaatggggaggcctcgaatgccaggatgaagagtttgggcctatggtaatgagaatagtaatagctaccagttattgacttgccagccacttgattgagtcatttaacctcacaacagtcctatgggataggtgttaactgttttcatcccagtttttcagatggggaaactgagacacagaagttgtagtcagttatccaaagtgtcgcagtgagaaagtgctggagttggggctcagaccctgtgagtcaggccccagagttcactggggccacatgctcaaccaccatgccgcctgcctgccgccggggctgagccagcggaaacctgggtgctgcttctgatgcaggtggtctcctctgctctcttccccagcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacgtgagaggcggcctcccccacttcccgtgccccccacgcccaggccccttgcctgtctcctctctggtcccaactgccccacgtctatctgtgcctccacccgcagctgccgaaggagaaggtgctgaagctctacaagagcatgacactgcttaacaccatggaccgcatcctctatgagtctcagcggcaggtgcgtggggacaggactaggggcggggggctggaattacctgaggtcccctacctgtgtttgggccaaaggaatggctcccaaggaggacagattcttttttgggggggttccatagagttctgagggttctcttgggactctggaggagaagtgtgagagcagtcctgccttagggcagaaggatggacctgatcactaaaaaacacctactgtgtgcctggctgggggctcgcctgtgtggggagagggcagggagaaggcctgacagcccttcctcttggaaatgcacagtcctgagaaacagggtgggtccccagtgcttcctggagtgctccaggggactgccctaggcccatgtgaaatgggctgtgatcccctgataaatcctagtatcagggacaaggatccagtcaagccagtgtcaacaaagagggaagttattgactccaatgaccatacatccagagggtcctgttttggggcacagctagatccagggggctcttccaggcaggaagtagagggaaggcggaaggccagacatggcacatcccagctatcccacacccccacctttatagagctttctgggtagtcccacctagtgacatctgcatacatttcctgggccactcctagctgcaggggagactgagaaatgtattaataatactttagtcccggcagttgctgcctgcgggagattgagacctctgttaacagaggaggggaatagtatactgggaaggcaaccaggagcctctgccagtagccccgagtcctgatcctcagggggctggttgcaggctcttacccacgctaacctggacagtcctgccaggccctcagtactcagcaccgcccactcacttggcactggaatgtgcattaacttttaattggctccccacttagaagaaagcacacattcatcagtttcccccacagcaatgggaaagccaggcctgggaacacatggaggagggcaccgccgagccgcgaggagctctggccccggggtgtccctcagggtgctggccaggctgcctttgttccgctttacacatggccctgtgtgatctcatgtccatctgtatgccagggctgcccagagccccagccagactgcttgtcagagccctgcttggcttctcgccctggatgtcccacagcaaactaatcctgtctgaacttgacctcgacatcttcctcccaggcgtgctcctttgcctcacctagtccgtttctcagtgaagagcaccaccatccacctgcttgcccacaccagaaacctcatctcatccctgtctcctccctcccccttgctatccctttctcccctctcattccctctgtctgtagatatttcttttttttttttttttttacttttgagatggagttttgctcttgttgcccaggctggagtgcaatggcatgatcttggctcaccgcctccctggttcaagcgattctcctgcctcagcctcccgagtagctgggattacaggcatgcgccaccacacctggctaattttgtatttttagtagagatggggtttctccatgttggtcagtctggtctcgaactccctacctcaggtgatctgcctgccttggcctcccaaaatggtaggattataggtgtgagccactgcacccagctgtagctacttcttttcttttatgttatttttatttatttatttagagacggagtccacctctgtcgcccaggctggagtgcagtggcgcaatctcggctcactgcaacctccgcctcccaggttcaagtgattctcctgccttagccccccaagtagctgggattacaggcgcccaccaccacactcggctaatttttgtatttttagtagagatggggtttcaccacattggccaggctagtctggaactcctgacctcaagtgatccgcctgccttggcctcccaaagtaccgggattacaggtgtgagccaccgtgcctagcctgtctgtagatacatctttaggaagtgctcagctgctcagaagcacactctgagacccagccccatcctttctctgcttcactgttgttggtgagttgaccttcgtgctctgcttgtggcctcgtgttcacagcatggctgctgcatgtccaagcttcatggctgtctgcaaggcaggaagaagtagggagtgggtagggctggcaccagcagcagtggtctcttctatccagaaagcaaaagcagacttccaccaaaatatctggctaaaactgtgtcccatggccacctctggctgcaagggaggccagggacctgagtgcgtgtctttttgaggctcaggttaggggatttgggagaagggaactgggcactggtgtggccagctgacagggtctgctgccccctagcacagccgactcagcttcctcagacacatccacctgctcctctcccgcctccctctgctaccaagctgggcctctgccccctctctcctggcttgctgcaatcagccttgatgactccatccatttacctcactgcagcctgagagcaattctaaaacacaggtctgaccacattgctcccttgagaagactgtcggcaggttaccactattctcagagtaaaatcaatgtatcgttccctttgttatctgggtgccacctcctctccctcctcatctttccccacccctaccactgtatgtcccagcccttctggcctcatggtctatcattccctctgcctggaaccctccacccaccccatctttgcgcactggtcctcaccgatgcccttccgtggtggaacaggtgcttcctttgggcttctatcacagcaactcgatccctctggcagttctaagcagtctggcagcgtcttcttaaaggcaggaaccccagcatggcctggcccaggactggccttcaggaggactgtgaattcatggaggtgttggaagctgggcaggatttggatggctctctgtcattgcccagcataaccaattgtgggaccccggtcccctctccacccccagggccggatctccttctacatgaccaactatggtgaggagggcacgcacgtggggagtgccgccgccctggacaacacggacctggtgtttggccagtaccgggaggcaggtacgtctgtccgtggtttggccctgtggtccccattgaagtgtacactttagtttttctgagtgttcttccaggagcagcatagtgccaggaaggtctaaggagctggaagaagagctttccaagcaagaaagagacaagccagggtcaggactctggagggggcagtcttcccactctgaaggccagaaagtgtagtggctcagggtctgtgctcttaaccctttgttaccagttgtcaggttttgggcaagtcacttcccttctctgagcctcagttttctaatctccagaagagggattatgacggtacctgcatccaagggtcgctgggaggatgcagtgaagtcaacgttcgctgtgggtgtggcctgtgctggagaccctgtctccctggtgcagtgatcccctggcccctcctcaggtgctgtatccttcggggagcaggagcaggtggaagaaccttgacagacctgagtgcggtgcaagattagaggggcccggcaagcccagatgagtgaaaggaaggaagggtcaaagaccaggaatgaagaaaatcattgagcaggaatgagtgcctgggagcgaaggagtgagcccagggagcagtgagtggggtcttccagggagcttgttggtgtggggccctgcatggggactaccctcagagtgtcagcgagcactgatagggccaggaaggcacatcttaaccctttgtcttagatgcttggggcaagttgcttaactgccctgtgcctctgtttcctcattcgtaagggggatggtagcccttcccaagacagctgttgagggcagtcttggggcagttggcaaagtgccctcagcacagagtaagcgctcagggccaggggttggtgtcatgatcggggactcgccctgggacagcccttcagcagggccagaccacgtggctgtccagagcccccatggaccagcatggcttgcagcctgctcctggactgtctactgctcacagctggaccaggctcttggccccacatgctctaggagggcaaacgccctgtggtgtttgtctaaggtctagtgtcatccgtgcggaaaaagatttccagacaccaggcagcaagctgggcccccgccagctgtgctgagcactgcacctgtttttgctgaagggttctcttgtgagggcaccaggcaggaccgagcaagcctcatgggaatcatgggagccgctgagctctccacatgggagagctggccgcctctgcaagaatgactgtccagcactgagggtcagcagaagtgtctgggcagctgcaaatgggactcatgcagaggcagcatggtgcagggtaaggagttgagtcacatccactctagacttcacttggcaggccactcaccttggtgacgctgtctgtcgtctgtgaagtgagaagagtggtgttcatcatgataggtagtgcctccctgggctcttgacaccagagtgctgttctttttttcttctccttttttttttttgagatggagtctcgctctgttgcccaggctggagtgcagtggcgcgatctcggctcactgcaagctccacctcctgggttcacgccattctcctgcttcagcctcccgagtagctgggactacaggcgcccaccaccatgcctggctaattttttgtatttttagtagaggcggggtttcaccatgttagccaggatggtcttgatctcctgaccttgcgatccgccctcctccacctcctaaagtgctgggattacaggcgtgagccaccatgcctggcctttttttttttttttgaggtggagtctcactctgtcgcccaggctggagtacggtggcgcagtcttggctcattgcaacttctgccttccaggttcaggtgattctcctgcctcagactccggagtagctggaattaaaggcatgcaccaccatgcctggctaatttttgtatttttagtagagatggggtttcaccacattggtcaggctggtttcaaactcctgacctcaagtgattcgtttgccttggcctcccaaagtgctggggattacaggcatgagccaccgcgccgggccagccaaggtgctgttatatgtgctctttagcctcggagactgtcatttcccctcactgcactgcagagcgagggcacaccgggtgaggttagggcaggccccagtggtgttgcctcattgaggcacctcccccatccatgtgaggcaggagaggcaagcattaccatcaactctaaaagccaggtaagaacctgagtcaacagaggtgaggtcatgggcccaggccacattctcctaaggagtggagccgagtctttttatggcagtctgacccagagacagctctcgctgtttcccacccttggctgtcttcccagggctatatgtggagtatcagtggtggcactggcagggagtggcgcccggtgaaaaggagtgttaagaggaagcacgtgccaggtgtggtggctcacgcctgtaatcccagcacttcgggaggccgaggcgggaggattgcttgagcccaggagtttgataccagcctgggcaacatggcgagacccccatctctaaaaaattaaaaaattagccaggcgtggtggtgcacacctgtagtcccagctactcaggaagctgagtgggaggattgcttgagcccagaggttcaagactgcagtgagctatgcttccaccaccgaactccagtttgggtgacagagtaagatcctgtctctgagaccaacaagaaaagaggtagcatgtgtcaagcaagagcagcagttcccactggacctggagtttcctggtgcaaatcagcctgtgagtctgtattttcttttttcttcaagacggggtcttactctgtcacccaggttgaagtgcagtggcatgatctcggctcactgcaacctctgcctcttaggatcaagtgatcctcccacctcagccccctgaatagctgggaccacaggtgcacaccaccacacctggctaattttttttttgatttttggtagagacggggtttcgctgtgttgcccaggctggtctcaaactcctgagctcaagcagtccacctgcctcacccttccaaagtgctgggattacaggcacgagccactgagcctgacaagtttgtacttttagcacgttcccctgcccctgcccagtccttctcacatgggtggacctagtaccacattctgagaaagcctgattccaaggccctgtatcagtcccttggaccttctttgaccctctacaagacctttctttccctccttaaccagagcaactcctgtttctatctgttacatatgcagcacagccacatcttgtgtggatttgtattatgtccattcaaaagcatgtgtcagaaaataccagtaaacctgtattaaagttggatgttgaagtagtgctaaccaccctcaactctaactaaaatatcaacaagtgggctgggcgtggtggctcacacctgtaattgcagcactttgggaggctgaggtgggtggatcacctgaggtcgggagtttgagaccagcctgaccaacatggagaaaccccgtctctcctgaaaatgcaaaaattagctggatgtggtggcacatgcctgtaatcccagctactcaggaggctgaggcaggagaatcgcttgaacccaggaggcagaggttgcagtgagccaagattgcgccattgcattccgggcaacaagagcaaaactccgtctcaaaaaaaaaaaaagaaagaaaattaggtagatctagtggtgcacacctggaatcccagctatctgggaggctgaggcataagaattgcttgaacctggaaggtggaggttgcagtgagctcagattgcgccactgcactccagcctgggtggccaagccagactctgtctcaaaaaaaaaaaaaaaaaaaaaaggtaactgctgtgtgtaatgtgatctccattaaatttgtatctaaagagcgggttctgcggtaaagaaaggatttggaaagcactgtactagagagctccctctgaataatgttcccggtctgagtgcttgcagcattgatccacagcgctgcccctaaagtgttggtgtgaaggttgtcccactcttcaggcggggcaaagagcttgtctgagggcaatcacaaacccccttctgtcttctaacttcggaggaagggcccccttaacctggagcggttccctttgatggggaggtgggtgttcaccagaggttttgtttgaagaaaaggttttactgccatacatgggttagagtacttctgtagtccagaagttgtaaattagtggtctatgctgttatttggttcataatgatgatttttttttttttttcgagacagggtcttgctttgtagcccagattggagtgcagtggcacgatctcagctgcctgcagccttgaacttctgggctgaagcaatcctctgcctcagcctcccaagtagctggaaccacaggcacacatcaccatgcctggctaatgttttgatttttttttttttttgtagaagcgaggcctcaccatgttgctcaggctggtctccaactcctgggctcaagcgatcctccaacgtcagcctctcaaagtgctgggattacaggcatgaaccaccatgcctggccatagtaatgatttatggttagaatatttcttaaaggtaattgaattagttgaaagcacttaaataccagacaatatctcactaagagaaagaaagaaaaaggctagatttctgctttcttttgaaaaatcagattggccttgctgggcagagtcagtcagtctgaacatcagtcttcctcttaaaacaagcctgagctttcctgtctgcctgccagcatgctgcaggtcacccacagggctgaactgtccccctgtactgcccactcggctaaccattgcctcctcccctcctaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcagggtgaggatgcatgccctgtaccttgcacatgtgcagaccaatgtcacacccctgtccaggcctcagctcttttgcctgccttctgggtggaattctgggttggtgacaccactagagccctggtctgtgctccagacttcttcttcttatttttttcttttttgagacggagtcttgcactgttgcccaggctagagtgcagtggtgctatcgcagctcactgcagcctccttctcccagcttcaagcaattctcctgcctcagcctcccgattagctgagactacaggtgtgcaccaccacgcccagctaatttttgtatttttaatagagacagggtttcaccgtgttggccaggctggtctcaaactcccggcctcaggtgatccacccgcctcagcctctcaaagtgctgggattacaggcgtttaagccattgtgcccagcccactttttttttggtctgagacggggtttcactctcgtcagccaggttggagtgcaatggtgcaatctcggctcactgtaacctccacctcccaggctcaagtgattctcctgccttagcctcctgagtagctgggattatgggcatatgccattgtgcttggctaaatttttgtattttttgtagagataaggtttcaccattttggccaggctggtcttgaacctgagttcaagtgatctgcccaccttggcctctcaaagtgctgggattacagatgtgagccactgcacctggcctgtgttccagactttgaatgcacctcttgtctgggacccttcagaagagggctctgttgctgtccccaccccattcaggggcctgaagcctgtgtgaccacactctggatttcccaaccacatgcccactgcatttgtctgctcacaaacatagccaacgtgtgcaccaggttccactgtgccaatgcttcacgttcatcatctaataaggaccctcattgtggccatggggacagaggttattatttgctcttgttcctgttttcaagagcaggatgcccgtgttttgtgtgtgtgtgagagacagcaagtgaatgggaaaaaaaaaagtgcaggagcctggccaacatggcaaagccctgtccctactaaacatacaaaaattagcttggcatggtggtgcacacctgtaatcctagctactcaggaggctgaagcaggaggattgcttgaacctgggaggcagagtttgcagtgagctgagatcgtgccattgcactctagccaaagtgagatcctgtctcaaaaaaaaaaaaaggaaattgaagtcaaagagggaagtcactcgctaacggtcatgtggcacagagggagaggagcagggactcaagtcattgactgtgtacctccagagcctgggttcttggccctgacctttgtctgcctcagtcctcagagtcaagtaagcttccccaaagcttaccgtaggtgccctgaagtcccttcccttataagagcttttttgggaagcaaacccactgggtgccaggcctgcaccctcatagtgtggagaacaaggaatcggagccccttcctgccctccggggcctgtagcctgatctagggttggtctgggccctggcttttttgccctagggcagctgagatgcatgagtttgtgtctctccaggcctcagcactgtgcccagcacagcaggaggctccacaccccttagctcatagtgttcttttgttgaggaacaagaagcagtttgagcctcttaggtgggaggtgggcagggaagctttctcagaggagggggcatttagggggcatttgagctaaaggtaatagggtttccacaaggctggggcgtggccctaaccttccctctgggtccctgctaagtcacttcaaatacacgaagttcctgccgtgtgccggtgccactccaagtgcagggaacaaaagcaacgcaaacctcagccctcctggtgctgccattgtggtgggggagacggacagtaacagagatggagagggaactcctggagtatatgagggtgggggtcctgtagggagcagccaagccagccgggtgtggtgcactgtaggggtggctggggtccgtcactggagtgacactgaagtatggaccagaggatgtgagggggggagctgtgtggtgtcttgaggcaggtgtgagcctggcgtgtttgaggagctgggaggagcccagaggggcaggtgtggagtgagcaggtgtggagtgagcgggtgtagggtgagcaggtgtggggtggttggaggtaaagtccaggaggtggtgggtgggggtgcagatggtgcagggttgggtggggcctcaaggcctttgcctgttgcagggatgtcgacttttactcaaagtgggacaggagccgtgggtggggaggagtctgctcttccttggcctggctcacctcttcatggaatccgcgggctgccctgtggataagggattgggcagtgtgtgaagggctagtaaggaggctgctcagtaacttgggcttgaccagggtggtgcagaggaggaggtaagaggggttaggttctgaaggtggagtagatgtggagaatggcgggaagtttggcttggagatgatactggactcttcagcctgagcagttggaagggtggagttgctttcagctgagcaagaggagacctgggtgggcagatgctggggggcatcaggagctgaggtgtttcctttccccttgaagcctggtgactgctggcctgagccacgcttgagccgtgggtcatgtgagtgtgaatgagtgtgagtgcatgtgagtctccgcccctgctcaccaccctctcatcccctgcagcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattggtatgggctctgctggctgctccccaccccgctgggatcatctccttccctccccaatcccgccaccttcctgccacccctaccctccttcctggttctcgtcctgtgtcctgtggcgtctggcacttggtcagccacaggagttgaggtcctgagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagccctttctcatcgaggccatgacctacaggtgcctgccgctccccccgtcagcacccccacagcactgacagccaccatagcatcttcctcatatcgatcactgtctccaaaacatggtcttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgagggtgccccgcccgggagggtgtgctgggggctgctgcggcctgcagagcttgggaaggatttgtggaacaccgaactgggaggctcagggataaccccagtgatgtctcagatgtggcctgtggagccaggctgctggggccatgtgtgtcctggctctgtgtccttggcacgttgccctccacttccttgtctttgaaaggggatgctggtggtgcccatttcagaaactggtttgagactgggcatggtggctcacacctgtaatcccagcactttgggaggccgaggtggcagatcacttgaggtcaggagcttgagaacagcctggccaaacatggtcaagccctgtctctactaaaaatacaaaaattagggctgggcgcagtggctcacgcctgtaatcccagcactttgggaggccaaggcggacagatcacctgaggtcgggagtttgagaccagcctggccaacatggtgaaacctcgtctctaataaaaatacaaaaattagccgggcatggtgccgggtgcctgtaatcccagctacttgggaggccgaggcaggagaattgcttgaacctgggaggtagaggttgcagtgagctgagatcgtaccattgcactccagcctgggcaacgagagcaagactccatctcaaaaaaaaaaaattagccaggcgtggtggtgcgtgcctgtagtcccagctactcaggaaggtgaggcagaagaatcgcttgaacccgggaggtggaacttgcagtgattggagatggcgccactgcactccagcctgggcaacagagcaagactatctcttaaaaaaaaaaaaaagctcgtttgaggattaggtggcaaaccgtggtggagtgtacatgccctgcccagagtcagtgtgccaccctccctgacccggtcattaggacccagggcccgtgcagcccagtggtgagggcagcacccggcatagggcagcaccgtgtgtcctgtccctgcccttctctgtgcctcagtttcctcattgcttagctgtctacctcttagggctgctgaaagccttaaatgattccacacacttggatagcacctgatccctgctgggatttgagggttttcattacacttctgctaggataatcatttccattgtcgaggtgggaacacaaaggcttggagtggttaattccttgccaaggccccgcaggaggaagcagggtcctgcatgggaggccggctagcctgcccactgccccatgtccccacaggtgatggaggcctttgagcaggccgagcggaagcccaaacccaaccccaacctgctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctaccacctctggtctttgtttcctggagtttgggggtgatttgaggccacccccagcttctccaccttagataaataaggtcaaggctcttgagatacctacttcccccggaagcttgcgcaagctggaaggttaacttcagcagacaggatgggggtgggggggtcctccagagatggtctcctgctctctcacagaatgggagaagcctgctgtccagcagagtgatggggagcccagtggagctagccctgcccagcaggggtgcaggggagcgtccaggatgaaggtcagggtgtggccaagccctgctccccaccactccagggccccacagatgcaaaaacaaccccaggcctcagagtggggagtgcatgtttttcaaaaacaaaaagtaggcaaaaacagtccaccaccccatctttcctgcccaggcccctggctgggggaggccaaggagtggcttaagttgtccagcttctgggccctcctccctcccatcaagacctggaaggaggggctgagccaggggccggccccagaggcccaggccagggccggggccaggtcagcacctccgccctccccaatgagagtcagcactggagccttgggtcttgcagttgtttccagagccgaatgctggcctgggggcccaggggccgtaccagcagcaggttgcggaaagcacagtggtccgcagtgcggtctgctggccaggctgtgaggaagcctgggtgggcctggggcaccaggcccagggctcggatgcaaaggccagtgtagacgtcctcaaaggggaagggtgccacacgggctgccgcccgcagcagccagggtgccaggcgcccggcaatgacgtagccacccccgcttgcataggctgggtagccaccttcgaagaaggactcgggcacatagaagggtcctcctggcttccggagaggcatggcctgggtaaagacctcacccaggtagaggcttcgggccgaggcaggtggcagggcccgcaggtgagccagcagggcaggggtgtgtacaaaggcatcgtcctgagctcgcaagacaaaactcacggtggggcagtggcggcccagccaggccagcagcagcaggtctttgagcgtctggttgaatgggacgtcgaggaagtcccagagcagcaggtcactgtagcgacggctctcccatgccactagtgagtctaggtcaggccccgcctcacctaccggagaccctagcaggaagagcagccggatccctggagctggactgccccacgtctctctcacggcctgtcgttctgcaaagcgccctggttctgacttgacggccaacagcaggtaggggacatcagtatctgagcagctggagacttggccgccaccacctccaggcagccactgtgggaagctccggcaggctgctgacagcaagaagcggcggaggtccttggggtaggaggcgaagtcagggatctcggtggcggcggcggccccccaagcctggcagccccccgtttcagtgctgtccccactgggcagggaccccagccgccactgctgctggttccagtaagcaaagggcagcgggatagtctggcccaggcgggtggagaggttggcaggtagggtgggctcagggttggctggcgtggggcttggcggggtgccccgagggctggggtaggccttgctgagccgggactcggatgtccattcgatgtacactttgaggcccaggagtgtgagcagtgctgacaggcagagaaggcacttggggcagcgcatgacccggcccagggaaggggcggccgcgggagctacaagggagccacaggggagccacggaggccattggggtgtggggatgggcctccagagagggcccagccaggccccaggcagacagcttcacaatctcccatagtccccgccaacccccataacagattctctcggtcccagatcctaaacagctcccctgacccagggacctcgt

SEQ ID NO: 13465 - DNA, 27579 bp, Human
ctcaaatgtcaccttcttaatgaagcttccttgatccccttcttgctaaagcggtatccccaccctcaccctacccagctctgttttccctcacagcaattaccaccatctaatctaccctataatttgcttatttactacattcgttgtctaggatatcagcttcacgggggcaggaatttttgtctgccatccatgttcatgtctgccgtgtccccagctagctagaacagagtctagcacaggagaagggatcagcatgagatgagatggggctggatctccaagggctttgactaccagactgaggagctgaactgtgttctgaggacatgggcaaagctatggaaggagagaaagatgcttccagatgccaggtggaaggtggattagagaggggcaagaaagaaggccctgggcccaaagggagcagggcagggacatgaggagggaaggcaggaggtgtccctgacaaggcccatgatggttacctggggactggaggagcaatgggctgccctgacatggggtcatggaggaggataacacagagaggaaattcagcagaggtctgattagaagggccttgaatgttgaagaggttggactttatactgagggcactggggagctatggaaggatccttagcaggggagtaacatggatttggaaagatcactttggctgctgtgtggggatagataagacggtgggagcctagaaaggaggctgggttggaaactctgggacagaaacccagagaggaaaagactgggcctggggtctccagtgagtatcagggagtggggaatcagcaggagtctggtccccacccatccctcctttcccctctctctcctttcctgcaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacgtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacaggtgtctgcctcctgacccttccatccctcaggtgtcctgttgccccctcctcccactgacaccctccggaggcccccatgttgacagaccctcttctcctaccttgtttcccagcctgactctccttccgttctgggtccccctcctctggtcggctcccctgtgtctcatcccccggattaagccttctccgcctggtcctctttctctggtgacccacaccgcccgcaaagccacagcgcatctggatcacccgctttggtggcgcttggccgccaggaggcagcaccctgtttgcggggcggagccggggtgcccgccccctttcccccagggctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacggtgagctcggaggggcaggggagccgggaggggggcccccagggggcgccggagtgccggggccacgggtaggaagtgactggcagaagaaactggctggaggaagaggacaccccggggcaaagggaacgtgtgatggtgggaggggggtgtccgaaagaggatggcactgagccccctaccacccaggtgtctggtcttggagaggaggagatagcgaagtggaccgcttctagagtgcgacagaaacatgcggggtcgtgggggcagtcccctagagggagacaagcaatagggggagggtagaaggctccctcttccaggacgcgttgaatgggggggggggtcgtggggtgccaggtgcagagaagggagcctggtgtgggagaagcgaagaccccagcatttgggaaaggagaggcgctggagaaagttgacccagagcttgggggtcctgaggtggaaagattcaagaaggacagaaaagctagatgaaggcaaccccagagggtgccaggaaagtgagagcggacccacttccagaggctgccaggaacacgcgggatgcgggggtgggggagagtcgtagaaagagaaacagaggtgcgtgtgataaatgtggggagaaagggacgggaggttattggaaggaggaggcaagcgggagaggagcggagactcgggagggcgcccgggatgcagaggtgtcctcggtgtttcacacagggacgtgagggacagagtggggagcccagcggaggaatcgagcttccagaagacctagagtcctgggtcatgggaagggctttaccgagaggggagacaggcgtgggaaaggtggtgtgagcggggaggaggagagatacccagcgccatccacgctgcgagcagcgagcccccccattccccgcaggatgcaggggaatgggctgagcggagtccagccgcaggggaagtgctgggtggggggtgactctacaagaccgaggtgagaaaaccaagctgggaggagtgagaaagccccacgtgggtgccacgcgcggggggaggagcctgcgcttccaccaaggggcaggaggaccccgctgcgctaaacgctggcagtctggaccccaaagtcccagttcctctcagggtggctggggaaaccccagcgtccggcggcctcatcctcctcccttccctttccttcccatgcccccggcgggggcggggatcgctcgcggagcccggggcgagacggggcaggtctggtccccgccctcctggctgcggcgcctcccgccctcctcaccccagctacgggcggggctcccactcagccggccccgtcggcatccatgcgaggacccaggcgtcccgcgtggttcagagccttggggaagatccctcaggtttcactgactcttgggcggtgtgggcttgcgggttccctgcccatttctgcgccagtttacagctccagcccaatgacgcgcactccgcacccaagtctcagccttaccttatcttccgtggcttcaccttcgttgtagaggttcctttaacactgacacctccaatcctcttctccccaacaaatgcacatgtgtctcgtctcgcacgtgtctccccatctgcctctttcttttcgtctccgttagtctttctgtccacgcatgggtctcctggtttttgtctctccgactattttctctccctttctatttttctcctccacggtccggttgcctcgtctccgtctctgacatctccccgcctctccctctctgcatcaccctccaacccttcctctccctcctctctgtcttcctccctatctgtcttccccagccaaggctctgcctttcctttggggtttgctgagtaacctccgggccaagaatagggcttactggggctgggtggggagggagactggggaggaggaggaggatcgaagggggccgtaggggaggggtttcctctgcctttctcaccagtctcttttcacacccccactatgggaggctggaagcagttgccccagttgatccagcagttcatggcctgttccctcatccccatccccaaacttttcctaaactagaaaataccttggctgggcgcggtggctcacgcctgtaatcccagcactttgggaggccaaggtgggtggaccacctgaggtcaggagttggagaccagcctggccaacatggtgaaacccggtctctactaaaaatacaaaaattagctgggcggggtggcgggcggcgcctgtaatcccagctacttgggaggctgaggcaggagaatcgcttgaacctgggaggcagaggttgctatgagccaagatcgcgccactgcactccagcctgggcgacagaaactccatctcaaaaaaaaaaaaaaaaaagaaaagaaaacaccttaattccttttctccccactacagccattcctacccagaatgaacttcactttccctaaccagctggggaagggagttaagggtggaaaactaataataaaaataagtagaagaatcacttaggggttaagagcacagtctctagctgggtgggtgtggtggctcatgcctgtgatctcaacatattgggaggctgaggcgtgaggatcccttgagcccaggagttccagcctgccgtgagccatggttgtgctactgcacttccgtctgggggacagagtgagaccctgtctcttgggggaagaaaaaaaaaaagcacagtctctggaatgagacagcttgagtttgaatcccagtctgcagctatgtgaccttggggcaaattacttaatctcggtgcctcagtttctcatctattaaacgggtataataatagtataaggttgtgaggtttaaatgtcttcatctttgtaaagtgctttagatagcatctggtaaatagcgctgttttgtggttttttgttgttgttgtttttgagacagagtcttactctgtcacccaggctggagtgcagtggcgcaatctcggcacactataacctctgcctctcaggttcaagcgattctcatgcctcaacctcccaagtagctgggattagagccgtccggcaccatgcctggctaatttttgtatttttagtagaaacggggtttcaccatgttggccaggctggtctcgaactcccgacctcaagtaatcaatccacctcggcctcccaaagtgctgggattacaggcgtgagccactgcgcccagccagcactcttagacgtatacatgattgagtgaccagtgtatgcagaattggtgccacatggcttgacctgggtcatctaatttcccactataatactggaatgggttctagagtcactctgtcttgtcttacacctggctcagagagaggaattcacttgcccaaggttacacagcgcttaaattaggagagtctgtgtgggaatgcagggagcttaatgttattgctgtttttcaaagaataacaggaaactgacattcagaaagagggtgttaactgcccatggtcacacagccaagaggcagcagaggcactatctgagtccaaagcctgtgcctttgatccttactctgcattttaggggctcttgcatttggggcaaggaaggccagagcaaacagagtggttccccttggtgccagccttagtcgacttgagagatgatgctacatgagagaggaatgtggttaggacctattttacagaggaggaaacaaacctagggggagaaaccacttcctcaaggtcacacagctaaaaagtatcacagtcagggctgggcgtggtggctcacacctgtaatcccagcactttgggaggccgaggcgggtggatcacgaggtcaggagatcgagaccatcctggccaacatggtgaaaccccatctctactaaaaatacaaaaattagctgggcatggtggcatgcgcctttagtcccagctgctcgggaggctgaggcaggagaattgcttgaaccctggaggcggaggttgcagtgagcagagattgcgccactgcactccaagcctgggtgacagagcgagtctccgtctcaaaaaaaaaaaaaaattcatttaaataaataaataaataaataaataaataaataaataaataaaaggtatcagagactgactccaccccagagctgtcagctccaaaactcctagagttgggagcaccagctcccctcacctctgccaaacccctgatcgcctcccttcatttctccctgctagaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccaggtgaggacatgagccagaaggaaggtcagggcatgggctggagagggtgagctgtgaccaagggggtggctgtgggtcggctggttacaaggtccacctagatggtccctgaaggatagaagaacacaaaccatacaatcctagaactcttttttttttttttgagacagtgtctcactctgttgccaagctggagtgcagtggtatgacctcagctcactgcaatctccgcctcctgggttccagtgattctcctgcctcagcctcccaagtagctgggattacaggtgtgcgccaccacgcccagctaatttttgtatttttggtagagatggggttttaccatgttggccaggatggtctcgatctcctgacctcgtgatccacctgcctcggtctcccaaagtgctcagattacaggcgtgagccactgcgcctggcctcttttttttttttttttttttgagatggagtcttgctctgtcgcccaggctggagtacaatggggtgatctcggctcactgcaacctccgcctcctgggttcaagtgattctcctgcctcagccacccgagtagctgggattacaggcatgtgccaacacgctgggctaatttttgtatttttagtagagacagagttttatcatgttggccaggcttgtctcaaactcctgccctcaagtgattctcctacctgagcctcccagagtgctgggattacaggtgtgagccactgcacccggaacctagagcacttttaaatgttcagactctttgcatcctaggatgttaaacacttagaaggctggaatcttaggagttggactctttaaggacacaggattcttgaaagttggaatctctgaaaaggttgggggctctagaatcattctgtccaatatgacagccactagtcacatttagcttgattaaaatttaaattgtttaaaattaaattaaaaatttagggccaggcatagtggctcacacctctaatcccagaactttgggaagccgaggcaggcagattgcttgagcccaggagtccgagaccagtctgggcaacatgttgaaacttcgtctctacaaaaaatactaaaattagcctgttatggtgatgcgtgcctctagtcccagctactcagtagtctgaggtgggaggattgattgagcccaggaggtcgaggctgtagtgaactgtgattgcaccactgcactccagcctgggtgatggagcgagaccgtctcaaaaatatatatatataggccaggcgtggtggctcatgcctgcaatcccagcactttgggaggccagggtgggtggatcacttgaggtcaggagttcaagaccagcctggccaacatgacgaaactccatctctactaaaaatacaaaaattagccaggtgtggtggcaggcgcctgtaatcccagctacttgggaggctgaggtgggagaatcgcttgaccccaggaggtggagactgcagtgagcggagatcataccactgcactccagcctgggcaacagagcgagactctgtctcaaaaaaataaaaatgaaaaagaaatcctcattctcactggccatatttctagtactctatagtcacatgtggttagcagctactattttggatgttgcagataaagcacatttccagaaagttctttaggacagcactgctctagaagatagggagcttccaagaggactggggcatctggaagggctggaggctctagcagtttctatgagctagaatccatatcagagggaatgttaactcataggatggtagatttcagactttcacagtgagagaactttgtcctatgttagcttggcttcttggagtctggggaattcagctttattctgcagtccctggagtggactatccagccccagaaaattcttcttttttttgtgtgtgtgtgtgatggagttttgctcctgttgcccaggctggagtgcaatggcaccatcttggctcaccacaacctttgcttcctgggttcaagcgattctcctgcctcagccacccgagcagctgggattacaggcatgcaccaccacgcctagctaattttgtatttttagtagagacggtgtttctccatattggtcaggctggtctcgaacttctgacctctggtgatccaccctcctcggcctcccaaagtgctgggattacaagcgtgagcgactgtgcctggcccagaaaattattctacacagatgttgggtacctgcagcatctaggtgcggcatggcagactcttgggtttatagaacattagtcttctaaagcttctcaggctctagaagtggaaatcttgggatattatcaaacatttgaatcacaaaatgactttttttttttttgagacagagtctcactctgtcaccctggctagagtgcagtggtgcaatctcggctcactgcaacctctgtgtcttgggttcaagtgattcccctgcctcagcctcctgagtagctgggattacaggcgtgtgccaccacgcctggctaatttttgtatttttagtagagacgaggtttcactttgttggccaggctggtcttgaactcctgacctcaggagatccacccgccttggcctcccaaagtgctgggataacaggcgtgagccaccgtgcccagccggaatcattagaaattacttctaagttactgagaattcagggtgtcaaatttgcagaaccgtatgctcagtaaaccccagaatgtttgcagcagaattttattttatttattattattattttgagacgaagtctcgtcctgtcgcccaggctggagtgcagtggcgtgatcttggctcactgcagtctgtgtctcccgggctcaagcaattctcctgcctcagcctcccaaatagtggcgactacaggcgtgtgccaccatgcctggctaatttttgtatttttagtagagatggggtttcactatgttggccaggctggtcttgaactcctgacctcaagtgatccacccaccttgggctcccaaagtgctgggattacaggcgtgagccactgcgcccggcccagaatgttagcagcagaattttagcattgtgggctgtccacgctgagtggggcttagcatttcaccaatgaggaaacaggcctcgagaaggcaagaaaacaccttcggctgagctgtgtgaaggtgacttgaccgcagcctgagctttttctccacccctcctctcatgggtactgttggggaggatgggtgccacaggaccacacaggtggctgtctgagagggtagtgcctgggaactttctggaagcctgtttggggaagcagatggggtgaaggattcagttagtgtatgtggggtcgtgacaccatctacccactgtctctctcctgccttcatcatcctctagaaatacagcaacaattcctggcgatacctcagcaaccggctgctggcacccagcgactcgccagagtggttatcttttgatgtcaccggagttgtgcggcagtggttgagccgtggaggtgaggattacttgtgtgtcccacccctgtttctccctggggtccaccccattgtttgtcctggggtcactttgcctaggacccctctccgccccatactggtgtgaaagtgctgagacctggctcccctctgtggcatggaaacctgagtgattggctaatctgtttcctgagcacctctctgccctgccctgtgatgggtgatgccaaggacacagcaatgaccaaaacagccccatccttgccctcacagagctcatatagtccattggctaggtagctggggaacagacctgtaaggcagtgatgacccagagtgggtgggactgggatggggagcccaaaggaggtacctgacccagcccagaatcagggagggcttcctggaggaggggcaccatagctgatgttgaagggatgagtagaatggtcaggaaaaggagaggtgtaagagtattctggggctgggcatggtggcttatgcctataatcccagcacttttgaaggccaaggaggatggatcactggagctcaggagtttgagagcagcctgggcaacatggcgaaacccggtctctacacaaaaatacaaaaattagccatgcatgctgttacgtgcctgtagttccagctgcttgggagactgaggtgggagaatcacctgagcctgggaggtcgaggctgcagtgagccataatcacactactgcaatccagcctacatgaaagagtgagatcccatctcaaaaaaaaaaaaaaaaaaaaaagattccaggcaaagggaacagcctgtgcaaaggcctggaggccagggagagcctaactcatttgatctgtccaggagatgattgtctctgtctggtttctggcagggcccatggtgcccctatctctctccctcacctccctctcatttatgcttttattcaataattgcccacaggttcctgctgtgtgcctggccatgtgctgggtggtgtgggggacatagtgataaccaagacagccctcagttctgccctcatggggcccacagtcacttctggacacctaagagatcttgtcaaggccccaccaggcaggaatgacctagaatgatcaagaatgggatggggaggcaccagcagggaggacaaggctgggacagggaggcatgcaggatgggggaacgccctaagtgctgttgggagcccagagaaggcacctggacccatctggggagtctaggagggcttgctgggtgagggtgattgtgtggagactcacaggataaatagtagtttggccacatgaaaaaaaagggattagggggcctggcatggtggctcacgcctgtaatcccagcactttgagaggccgaggtgggtggatcacctgagatcgggagttcgagaccagcctgaccaacatggagaaaccccgtctctactaaaaatacataattagctgggcgtggtgatgcatgcctgtaatcccagctactcgggaggctgaggcaggagaattgcttgaacccaggaggtggaggtttcagtgagccaagatcgtgccattgcactccagcctgggcaacaacagtgaaactccgtctcaaaaaaaaaaaaagaaaagaaaaagaaaaaatagggattagggagcaggtgggcactgggaggagtgtcctgggctgttcgacaaaggcctagaaggagctcatctgtcttggtcaatgctgagtcccaagcacacagcacaggcttcggcacattgtaggagcctagaaaacatcattcactcattcattcaagagattgatgctggccgggtgcagtggctcatgcctgtaatcccagcacttcgggaggccagggcaggaggattgcttgagcccagcctgggcaacatagtgagacctctgtctctacagagaatttaaaaagtagccgtgtaggccggatgcagtggctcaagcctgtaatcccagcactttgggatgccaaggcaggcggatcacctgaggtcaggagtttgagaccagcctggccagcatggtgaaaccccatctctactaaaaatacaaaaaattagccgggtgtggtggcgcatgcctgttatcccagctacttgggaggctgaggcaggagaatcgtttgaacctgggaggtggaggttgcagtgagctgatatcacgccactgaactccagcctgggcaacagagccagactccatctcaaaaaaaaaaaaaattagccatgcgtggtagcacgcgcctgtggtcccagctactcgggaggctgagatgggaggattgcttgggcctgggagattgaggctgcgagaccttgtctcaaaaaaaaaaaaaaaaaaaaagagagagctgcagtgagagggcagagtggggtgggtgggggaggcaggaaggaagcccctggggtttgctccttccttcctcttcctccaggggctgggtgagctgcactctcagactggcttccctctcgccactcctacaggggaaattgagggctttcgccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctgactcccacaccaaagcagggttcactaccggccgccgaggtgacctggccaccattcatggcatgaaccggcctttcctgcttctcatggccaccccgctggagagggcccagcatctgcaaagctcccggcaccgccgagccctggacaccaactattgcttcaggtgagccttgtagcctggatggaggccttccaggctgggggcatgactgccatctgctgaccaggtgctccaggttggacacctggctgctgctgtgcttgggctgagcatctgtctcctttagcttggagggctcaggggatgaggtctgggtgtaagaaccaggagtcttgtgccaggtgcggtggctcacgcctgtaatcccaacactttgggaggctgaggcaggtggatcacctgaagtgaggagtttgagacctgtctggccaacatggtgaaacccgtctctactaaaaatccaaaaattagccaggcgtggtgggcgcctataatcccagccacaaaaaacaaaaaaagaactgggagtcttgtaatgttgggatcaggttcctttttttttttttttttttttttttgagacagagtctcgctctgtcacctgggctggagtgcagtggcgctatcttgattcactgcaagctccacctcccgggttcacacgattctcctgtctcagcctcccgagtagctaggactacaggcacgtgccaccacgcccagctaatttttttgtatttttagtagagatggggtttcactgtgttagccaggatggtctccatctcctgacctcgtgatacacccacctcagcctcccaaagtgctgggattacaggcgtgagccaacgcgcccggcctaattttttgtatctttagtagagactgggtttcaccatgttagccaggatggtcttgatctcctgacctcgtgatccgcctgcctcagcctcccgaagtgctgggattacaggtgtgagccaccacgcccagccttgctttcttgctggagtgttggaatcacagaatgttagaaagttgaaccctgtgattgttggaattcaaagttggaaggtcaccatcttgaatccctaaattgttggcaggttgaggttctagaatgctgggattctagaatgctagaatttggtgttaattactgaaatggaaaatgtcggactcaaggaaagctgaaacattggaatcctagaatttggggattcaaaatgggaagatggcccatgtggaattcctgcaccactggccaattgtggataccagtgttggcagattggagtccttgaatattgggctcacagtggtagaattctgttttgaaatattcacatccacaaatgttggagttggagaaagcagaatattggtatctcagcatgttggaactcagtgttggaatgttagaatattagaatgctgggattttattaatagaaagtggcagcaggctgggcgcggtggctcacgcctataattccagcactttgggaggctgaggtgggcggatccctgaggtctggagttcaagaccagcctggccaacatggtgaaaccccatctctattaaaaatacaaaaattagccaggtgtggtggctggcacctgtaatcccagctactcggctgggattacggctatccaggtacccaggctggggcaggagaatcactggaacctcgggggtggaggttgcagtgaaccgagatcgcgccactgcactccggcctgggcaatgatgcgagactccatctaaaaaaaaaaaaaaaaaaaaaaaagaaagaaagtgtcagtttgaacctcttgagtgatggctcagaactttggaatgttgggatgcaatactggcatactggaattcaggaatgccaagatcctcaaaggttggaaagggggaatcctagagagttgaagatgctgtcagaatgttagaatcataagatgctggaatgctaatactgcaatctaagaaagctgaaatgttggattcctagaaagttgaaatggagagttagaatgttgtaaatttagagtgatcatctgaccttattcctcccttgcttaaaatattttggtcctgtctctgggctttgttaccggctgtttccctgccagaaaatcagccctgctcccaggctccttcaccaccagatcttagcgccatcagcccagcaacgctgtcaatgaacaaattgaggtcttttttgagacagagtctcgctctgttgcccaggctggagtgcagtggcgtgatctcggctcactgcaacctccgcctcccaggttcaagtgattctcctgcctcagcctcctgagtagctgggattacaggcgtgtgccaccacacccggctaatttttggtttttttagtagacactgggtttcaccatgttggtcaggctggtctcgaactcctgacctcgtgatccacccgcctcggcctcccaaagtgctgggattacaggcatgaaccactgcgcccggccacaaattgaggtcttgagtgccaacagctcctgacattacaaagggagatagccagccatgtcagcctccgtagggagggacccaatgttgcctaggaagtcttggcaaaaaatcaaacctgaaggccaggtgcggtggctcatgcctgtaatcccagcactttgggaggccaaggcaggcagatcgcttgagcttaggagttcaagaccagcttgtgcaacatgttaaaaccctgcctctgtacaagaaatacaaaaaaactagctggctgggtggtgtgtgcctgtagtcccagctacttgggaggctgaggcaggagtgcttgagcctaggaggttgtggctgcagtcagccaggatcacgccactgcatttcaggacagagcaggaccttgtctcaggaaaaaaaaaaaaaaatcaaacctgaatctgatcaggactgtagatcctaacagttttctagaaagacaggaacagaggaaatggtcagcaaaactcagactgcaagaaacctcacccagtttcttcatcaaatacaatgcaaagaaggggaaagcacacacacacacacacacacacgtaccccccatgcaaccaaaaattcacatacaagttttgactccccaaaaacttaactattaatagcctactgtggactggaattctgctttatccacaacataaacagttgattaatacttttttttttttttggagacagagtctctgtcattcaggctggagtgcagtggtgcggtctcggctcactgcagcttctgcctcccgggttcaagtgattctcttgcttcagcctcccgagtagctgggaccacaggtgcccaccgccacgcccagctaattttttgtattttagtagagatggggtttcaccgtgttgcccaggctggtcttgaactcctgaggtcaggcaatccgcccacctcagcctcccaaagtgctaggattacaggcatgagccactgctcccggccgaataatacatattttgcatgttttatgtattatgtcctatatcccctttttttttttttgagacggagtttcgctgttgtcactcaggctggagtgtaatggcacaatctcagctcacggcaacctccacctcccgggggttcaagcaattctcctgcttcagcctcctgagtagttgggattataggcacctgccaccatgcccggctaacttttgtatttttagtagaggtggggtttcaccatgttggccaggctggtcttgaactcctgacctcaagtgatctacccgcctcagcctcccaaagtgctgggattgcaggggtgagccacgcacccggccgtattctttgtttttttttttgagacagagtctagctgtgtcacccaggctggagtgcagtgaagtgatctcagctcactgcaacctccgcctcccaggttcaagcaattctcctgcctcagtctcccaaatagctgtgatttcaggcatccgccatcgcacccgggtaatttttgtatttttagtagagacggggtttcaccatgttggccaggctggtcttgaactcctgacctcaggtgatccatcagcctcggcctcccaaagtgctggccttacaggcttgaaccactgctcccggcctatgcctgcattttaaaaataagatagagaaaagaaaatgtccttaagaaaatcataaggaagaggaagtatattttccattcattgagtggaagtggcttatcataaaggtcttcatgttgagtaggctgaggaggaggaagaaaaggtgttggtcttgctgtctcagggcagaggtggaagaaaaattcacctgtaagtggtgaattttgtaagaggacccatgtagttcaaacccatgtccaagggtcagtctatatatagttgaccctgaatatatatacagagagagagagagatgattttgtagattttgaaaaaagtcctaagagaggccaggtatggtagctcacgcccgtaatcccagcactttgggaggctgaggcaggtggatcacttgaggtcaggagttggagaccagcctggccaacatggtgaaaccctgtctgtactaaaaatacaaaaatcaggccagctgtcgtggctcacacctgtaatcccagcactttgggaggccaaggtgggtggaccacctgaggtcaggagttcgagaccagtctggccaacgtggtgaaacctcctctctactaaaaattcaaaaatgagccaggcgtggtggcgggccctgtaatcccagctactcttgaggctgaggcaggagaactgcttgaacccaggaagtggaggttgcagtgagccgaggtcgcgccattgcactccagcctgggcaacaagagtgagactcccgtctcaaaaaaataaataaataattaaaaatacaaaaattagcagggtatggtggcaggcgcctgtagtcttagctacttgggagactgaggcaggagaatcacttgaacctgggaggcacaggttgcagtgacccgagattgcaccacttcactgcatcctgggtgacagagtgagactccatctcaaaaattaaaaaaaaaaaaaaaatcctaagagacatatcaaccaattgcaatgtgtagaccttacttgaatccttatttacacaggcttaaaaaaaaaagatatttatgagacagttgggtaaatgtgaactctgtctagatattcctctagatatcaaggaattgttaattttcttacatggtattgtgactgtgttttaaagtagtcttaattagagatacatttgaaatatttatggatgaagcaacacggtggattgcatgtgctttgagataaaccattgtcggctggctgcagtggctcacagctataatcccaccactttgggaggccaaggcaggaggattgcttgagcctaagagttggagaccagcctgggcaatatggtgaaaccccatctcccaaaaaaaaaaaatatgaaaagtagctgggcctggtggtgtgtaccttttgtcccagctactcaggaggctgaggtgggaggttggcttgagccccaggagctggaggccacagtgagctgtgattgcaccactgcactccagcctgggtgacagagtgagatcctgtctcaaaaaaaaaaaaaaaagagatagtggataggggtagagatgcaatggaaattggccatgagttggtcattgttgaagctgcttttgtgtacatctgaaactttccagctggacgcggtggctcacacctgtaatcccagcactttggaaggctgaggcgggtggatcacatgaggtcaggagttcgagaccagcctgtccaacatggtgaaaccctgtctctactaaaaatacagaaaaattagctgggtatggtggtgtgtgcctgtaatcccagctacttgggaggctgagccaggagaattgcttgaacttgggacatggaggttgcagtgagccaagattgcaccactgcactccagcctggggcaacagagcaagactccatctcaaaaaaaaaaaaaaaaaactttcataggaaaatttgttcttaaggcagctcgaacactacctccttcctaacccctttctccaacatccaagatggatgtgaggcctctgggcctcccctggggccctaagtagatctttgactcaacaaacagtctctgttgggtcttttatttataaaaagttttgtagcgacagggtctcactatgctccccaggctggtcttaaactccttgggctcaagcgattcaccggtcttggcttcccaaagtgctgagattacaggcgtgagtcactgcacctggcctaggtcttgagagactggacggaagaggcttggcaagggcaagggctgtgggtatcccaaggcccggtgcagggtaggccccgaatgtgtgctgaaaaaatgagtcagaggatcacctagacggcttgttcaacacggactgttgttcccagtcctgcacacaatttctgatttcagtggcctggggtgccacctgagaatctgcatttcccatagttcccaggtgatgctgccgctggtcctgggagctcacgtggagagctgctgacttggataacagtatcacagattgttcaaatcctaggatctcagaaccccagctagggttgaactgcatattaaagatgattctgagccgggtgcggtggctcatgcctgtaatcccagcactttgggaggccgaggtgggtgggtcacctgaggtcaggagtttgagaccagcctgaccaacatggtgaaacccagcctctactaaaaatacaaaaaattagccaggcatggtggcacatgcctgtaatcccaggtacttgagaggctgaggcaggagaattgcttgaacccgggagacggaggttgcagtgagctgagatcacaccatcgcactccagcctgggcaacaggagggaaactccatctcaaaaaaaaaaaaagattccggacactagttcttccccttttgtgagttcagaacttcctgtgagaaagtgaaagccaggactctttttcccagaaatacatgcatacatacacacatgtgcatatgatctcaggcactcatggccctccctaagcctgcccatgatggccccttggccctcagcttaacaccttattttatctagtagctcctacctctgaacagatgaggaaactgaggtccaaccaaattgggtggtacgggctgagttcacagggatctcagtttcttgacttccttctcaggcttctgtggctcttggaaaggctttatcttgcctctaggttatccggtgccacttgaagttgggttcaagcgattctcctgcctcagactccccagtagctgggattacaggtgcccgccaccaggtccagctaatttttgaatttttagtaaagacagggtcctcaagtctgcctgccctagcctcccaaagtgccgggatgacaggcgtgagccaccgtgcctggctggccccaccaatctatgagcagaggttgcagtgagccaagattgcaccactgcactccagcctgggtgacggagcaagactctgtctcaaaaaaaaaaaaaaaaaaaaaaggcattgtcaactttttcttttcttttctttcttttttcttttcttttcaagacagagtctcaccctgttgccctgggtggagtgcagtggcacgatcttggctcactgcaacctctgcttcttgggttcaagcagattcttgtgcctcagcctcctgagtagctgggattacagacaagcaccgccacacccagctaatttttgtatttttagtagagacggggtttcgccatgttggtcaggctggtctcaatctcctgatctcaggtgatccacccgccttggcctcccaaagtgctgggattacaggcgtgagccactgcacccggcctctttgacagttctaagaagtaaaataaaccagaagaaggcaggcagagagtaatagatattgggaactgttatttttcctattctgatttaaattcctttattatggaaaatttcaaatgtatacaaaagcaatgaagataatgaatgcccgtaaactctcatccagcgtcatcggtaattaagattttgccccatttcaaatgcagacatttttatattttcttgcataactgcaataccgtattgcactaaatggaactaacagtcacttggatattttggaaaggatggctcagaaaggtatctctgaggaggtgatgttcagtcatgtaactgatatttactagtacctactgcattccaggcactgctttaggagttaagggtccctgagtgaaggacatttgagctaaggtttaaatgaagtgaaggggccaggtgtggtggctcatgccagtaatcccaatgctttgggaggccgaggcgtgcggatcgtttgagcccaagttcgacaccagcctcagcaacatagtgagaccgtgtctctaaaaagaataacaaattaaaaagaataaataggccagatgcagtggctcaggtctgtaataccagcactttgggaggctgaggtgggcggatcacaaggtcaggagttcgagaccagcctggccaacatggtgaaaccctgtctctactaaaaagacaaaaaaattagccgggcatggtggcacacgcctgtaatcccagctactcggaaggctgaggcaggagaatcgcttgaacctgggaggcggaggttgcagtgagccgagatcatgccactgcactccagcctggcagacagagtgagactctgtctcaaaaaaaaaaaaaaaaaaaaaatagaaaaaaaaagaagaaatgaagtgaaggaacaagctggagtgggtatctgtgggactagcaaggcaggcagagggaacagcagatgcaggagccccgaaataagactgtctgaggaacagacaggacgccagtgtggctggagtggagtaggcgtgagagagggagttgagatcagccagatttgatagcaccttgtggctcacggtgaggacttgggcatttgccgtgagatggagccaggttcagagcagaggagtgacaagacaatttatagcatgcccatggagggcagagatttctgtctcttttttaaaaaaattgaaaaaaaattttgtagagacagggtcttgcactttgttgtccaggctggcatgcagtggtgttatcatagttcactgcaacctcgaactcctcgactccagcgatcctcccacttcatcctcccaaagtgctgggattaaaggtgtgagccaccatgcctagcctatttctatctgtttcatttgtcctcagtccacagtagatcccagcccagcacacagtagtagttcaataaacatttgttgcacaaatagagcagatcagtttacatggagctgtgttattttgtatgttccagggtgtggcatgccatgatttatttagcccccccgtggatggtcatctggcttcttacaggcttgtcttaagcattgcgtgaaattaattattacattgctcttagcactggaggaagtgcttaatctgtgttagtgattatcatgactatttgtgttgttattaacacagtgggtgcaagggagacccagatggagatagggctgggggggcaacctagggtgacacacgcacctggggaggaggggcatgtggcttctatggtggtagcccctccctgcccctgacgcgtctctcctgcctgcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtacgtctggcccaccgggctacgagatgcgcttggggggagccaggacggaggaagaggagagagaaagagaagtaaagtcagagaggtgagttggcaggatggggagaaagagagggatggggtggggaggggaatgaataaagagatggggagagaggcaggaagctagagaggggctctgagcaggggccagagggagatgagctatgaagacccacagagtgaagtaacagagggatgggggtgaaggggagaagagagacagggagatggaaggaaaaacgcagaaatggagagacaaaatgagagagacagatacagacacagagttaggccaaggagagacaaagacagatacacaacaaggcaagaggcgaagatgaggagggacagagactgagaaagaaaatcaggcgggcgcggcggctcacgatggtaataccaacactttgggacgctgaagcaggaggatcgcttgagcccaggagttcgagagtagcccaggcagcagactgagatcccatctctaccaaaaaaaaaaaaaaaaaaaaaaaaaaagctaggagtggtggcgcttgcctgtggttggagctactccggaggctgaggcgggaggatggcttgcgctcaggaggttgaggctgcagcgagccatgatcgtgccactatactccagcctgggtggcagagcgagacccagtctcaaaacaaaaagaaaatcagacaggtggggagagacagaataagataggatgttagaagataagagagaccgaattggagatgggaagaggggatgcggggagagacgaagtgagagaggctggcgcggtagcgggtgggggatggggcagtggagggccgttttcctccctccacgagccctgagccctgaccccgcccgccgcccgcaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatgcagggactctgataacacccattttaaaggtgaggaaacaagcccagagaggttaagggaggagttcctgcccaccaggaacctgctttagtgggggatagtgaagaagacaataaaagatagtagttcaggccaggcggggtggctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcagtgagccctgactgtgccactgtatgccagcctgggtgacaaagcaagactccatcttttttttatgttttttttttgagacggattttcactcttgttgcccaggctggagtgcaatgtcgagatcttggctcaccacaacctctgcctcccgggtttaagcgattctcctgcctcagcctcccaagtagctgggtagctgggattacaggcatgcgccaccatgctcggctaattttgtatttttttttagtagagacgaagtttcaccatgttgttcaggctggtctcgaacttctgacctgaggtgatccgcccgcctcggcctcccaaaatgctgagattacaagcatgagccagcgcacccagccaagactgcatctttaaaaaaaaaaaaaaaaaaagactgggcacggtggctcacacctgcaatcccagcactttgggaggctgaggcagggggatcacttgaggtcaggagtttgagaccagcctggaccacatggtgaaaccctgtctctactaaaatacaaaaaaaggctgggcgcagtggctcacgcctgtaatcccagcactttgggaggccaaggcgggcagatcacgaggtcaggagtttgagaccagcctgaccaacatggtgaaacccagtctctactaaaaatacaaaaattagccatggtggcgcacgcctgtaatctcagctactcaggaggctgaggcaggagaatcgcttgaacctgggaggtggaggttgcagtgagccgagatcacgccacttcactccagcctgggagacagagtgagactccatctcaaataaataaataaaaataaaaaatacaaaaaaaaattagtctggcattgtggtgcacacctgtagtcccagctactcaggggcctgaggcaggagaatcgcatgaacaggggaggcagaggttgcagtgagctaaagtcgcaccactgcactccagcctgggcaacagagtgagactccatctcaaaaaaaaaaaaaaaaagaacttgcactcaaggaagacaggagccatggcagggtttgacctaggcgctcagagggtccgccgtcttgctcatggttgggagtggacagaagtgtcagggtgagggtgagcacagacagaccagctgtccaggcaagaaatggcagcagccacaggtgggtctccctctgctgtctccatttcttcccatctgctatggtcctgcttgtgaattctctcctgcttcctctttctcctgcctctcagtttctgctctttctcctaggtttcacttccccacacccagtgattgtcctgggaggaaggacagtatgagtgctgcggttcctttgcctgtgggcatgagagctgttggcagcactgggtctgggtgccagggacctggggccctcccagctcagcataggggtagaaatgtggttactcctctggcctcaggtcccaaagcacacagggctgagggaggagtggggaggcaggagttcactatgcaaggacatgccaacaaatggataggtatagagatgctgaggtctggccccaagaggcagagtcacaagctaggacacagtgactcggctgtaatcgctgcagccctatgaggatgtggtgcgtgtacacatgcagacacactcacacggcgggaaacacggacggtgccccacactacacaaatattcacctctcagagccgccgtggacacacagagactcctgcagggcccgtaacacatgggctgtgtcatttggcagcagctgcagcccacatatacacagatacaaatagagaaagtgtcagcccatcacgtaaacaccacccagcctcggagcctcactgggacacaacacgagcagagacttcaatagggacctggcacaacacagtcatatacaaatatattccacagggtcatggtcgcaaccaccgcacaccagacactgattcaaacagtgtcatgcacgcacacgcatcacggcatcag

SEQ ID NO: 13466 - DNA, 46841 bp, Human
tcccaaaatatacccagtcccttcccccgcagagcccacaggccagtgggaggagacagatgtgagacacataatcatgccaataaatatataatgacaacccaggcaaagtgttgccaaggaaagggacagcatgttgggagtgaacaatatgaggacctagattgggctgggggggccaggcagtgatgcgatggagaagggatgatagagttggggacaaagtgctgcaggaggttgctccaagtcctctgagggggctctttgggtgagaaagcgagagaagcctggggaggcgaggggagggtcacagaaacataaggagtttagggttctgctgaaaggtttggggcagaggtgggaaagggtttggtttgagattgggaagaagccttctgactgttgagtgggagacaggttggaaggagcaacagaagccagcagcccatggccgggcacagtgacccacgcctgtaatcccagccctttgggaggccgaggcgggcagatcacgagttcaggagttccagaccagcctggccaacatggtgaaaccccgtctctaccaaaaatacaaaaattaacctggcatggtggtgcacacctgtaatcccagcaactcaggaagctgaggtgggaggatcacttgaacccaggagatggaggttgcagtgagccgagatcgagccattgcactccagcctgggcaacaaagcaagactgggtctcaaaaaaaaaaaaaaaaaaaagacacagcccagggagacaacggtgaagggccctaagtggccagtgacaaggagctgggagcttgccctgagggcagcaggaggccatgggcaagcagagaagggacagggtaggatttgactttcagaaacagtcctctggttgctaaatgggagaaaggagtgacagtagaggcaggagaaggcaggatcagacgggggtgctgggaaggggcaggtagaagagacatcaggaggccaaacagataggactttatgatgcaccgtaggtataccagtacccaaacacaggtggccaagagcagagggatagacgcccagcctcctcctcacagacatccaggcatgcagagccctccacgtgccaaacacacagggccgaggaatggaagtgcagcagagccgatacgcaggcagcagatctgcaataaccaggacacacagtcccaccagaaggagagagcagtggaatgatcagggctcactgcagcctcgatctcttggactcaagcgttcctctcactccagcctccctagtagctgggaccacaggcacacgccatgatacctggttaagttttaatttttaaacttcttgtagagatgggggtctcagtgcattgaccagtctggtctcgaactcctgggctcaagcgatcctcccaccttggcctcccaaagtgctgggattacaggagtgagttactgtgcccggccaacaaactattcttattcccattttacagatggacaaactgaggctcaggaggccagtcacttgcctgtagcccacagttagtggtagcactgggattccaacttgggtccccttcatgtcgcctgtatttggtgtcccatttaggcgtccatgcaggttttggcgtgtctgaagatctgtgtctccccaagtaagtgtcccccatggatgcccacccagccgtgtcctcctgtctctgaggtttctccaggaatcgagctcctggcctggcttgtctgagtgtgtctgtgggccagtagcatgcccctgcccgtctgggtccctctgcgtgtctctgcttgtcctagcctgtgtgtgtcagtgacgtctaagagtgtgtgtgcgtgcgtgcgtgcgtgcgtgtgtgtgtgtgtgtgtgtgtccttgtccgaggagccgagagagtgagggggaatgaagggccaaggaggcctggctggggctgggctgggggtggaggcggggagaggggcgtcacggcctgagctgagaagggagtggagttctggaggaatgtttaccagacacagagcccagagggacagcgcccagagcccggatagagagacacggcctcactggctcaggacagggggcacagccaccagggtccccttccccctcctcagctccctccctggcccctttaagaaagagctgatcctctcctctcttgagttaacccctgattgtccaggtggcccctgggctctggccctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggtgagtgatgggggctccttggggcagggatcccctcggaggggctggggcaggggtaggaggtgggggatgatggcaggtgtggggggcctgggctggcttagggagtttccttgggaccacagaaaagggacttcaagggagggagacacagactcagagacaccaagtgcggcagagggagagaaagactgagagaggaactgaagggcaggggggacagaagagaggacccggagagacagacagacaaggagaagctgagggcaggggtgggggctggacctgagaagggggccatggggagaggggctgagctgagggtcgccaggaaggaagaaatctttccgaaggggcaccgagtcaggcggcgggatgaggagggctctggagccctgggggaaaacccttctccctgccaacaccacccccctgacccgccacttgtccctaccccaccagtccactccatctctggggaggaggctctcactttgtctctctgtctctgcctccagctctgctatctctgtgggtctctgtttctctctctttcacagtctctgcctttatctctccctgctctctgagtctctctctctcttctcagcctccctctgtgactgtatcccccctccgcccccaccttttcttctctcttgagggctgtttcttcattttttctgtcttgccttgtatctgtgctcctctctgtctcatctcccctgcctttctctggcttctccctccgccaccacccttatctccccccaccaccacccttatctctctcccccaacccctgattcttcccctccatccaccagcaccagcgcgacctgttaagtctctagagacctaagagaggacggagggggcaggggctggccctgccaggcagtgcagggcgtgggaggctgccagatcccgagcctccttcccgacgggatggacgctagatcccagtcccttgggagggctcccgtcctcctctcagagcctccgccctccaccccactctgaggtcactctgcaactatgtcggcctaagggcctggcggggtcctggccgccggtgggcaggcaaggacagggtggaactgagggccggaaggagctggggggttcctaagctaactcttcccatctcccctccaggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcaggtgtgtggccacatccccgaatcccactcccacctccgtcacacagagggcagaaagcccacctgggtgggaaccccagtttgaccacttgtcagccgtgcggctttgagcatgtgatggaacctctaggtttcgttttcctcttctgcaaaatgagttaataataggacatacttcgtggttgtcatgagcttccagactggacaccctctttccgttctgacagaccccctcccagtgtccagctctgaccctgaacctctctgtctctcctcttgccctgtcagaatcacctccctgcagctttccgacacgggacagtaccagtgtttggtgtttctgggacatcagaccttcgtgtcccagcctggctatgttgggctggagggtgagctctggggtcaggggtcctgaggggtcagaggacatgtggcgctcataggttgtgggaagtcaggaatcctgaggggtcaaggtcaaagggtgctggaggattcaggatgaacctagcgtcatacagcctaagaatgtcagagttttgggtggtcaagaagctgggagtccatataagttatggtgccaaggctgggggattatatgttctgggtgaaaagacttcttgggggtagttggatgtcctaggcatcagacaccatcaggtcacaggaggccattctggtcttcagataaggcgtcagaggcacgcaacgtacccctgtccccacgaccccagcggtctcttttttctcatccatagaatgagatgaggatgagctgtcagacattctggaagagagacatgaggagctcagctatcgtggggggtctgacatgggaggaatcagatattggggtcacgtgtgtgttgggtatggctcaggtgccctcggggatcagataaggcaagtcaatgaccctgcagggtgggtttgctgcccaaagcctacagcatcctagtggtgagtcaggcatcttggggcctcagagggaccccagcctctaccactgcccaccccgctaggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccaggtgagtccggggatgtgggtcagctccgaatagggggccgggcagggctgaagtcaggagcaagggaacattgctacctctgcgtgagtgtctgactgtccttctgtccctcactgtctgtctctctcgtttctccctctgagtctgtctctgcctctctgtctctacctatcttatttctctccgtatgcctttttctgtctctttctgtctcttggtgtgtgtgtctttctgtctctctttgtatgtgtctctctctctgtctctctgcttctctctccctccattcaccccggcctctctctgaatagaattctttgtcctgggtttcctctgagctgttccatggctcgagtgcgtgtgggcctggtgcccctttgtcagcccttgacccaagcagggcaccggaatcaaccgtgccctcctctcctccgcctccctccacaaccggcccacctcctgccctaacaagcctgctggcctcagtcaaagggaggatgtccagcccggtccccactggggagatggaacccaaagaagagagagcaggaagaaagtaggagacagaggctgggcgtggtggctcacgcctgtaatcccagcactttgggaggctgaggcgggcggatcacgaggtcaggagatcaagaccatcctggctaacacggtgaaaccccatctctactaaaaatacaaaaaattagccgggcgtggtggcgggcgcctgtagtcccagctactcgggaggctgaggcaggagaatggcaggaacccgagaggcggagcttgcagtgagccgagatcgcgccactgcactccagcctgggcgacagggcgagactccatctcaaaagaaaaaaaaaaaaaaagaaagtgggagacagagagagatagaatgacatacactggaagggacaggccacagtgacccaagatgaacatagacaggacagagaggccgggcatggtggctcacgcctgtaatcccagcactttgggaggctgaggcaggtggatcacttgaggctgggagttcgagaccagcctggccaacatgacaaaactccatctttaccaaaaatacaaaaattagccaggcgtggtgacgggcatctgtagtcccagctacttgggaggctgaggcaggagaatcgcttgaacccgggagatggaggttgcagtgagccgagatcacaccactgcactccagcctgggtgacagagcaagactctgtctcaaaacgaaaaacaaaacaaaatgaaagacaggacagggaagttggagtgacagaaaccctctccttcttggggaccattcccttctgcaccatgcagacgaggaaggaccgagctcagggttatgcagtggtcaggggcatcactgggggaccctggattcagggggttctccctactgaaggaggaaagacagaggagcagatggcagaggctctgtaaaggaaggaggctgcagcctggagggcatcagcttcccgcactcccaacctgctgcctctctctgctggaatgaggaggggccttctgactgggggtctccagggtggagggaggagctcacattctcagcattcctgggaccctgagttgcaaggaagacctggtgagcatgctgaccccagaggagtgactcaggcccatggctcgagtggctgagtagggaccagggttggggatcgggcatgagtcagcctggcaggtcccatgagaaggggaggggagggagagaaatgggggctgcacaggtgtgaggatctgtgcatgtctgtgtggtggtggtggggtgtctggatatctgtgtgttctggatctgagtgttagtgtatccgtcagcacaacctctgtgtgagggtgtgccttggcgagggtggacttctgtggatgtcccatgtgtggtgtgtgtgtgtgtgtgtgtgactaaatatatttccttcagcttggattctgtcccaatatgtgtttggatctttatagcatgtctctctctctacgtttcttaggggttgcccgtgtgtgggtgtctgtgtgtgtgcgcatgatggagtgtaccagtgtcagcctgtgtctgtccctcttttttgtgtttgtgtgttcacagctgggactcactgtatgaaagtaaagtgtgcctggagggtagtgggtttggggctatggtgcacacctctctgtatggaggtggtagtgtcagcccacaggtgtgcagctatgggtgtgagagtgtcctagtgagagcttgtgttcccttgcagaatcagaacgtgtccatggataacttgtgtttcttaccaccttttttcccccttattttttttcaagataagctcccgctgtgtaacccaggctggagtgcagtactgtgatcatggctcactgtagcctccacctcctgggctcaagcaatcctcctacctcagcaccctcccacccctcaagcagctgggactataggcatgtgccaccatacccagatagtttttgaattttttggtagagacagagtctcgccatgttgcccaggctgctcttgaactcctggcctcaagtgatcctcccgcctcggcctcccaaagtgttgggatttacaggcgtgagccactgctctcaaccctcagcctcttaccagctttctgtgtgtgtccatagatgtctctgtggcgtgtgtgtatatgtcacagggtaagcatgttggtgtatgactgtagtcacagacctgtgtgtgtgtgtgtgtgtgtaacagcaccctctgcttctctctggtctccctgtgtgtgcactggcccctgctgcctctgagtacatgacctaaggatgcttaccagtcagcgtatagatgtgtctctgtgtcaatctatgtgtccatggcagtgtctccatccttgtgtgtctgcatcaggcctgcgcatctacgaaactgtgtttttttgttttttggggtttttgttttgagacggagtctcactctgtcacccaagctggagtgcagtggcacgatcttggcttactgtaacttccgcctccggggttcaagggattctcctgcctcagcctcctgaggagctgcgattacaggcacgcctggcttatttttgtatttttagtaaagacagggtttcatgacaggtttgtcatgttggccaggctggtctcaaactcctgacctcaagtgatccaccggcctcggcctcccaaagtactgggattacaggcgtgagccaccgcacccagcgcaaatgtgtttttgtatcagtctgtgtctgggtgaacatgaaacctgggcgcatccagctccatcttatggcgtagatggaggcttggctgtgaggtgtacgcgtcggtgtgtctgtgtctgagcaggtcaaaatgacccttcattgtgtcctggtgtgtatctatctgtccacctcaactccatgtacgctgttacgtggtgtgtgtctctgaatatacagggacatttaagtttctgtgtgtgttggcatcagcctagatgtacattgcgtcgctaggtgtttgtaatcaatgtgtacatgtgtgactgtgtgtttatgtgtttgtcccacgttggcttgtatgcatacatgtctctttatgaatgtacatcagtgtcagcccgcgtgtatatgtgtgagtcacggtgtttttgtgtcactgtgtttgtgacatcagcccttgcatatctgtgtgccgttaacttaccaagcgctgcgtcttctgtgctaataacagcccctgtgtgtttaagtgtgattcattgtgagtgtgtgtgtgggggggtttgctgtgtgaaggaatttcgtccgtttgtgtgcgtctgtccctctatctgactcagggcgtgcccctcctccttccatccctctcattctctggaaaagctggggcggagagcaggggttgtggggggatggtcaggacatctggaaagcacatctggaatcggcctgctcctgtcgtcttgcggtaaagcaagaaccttctggaggggaaggggtcccagttcctcctgtccccttcactcaaggtgcggccgttggggcctgggaagggggatcccggctctggctccgcgcccccgaagccggccggaagcgctggggtggggaggtgcccccggtgactcacgcgggggcaggaatgctgcggtcggaacgggacccggctccagaacccacctccagccccagggcttctccggccggcggcgccagctcccgcgcgctgaccctggcggggccccacgtgccaggtggctggacccgacccaggctccccgcccccactcgggccgcccgcccgggactgtactgtttctcctccgggcggcgcgggggctgcgggcgcggggccttcagggcgcggaggctgcgggagcgggcacctgaccttgtctgggaacggccacctaggaagccgcgactgaggagctcccctaccctcccctttccggcctctgcagactttgcaccattccactccctccgctgacggagaaaaggaaactttgtgtctgcggatggagagcctcccttgccaacgcggtgggaacagaggcgtacacgcacggagcaaacacgagagacacgtacacagatactcaacacatgcacgtacacaccatccacagatacacgcagggtcacaaacataccagctcagaaacacaaacacagatgcacaagcacacgcgtaaacaacacgcagaactgcagtcgcacttacaagacttggtcccagggccgggcaccgagtggctctgcctgcgatccagcactttgggaggccgaggcgggaggatcgcttggggccagaagtttgagagcagcctgggcaacgtggtgagactctcctcttctctacaaaaaaaaattgaaaagttagccaagtgtggtggccgcctgtagtcccagctgcttgggaggatgagacaggaggatcgcttgagccctggaggtcaaggcagcagtgagccgtgattgtgccactgtactgcagcctgggagatagagcaagaacctgtctcaaaaaacaaaacgaaaaacttggtccttcttacatcctagcgcagacattgtgtgtgtgtgctgggggaggggggtgtctatgtttctacgtgtatctgtgttgggggattccccttattcaccaggatacgttctctaagagcccccacaaaagcctgaaacaatgaataatactaaaccctgtatatactacacataactttctttttccttcacaatttcgcagatagattgttttcttactatagatcttagcaacctcagtacatatatatatgattatctttttctaagtggagaattttcaccttttcacttaaaaggaagcactttaaggcttctctttggcctatccgaattgcagccatcactattttgcaccctggggcctttttttttttttttagacagagtctctctctgtcgcccaggctggagtgcagtgtggcgaccttggctcactgcaacctccgcagcccgggttctagcagttatcgtgcctcagcctcccgagtagctgggattacaggcacgcgccaccatgcccggctgatttttttgtatttttagtagagacgggggtttcactgtgttgcccaggcttgtcttaaactcctaatctcaagtgatccacccgcctcggcctcccaaagtgctgggattacagatgtgagccatagcacccggccaggcgattatttagataaataagagtttcttgaactctgcacttgagcactgcagtaccaggacagttgatctgatagctaagtgacttacagacaggtatcagatacagcactgagatgctggacaaaggggggattcacgttctaggccaaccagagtgggatggcatgaggtttcatcacagtactcagaacggcatgcaatttaaaacttaggagttatatctggaattttccattgaaatatttttagaccaagtgtaactgaaacctcaaaaagtgaaacctcggataaagggggactgatgtacgttgtatagcggtttgtgttgggtatctctgtgtgcttgcaggtctgtgtctcttgtgtttgtctctgtaattgtacgtgcttctgtgtgtgcacgctggtcataccaacaccaacaccaccacgttagggagggaaggcaatccaccttcactcgaaaacagttactcaaggccgggcacggtggctcacacctgtgatcccagcactttgggaggctgagatgggcagatcacttgaggtcaggagttcgagaccagcctggccaacatggtgaaaccctatctctactaaaaattacaaaaattagccgggcatggtggcgcgctcctgtaatcccagctactcagaaggctgaggcaggagaatggcttgaacccaggaggcagaggttgcagtgagccaagatcatgccactgcactttagcctgggcaacagagcaagactctcaaaaaacaaaagaaaaaaacagtcaagacacaataggtgaactcccctatggaattacacatgctcatatttctacacctatgcccaggaatgctcataagtacacagctgaacacaatttcactcactcattcaacaagcatttatggcacacctattgtgtgccaggccatcctgacacagcaggggacgaaacagacacaacccctgctctcctagagctgacattctagtgggagaaactgacaatgggcaaggtacttgggtaacaggtaaagtatgttgggtgatgagaagaaccaaagaggaaaagtaaagcgggaaggggatagatttggagaggaagctccaattagctccaattttattgtattttttctttctttctttttcttttcttttctttctttttttttttgagacagagtttcactcttgttgcccaggctggagtgcaatggcgtgatctcagctcactgcagcctctgcctcccgggttcaagcgattctcctgcctcagcctcctgagtagctgggattaaaggggcctgccactatgcccagctaattttttgtatttttagtagagacgaggtttcactatgttggccaggctggtctcgaacttcggacctcaggtgatccacccacctcggcctcccaaggctgggattacgggcatgaaccaccgtgcccagcctttatttttcattttattatttttagtttttttgagacagggtctcactctgtcacccaggttggagtgcagtggtgtgatcacagctcactgcagcctccacctccccgggcacaggtagtcctcccacctcagcctcccaagtagctgggactacaggtgtgcaccaccacacccagctaatttttctcttttttgtagagatggggtctcaccacgttgcccaggctggtctctaactcctggcctcaagcgatcctcctgactcagcctcccaaagtgctgggattacagtcatgagtcactatgcctggccaagctccaatattaacagggtggccaggcctagcggactgagaggtgttgttgaggaacaaaaatgaaagaagagggtgcgagtcatgtagacatttgtggaagactgttttgagcacagggaacagtgcacagttcttggagtggaaacatgcttcatgtatgtgttccagagacactggaggccagtgtggccggagaagagcgtgtgacagggagagtgggagaggggttggtaggaggcgagcttagagatgaacagacatgtctccattgatgtacagccatgggccagtttccctaagtgtgtctagcaggtgtgtgtgctcatacttgtgtccttgtgagttagtgagggtgcctgtgtttgtgcatgtgagtgtgtgcatgtttgtgtgtctccttgtgtgtgtgtgtctgtgtatgcttttgtgtgtctatgtgtgagtatgtatatatgtgtctatgtccatatatatgagcacgtgtatttctgtgtgtgtctatatatgtgtatatgagtatgtgagtatctaggtgtacgaatctgtgtgtgtgagacacagtgtgtgtgtgtggctgtgtctgtttctgtgtctgtgtctgtgtctgtgtgtgagcatatgtgtttatatgtgtgtgtatgagtatgtgtctctggggtgtaagaatgtgtgtgtgtgcctgtgtgtgactgtgtgtgagtctgtgtgagcatgtgtgtgtatgagtatgtatctctctctggggtgtaagaatgtgtgtgtgtgtgtgtatgcgcctgtgcctgtgtgtgtgtctgagcatatgtgtctatgtgtgtgtatgagtgtgtgtctctatctggggtgtaagagtgagtgtgcctgtgactgtgtgtggttgtgtgtcttcatgtgtgtttgtgtatgtgtgtttttgtgtgtgtatgcctgtgcctgtgtgtggctgtgtgtctttgtgtgtgtctgtgtctgtgtgtctgtgtgtatgagtgtgtgtgcctgtgcctgtgtgtggctgtgtgtgtctttgtgtgtttctgtgtgagtatgtgtgtctatgtgtgtgtatgagtgtgtctgtctctggggtgtaagaatgtgtgtgtgagacagtgtgtgtgcctgtgcctgtgcctgtgtgtgtctgtgtgtgtctgtactatgtgtgtctgtgtggcgggaggttagggctgaaaccaagccatccttgtgtttggggatggaggctgtgttcctaactcattgccctcaactctgctaaccctcccttcaggcaagtgcctgtgtgggctgcactgcccctggtcaggcaggccatggtaggagtggcccggcatggccccggagcccttcctgcccctctctgatattggacccttccctcatatgactccctagggctgaacaagacatcctctttctcctgcgaagcccataacgccaagggggtcaccacatcccgcacagccaccatcacaggtgacagagttgggaggtggggagctgggcgtcagagggtggggtttgggtccggggtcagagtgggggcagagagcagggtagggagctttgagcaaaggctccccagggtcaatctctcccgtttgtccacagtgctcccccagcagccccgtaacctccacctggtctcccgccaacccacggagctggaggtggcttggactccaggcctgagcggcatctaccccctgacccactgcaccctgcaggtgagactcccaaacttggttcatttcagtctcaggcctccttccacccacatccacaacccccatcctctccctgggaacccaccacttctcggccactgttgagaagcagtagagcctggggggttaagccagatgtcctgggttcgaatcctagctccaccaccttctggctgtgtgaccttgggtaggtggcttaatctgtccggggctcagctctcttgtctacaaaatggacataatggtagtgcctacctggtatgcttagtgtgaaaattcaatgagtgaatgcaaattaccaacttaaaatggtatatagaacataggaaacaaatttaacaaaattggccaggcgcggtggctcacacctgtaatcccagcactttgggaggccgaggtgggcggatcacttgaggtcaggagttcgagaccagcctggccaacatagtgaaaccacatttctactaaaaatacaaaaattaactgggcctggtgggacgcacttgtagtcccagctactggggaggctgaggcaggagaattgcttgaacctgggaggcggaggttgcagtgagccaagatcgtgccactgctctccagcctgggtgacagagcgagactctgtctcaaaaaaaaaaagaaacaaaaaaaaaaaaaatttaacaaaatgaaaatgatcagctgttttaattattttcagtattagtgatgttaactctagccagagtgggagccctgagacagcagagtctggagccatttctgtcaccactggatacccagaaccctccacttctcccatcccagccctggccactctgtgtggtcactgtctggggatgggtctgtcccctactggaatgtgagctctgacagggcagggctggagctgtcccagtcaccactggctcctcattcttgcccagcacaggaccagacatagagtagggaatattcgctagaaggatatattacaacccagatgagctagacccagcctctgccctcaagttgctcctagaataagaaaaccaaaaccaggccaggtgtggtggcttacacctgtaaccccagcactttgggaggccaaggctggtggatcacctgaggtcaggagttcgagaccagcctggctaacatggtgaaaccccatttctactaaaaatacaaaaaattagccgggtgtggtggcacacacctgtaatcccagctactcaggaggctgaggcaggagaatcccttgaaccctggaggcagaggttgcagtgagccgagatcgtgccattgcactccagcttgggtaacacgagcgaacttccgtctcaagagaaaaaaaaaaagaaagaaagaaagaagaaaaccaaaaccaaaacaaaactcacagatctgtaaatataaggcctaattctggtctgaagttctctgagattagaaagttggagatggggggtggacagtgcctatgatggtagatgacagtaatgaagaatgaccaatttctactgagtgtccgctgtgcaccgggtcttgcattaacgcacacctgctcgtgtgtttgtgaaggagggtctatggatacacccattttccagatgaagaaactaaggctcagagtggttaaccagattgtccaaggtcacatcaaacccatgtcatgctcctaacctccttagaaactgttttttgttttttcttttcttttttttttgagacagagtctcgctctgttacccagactggagtgctgtggcgtgatcacggcttattgcaacctccgcctcctaggttcaagcaattctcttgcctcagcctcctgagtagctggtattacaggcgcccaccaccacgcccagctaatttttgtatttttagtagagacagggtttcaccatgttggtcaggctggtctcgaactcttgacctcaagtgacccgcccacctcggcctcccaaagtgctgggattacaggcgtgagccaccgcgctgggccctgagaaaatgtttagagtcagtgcttgattaaacaggaattgtcttatacttacatgctctgagcacaaccccatctgcttgtcgttttaaacctagaaaatagtggctattggctgggcatgatagctcacgcctgtaatcccagcacttcggggggctgaggcaggtctgtacaaaaaattcaaaaaaattagctcagtgtggtggcacacacctgtagtcccagatactcgggaggctgaagtgggacaatcacctgagcctggcagtcaaggctacagtgaggcaggattgaacctctgctctccagcttgggtgacagagtaagactctgtctgagaaaaaaaaaaacaaaaaacagtggctattaatcttcccgttttcaaggtgaggaactgaggcccagagaggggccccctctctgggcctcagttcctcccatcctcctcccctccccggggctagaaagccgaagctgagattcaatcccagaggccagctggatttgggagacctcaaatgccaggtcaggcataagttgcactctacccacatcaccaagtgtccccaggaaagcagaagtgtgtcctcttccctttccaggtctcacttcctgctgcacatgggctagggctgaagagttccagtgggagggtcacagccgtcccagggaaaagagaagtgggagcaggcatggggagaccaactgtctgtacccatctcctctctgtcctggtagaggttcctcttcctgtctgtcactgcaggtcagagagcaggcatggtgacagcctcaccccctcctcgtacccaccatctgcccccactcctccccaggtctcatggtggtgtcatctccctccatgggggctgtgtgactttgggcaagttgctgaacctctctgggccttggcttccctgtctgtaaaatggggatgagaaaagaaattgaccccatagggtggtagtgcgaagtcaatgagttcatccagtaatgtgcttgacagagagcttggtacatatttggcactcaagaaatatttgctaggccgggtgccatggctcacacctgtaatactagacctttgggaggccgaggcaggtggatcgcttgagcccaggagtttgagacctgcctggccaacatggtgaaacgccatctctccaaataattaaaaaattaggtggggctgtcattacaccactgcactccagcttgtgtgacagagtgagaccctgcctaaaaaaaagaaaaaagaaaaagaaagaaagaaagaaaacaaacgttagctgttgataattataatgtgcaaagcagtttatatgcatcatgtcattaaaccttataccctgacaagtaagaactgtgatgcccattttccagagacagaaactgagactcagagaagttaagacactcactctaggtcacacagcaaacaacatccaacacaggacttagatccaaggaatctggctttagagcccacaccctgtggcagtaaactccttcctgacatactgtgtggctgtatggctggagtctccagggtgaaggggaagcccttggctgcaccattcctgaggcgtggctgtgaattgtgtggttatgggggttttgtggttccatgtggcagggctatacagatgtgtacaccagtggtggccccctccactctgagtgtgccattcctcgggcggaataggtatgggaacctgtgccgctatgcagagcttgacacttgttgccaggaaacacacataaaataataagtgacaggccgggcacggtggctcgtgcctgtgatcccagcactttgggaggctgagcgggcagatcacctgaggtagggagtttgagaccagcctgaccaacatggagtaaccctgtctctactaaaaatacagaattagccgggtgtggtggtgcatgcctgtaatcctagctactcaggaggttgaggcaagagaatcacttgaacctgggaggcggaggttgcagtgagccgagatcatgccattgtactccagcctgggcaacaagagcgaaactccatctcaaataaataaataaataaatagatagatagatagatagatagatagatagatagatagataataaatgacagtatgcacaagcagtcttctaaatgcttacatgccccaattcagtcaaccctgtgaagtggggagccactgtcatcccattttacaggtgagaagactgaggcacacagctagggaatgatagagcctggatttgagccccagatccagcatccgtgctcctcagcactaggctaaactgcctctgtgcacagacaagaggtattgttaccattactgatattcttaccgccagtagagcaaagactctggggacaggatggggtttaggtcccagcttcatcagtgacaaactgatgaccttgaacaagtgattccgtctctctgggcctcagtgttgtcatctgtacagtgggaataagcataatgcttaccacaggacaacaggattgatgtgagggccaaatgaattcagatttgtcaagggctaagaaaggcactcagtacatgttggacgtgttttatctttttttattaagataatatataacatagtcaggtgaggtggctcacgcctgtaatcccagcactttgggaggccgaggcaggtggattacctgaggtcaggagtttgagaccagcctgggcaacatggtgaaaccctttctctacacagaataaaaaaaaagccgggtgtggtagctcacacctgtaatcccagcactttgggaggccgaggggggcggatcacttgagatcaggagttcaagaccagcctgaccaacatgatgaaacctcgtctctactaaaaatacaaaaaagttagccaggcatggtggcacatgactgtagccccagctactcgagaggctgaagcagaagaattacttgagcccaggaggcggaggttgcagtgagccgagattgtaccactgcactccaacctgagtgacagagcaagactctgtctaaaaaaaaaaaaaaaaaaaaattagtcaagcatggttgctcacgcctgtaatcccatctacttgggaggccgaggcatgagaattgcctgaacctgggaggcggagattgcagtgagccgaaatcacgccactgcactccagctcaggtgatgaaatgagactcataggccgggcacggtggctcacacctgtaatcccagcactttgagaggctgaggcgggcggattgcctgaggtcaagagtttgagaccagcctgactaacatggtgaaacgctgtctctactgaaaatacggcaattagtcgggcgtggtggtacgcgtagtcccagctacttgggaggctgaggcagaagaattgcttgaacctaggagacggaggttgcagtgagccaagatctcaccactgcactatagcctgggcgacagagcaagactccctctccaaaaaaaggaaaaaaaaaaaaaagaaaaagaaatgagatgtataacatgcataatcttcagtgtacctctagatcaagctcgtctaacacatgtggcccaggatggctttgaatgcggcccaacataagttcgtaaactttcttaaaacattatgagatttgtttgtgatttttttttttaacgcatcagctatcgttagtgttagcgtattttatgtgtggcccaagacaattcttcttccactgtggtccaagaaagtcaaaagattggacacctttgagattgtttaacacacatattcaccatgtaaccaccatccaaatcaagacacagacccttccagtccccaagaagtctccctcaggccccagagatggccacccttctgcttctagaacattgcttttgcctgtagtataatgtcatataaatggggcctcacagtatcgtgctattattatgatgatcattactattatttgagacagagtcttgctctgttacccaggctggagtgcagtggtgtgatcttagctcactgtaacctctgcctcccaggttcaagtggttctcctatcgcagcctcccgagtagctgggattacaggcgagcgccaccacatccagctaattttttacatttttggaagagatggggtttcaccacgttggccaggctggtcttgaactcctaacctcaagtgatcgcccaccttggcctcccaaagtgctgggattacaggcgggagccaccgtgcccagtctatttgcgttattattgtcatcacactattattatcggtgctgaccacccgccatgcactgtggcatcctttgggcataactacacttaatctttaaacaatcctgtaaggcacttgatcctctaaggccccgtgtgcccaaggaaaaaactgaggctcagagagggaagagtcttgccagaggtggcttttggaagtggtgacagaaccacattgtatacagccaaatgatctccttgctttgcaaatccaggtgcccgtgttatcctagcatggcactgcaacacacacgcacccttgaaaagttgtgtagtcacaccagaccaccaccactgggagctgtgtgaccatctcgtgtgattgcttggctgtcccgtcctcacacccttgcctctcctcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggaggtaagaagggttggggagggacacgtcaccactgccccaccggaccttgcttatatcagtgccacccccattgtcccctttcactcctttacccctcatggcctcaatctccttcccatccaatctctgacccctcagcagcactgcccgctggcctctctcccagcccttctctcccctgtgcttcctctcatgggaggcctgcacgagttgcccacgtgtgtgcccttggcaccctgcacccacttcctgggaacaggggagggggtcaggaagaggtgggggtgccagcttcccctcttccctgtcctccagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgggtgctgctggtgggattggagtggagtggcttggggaggagggaggagaacatatcagggcagacatagatggttgtgaaggttgggtagtacacaattgctctatgcctagggggcacattcagggaaggttcacattcacattctggggagaataagggggtctaagggagggcatggggaatggctgtttttgaaccactgcaaaagcatttcagcagactcatatttactatataacgattttacagcagatagttatatagcaccttggggaaggggtaccttttcctgattttcacaaaggcactcctatcagggctagcaataccctgacatagggagggaggatggaaagggaagctagaaggggatggagggatacaggttaaaggatgaggatgagagatgaaggggaggacgaggaaggatgaggagttggaggatggggagagcgttttgagaaagagatggggcattgagcccgagagtgaaggcttaacagctggggggtaaggttctaccctgatgccacttctggacctcctaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccaggtaagtccaaagccatgcccaacctgcttcaaccctgtctctccctgacagccctgacttactccttgtacctttcagtgttaccgcaacttaggccctgttcctaccctgagccttactgagagctgccctcactcccttacccatgccaacccctcactcccttacctgtgccacggcctcactcctttacccgtgccacaccctcactcccttacccgtgccacaccctcactcccttacccgtgccaaaccttcactcccttactcgtgccacaccctcactcccttacccgtgccacacccttactcccttacccgtgccacgccagtcttgtcctctctgagcacatctcctctctgtcctttcttctcacagggcaagcacagccagtccaccagctgggtaagggcttccacaccccatctcctccttccctaccctcaacacctagtgggggcactgtcaccatgcatactcattgcacatccctttcatgtttctctaactcatcactctaacctacttcttgagtttgtgtggtccttgatggaggtgcctataatggcctagcatagcacattgtaggtattcaggcaatgacagatgagtgggtggatggatgaacaaatagatggatggatggatggatagatatatggagggtggatgggtgggtgggtcaatggatgaatagaggatggataggcgggtgaacagataaatgactggatgtcgagtggataaatggatgggtagatggatgggtggatggatggatgggtggatatatggagaatggatgggtgtgtgggccaatggatgaatagagggtggataggtgggtgaacagataaatgactggatggtgagtggataaatggatgggtagatggatgggtggatggatgggtgggtggatatatggagggtggatggatggatggttggatatatggagggtggatgggtgggtgggtcaatggattaatagatgggtggataggtggatgaacaaaagatgactgggtggtgagtggatatatggatgggtagatgggtggatggatggatggatggatggatgaatggatggttggataaatggatggatggacagatggatggatttgtgagtggatgaatggatgggtagaaaggtggatggatggatgaatgaggtatcctcctcacatccatccctctcaaatatttctctaacaattctcaaacattcctcctacacccattgtcccctctgggcactattatggttcactcttgtaactcaacccactagccttcaatactccttacatcccttcctacatttcttcacatacgctttccacgcttattccaccctcctttcacatatatcccattataatccgttcctcccacatgaccccaaaggcccattgcacaacacacttctcattcacaaactctgcacaccttgtatgcacttaccataccttccacattgcaaacactgaaaaacattgtccacaactttcccacacccgattctccttgcatgcttactgcacactccatagacatcattccctcacccttcactaatcccaacccatctcactctgcacactcaccctgaaccccttgcatactcagcacataatgatctttatttcttacacactccattccacccctgccctttttacaccccctttctgtgcaccccatacttctcatctgcccttctaacatcttttgcatgctcactgcacacttctctcacactgcaattacatccttaaaattccttgctcactccttgtatctaagacttcacgaatactcttcccacttcacacacccccaacttttccagcagccatccaaccctgtatatgcttaccatgcccctttggatatttatttcaccctcattcctggctttatggaaaccattgtggccgggtgcaatggctcacgcctgtaatcccagtactttgggaggcctgagacaggtggatcacctgaggtcaggagttcaagaccagcctggccaacattggcgaaaacccatctctactaaaaatacaaaaattagctgggcctggtggtgcgagcctgtaatcccagctgctcgggaggctgaggcacaagaattgcttgaacctgggaggcggaggttacagtgagccaagatcatgccactatactccagcctgggcaacacagcaagactctgtctcaaaaaaaaaaaaaaaaagaaagaaagaaagaaaaaaagaaagaaaagaaaaagaaaagaaaaaaaaattagccaggtggcacagacctgcagtcccagctactcaggagacatggtgaaaccctgtctctaccaaaaaaagaatacaaaaattagctgggcatggtggtgcacacctgtaatcccagctacttagaagctgaggcaggagatttgcttgaaactgggaggcagaggttgcaatgagctgagaccgggccactgcactccagcctgggtgaaagagtgagaccctgtctcaaaaaacaaacaaacaaaaaaagagacaaagaaaacccttttgtagtcattgcattctcttcaaaagatgttccttagtccgccctccttgcacacgcttcatgcaccatcctacactgcaaggatcttcttccccactcacctgcttatctacactctagtccacccttcttgcacaatcatcacatttctcacactaacctatgctgcttgagatttctccacacccatctcatgttcatctagccctcttggcacactcataacgcgttccacacatctctccctcccattccacactcactgcacactcctcaaatatccattccactcttctgtttttttggatcttggtggcataatatttggtagcttaaagtaaggaaaactgcaaacgcccaaacagggacttgaaccctgaaccctcaggttaaaagtctgatgctctaccacctgaactatcctggcactctcttttttttttttttttttttttgagatggagtcttgctctgtcacccaggatggagtgcagtggcccagtctcggctcactgaaacctccacctcccaggttcaagcaattctcctgcctcagctcccgagtagctgggattgcaggtgtgcaccaccaccccagctaatttttgtatatattttgtttaagtagagacagggtttcatcatgtcggccgggctggtcttgaactccttgcctcaagtaacccacccgccttggcctcccaaagtgctgggataacaggcatgagccaccacacctggcctccatcccactcttaactcacccatcctacaactttcacacacttctgctttaacctgcacttgtatcacatccattgcatgccctgtccagcccagcccattcagatatgtgaatgcatccatcacacacctcatcaagtatgtgcacatctttgccgaggccttctgcctccctcccacatcacccctttgggtcccagagagctggatccaaggcctcatccatgacctgttcctcataccccctgatagtgaaggaaccttcaactcctgccttctcgtggccctggtggtatgtactgctaggagcagtcgtggccgctgcctgtgtcctcatcttggctctcttccttgtccaccggcgaaagaaggagacccgttatgggtgagttggaaccacatggggaggctgtgtggcctgggatggagaggctggaggcagggaggccagtgaggaggctggtgcaggaggagtgatgactaagaatcagaatgagggcaagggaagccaggcgtggtggctcacgcctgtaatcccagcactttgggaggctgaagcaggtggatcacttgaggtcaggagtttgagaccagcctggccaacatggcgaaaccctgtctctactgaaaaatgcaaaaattagcgggaagtgtaggcacacgcctgtggtcccagctacttgggaggctgaggcacgataatcacttgaacccgggagatggaggctacagtgagctgagatcgcatcactgcactccagcctgggtgacagagtgagatcctgttttcaaaaaaaagaatgagggcaagggggtgtgtggaatgaatggaaggcagaaggtagctgcccaaggcatgctcagcaaatgttagcacagagggcaggcagggcttgaggctgagatggtgcttgctcaactgctggttgagtagggggttccacatggtttttccctgccctcacctactccccctcccccccagagaagtgtttgaaccaacagtggaaagaggtgaactggtagtcaggtaccgcgtgcgcaagtcctacagtcgtcggaccactgaagctacctgtaagtgaaccctatgccccactgccctggcctggatctaaaggctgtagagaatctggcctgctgggcttctgtacatgtgtgagccaaaagtttctaaaggccttgggatactagaatgtcagaaccacagaccctagaaataacagatttgtggaaccacaaagaactttcaaggaatagaatcttagacacagtaaatcttagaaacaccaaggctgggtgtggtggctcatgcctgtaatcctagcgcttcggggggccgaggtgggaggatcacttgagcccaggagttcgagaacagcctgggcagcatggtgaaaccctgtctctacaaaaaaaaaaaattagccaggtatggtggtgtgcccctgtactccctgctactcgggaggctgaggtaggaggatcacctgagcccagggaggtcaaggctgcagtaagccgtgatcacaccactgcactccagcctgggtgacagagcaagaccctgtctcaaaaaagaaaaaaaaataaaagaaagaaaagaaacaccaaacctcagagccattggatcttagaagatgtaatgatgatgataatgatgaagataatgacaagaagaaaatgatgatgatgatgaaataatgttgagattagatggtgatgatgtgataaaaatcacaggcaaccctagcactacctatgtggcaggctctgttctaagcattctacatgtatctcctcgtttaaccctcagagcaacccaaggacacgggtttcttttttctttttttttctttttttttttgagacagagtctcgctctgttgcccaggctggagcacagtggcacaatctcagctcactgcaaccttcacctcccaggttcaagtgattcttatgcctcggcctcccgaatagctgggattacaagtgcatggcaccacatctggctaatttttgcatttttagtaaagatggggttttactaaccctgtctttgttagccaggctggtcttggaactcctggcctcaagtgatcaacctgccttggcctcccaaagtgctgggataacaggcgtgagccaccacgcccagccagaggtgggtttcttatcaccttcacttcacagatgaggaagctgtggcatagagtggttaagtcacttgcccaaggccacacagcttgtaaattggatagctgggatttgaacccaggtacttttgctctgaagtctatactatttttttttttttttgatagaatcttgctctgtcacccaggatggagtgcagtggcttgatcttggctcactgcaacctccgcctcctggattcaagcgactctcctgcttcagcctctcaagtagctgggactacaggcacatgccacaacgcctggctaatttttgtagttttaatagagacaaggtttcaccatattggccaggctggtctcgacctcctgaacccgtgcctcccaaagtgctgggattacaggtgtgagccaccacgcctggcctgaagtctatactctgaactgccacactctactacctcttggaattataaattggtagagagatagaatcgatcttggcctgaaaaattatatgcatgtactctacacccttatacttttgaaatcataaaatcttagaactatagactctccattagaaggctggaaagccatgcaaggtctcagccgaggaggggatctcagaggcccagtcaaatctgttctttcggctgggtgcagtggctcacgcctgtaatctcaacactttgggaggcccaggcgggcagacacttgaggtcaggagttcgagaccagcctggccaacatggcgagaccctgtctctactaaaaatacaaaaattagccagatgtaatctgtaatcccagctacttgggaggctgaggcaggagaatctcttgaacctgggaggcggaggttgcagtgagccgagatcgtgccactgcacttcagcctgggtgatagagcaagacaccgtctcaaaaaaaaaaaaaaaaaaaaggaatctcatctttccagttagggaaactgaaatccagaaagaaaatggaagagctaggtctcttcctagcatacagcgagaaagccgccagggccccagggggatgtttggaaagggctgggaaagacatttatttaagaagagaaggaagaagcaacgatgtcccagtgatttaactgagtaacatacagcatccattctcagggtgtgagcctggtcccctgtggtccctgagacctttgcagggggcccataaggtcaaatctattttcatactattaccaagacattatttgcccttttgctttctcattctctcattagcattcagcgcagttttccagaggctccctgacgtgggatgatgtcatccaacactctgacagctgatggaccttgtgcttgtatattcttgttttaaaaatttatcaggctgggcatagtggcacatgcctgtaatcccaccactttgggaggccaaggtgggaaaattgcttgaggtcaggagtttgagaccagcctgaccaacatggtgaaaccccatttctactaaaatacaaaaattagctgggtgtggtggtgcatgcctgtaatcctagctacttgggaggctgaggaaagagaatcgcttgaacccgggaggcggatgttgcagcaagctgaggttgtaccactggacttcagcctgggcaacagagtgagactgtctcaaaaaaaaaaaaaattaaataaacctgataggttttcttttgaggccaggagtttgaaaccagtgtgggcaacatggcaaaaccccatctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttctttttttagagatggggtctggctatgttgcccaggctgatctccaactccaggcctcaactggtcctccttccttggcctcccaagttgctgggattacaagcgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaacaactaaattaaaactatttcatagacatcatgttgagtgaaagaagccagacacaaaagagaatatactatgtgattccatttttataatatttcaaaactaatcgattgtaacagaaatcaagaaagtggctaccccaggagggcaggtcatgttctgttcttggcctgagtgctagttacacatttgtgtttgatttgtgaaaatccactgagttggccaggcgtggtggctcacgcttgtaatcccaacactttgggaggccaaggtgggcagatcacctgaggtcgggagttccagaccagcctgaccaacatggagaaaccccgtctctactaaaaatacaaaattagctgggcgtagtggcacatgcctgtacttgggaggctgaggcaggagaatcgcttgaacctgagaggcggaggttgcggtgagccgagattgcgccatcgcactccagcctgggcaacaggaacgaaactccatctcaaaaaaaaaaagaaaagaaaatccactgagttgcttacttatgatttgtgcagattatacttcaataaaaagaaatatttttgtgtgtgtgttttgtttgagatggggtcttgctctgtcacccaggctggggtgcagtggcatgagctcagcttactgcagcctccacccctgggctcaagtgatcctccaacctcagcctcctgagtagctgggactataggcacgtaccaccacacatggctagcttttgtatttttttgtagagacggggattcgccatgttgcccaggctggttttgaattcctggactcaagtgatccaccggcctctgcctcccaaagtgctgcgattacaggcatgagccactgcgtccagcaaaaagaaatatttttattttattttattttattttattttattttatttttgagacggagtcttgccctgtcacccaggctggagtgaagtggtgcgatctcagctcattgcaacctctgtctcttgggttcaagtgattttcctgcctcagcctccccagtagctgggactacaggcatgtgccaccacacacggctaatttttgtatttttttgtagagacagagattcgccatgttgcccaggctggtcttgaactcctggactcaagtgatccacctgcctctgcctcccagagtgctgggattacaggcgtaagccactgtgcccagcaaaagaaatatttttaacaactggtacagcagggcactgacccatcagggtgcccactggagcaagagcgtggccaggctttacccctttagttccctttgagggaaggttcagggggtccagaggaggagctggggtggaagtagaggggtgctcagggcagttgctaattttaaatcagtgcagaagtatgtcagtgtttcaacaatggatctatccctactggtgggtgaatgtcacctgaatgtcagccctgctccatgactctgtccaccccaaccttgcatgcagtgaacagcctgggcatcagtgaagagctgaaggagaagctgcgggatgtgatggtggaccggcacaaggtggccctggggaagactctgggagagggtgagtcccccggcagcatacacacatccttctgaacttctgagatcctgcacttccacactcccacccaactataggaaatacagtccccacgggccctctgaggtcagtgtctccctctggccccccacaggagagtttggagctgtgatggaaggccagctcaaccaggacgactccatcctcaaggtggctgtgaagacgatgaagagtgagttacgtgcacatgtgtaggacccccagctccttccctatgcccctgagacagaagagagcaagcaagttagccatagcttagaacttctggtgtttccagataggcaatggagcccctgccaggtacctcaatagaaggaattgaatatggggagattagtacaaaggtgggagacgggttgaaggaacaactgggggcagggagggaaaccagagatgagcagcagcaggaagtcacttcccccgctaggcctgaagggtagagggagcaagtggtgttaccagaatccacagctagggacaccaggcaggagctggtatcacagagttagaggctgctctgtgggagctaaaaacccagaatagcactttgggaggccgaggcagcagatcgcttgagtccaggagtttgagaccagcctaggcaatatggtgaaaccacatgtctatgaaaaaaaaaataataatagtaacaaaaaattagctgggcatggtggcacacgcctggagtcccagctacttgggacactgaggtgggagaatcacttgagtctgtgcggcagaggttgcagtcagctatgatcatgccactgcactccaatctgggtgacagagtgagactttgtcttaaaaaaataaaacacacatggctgggcgtggtggctcacgtctgtaatcccagcactttgggaggccaaggcgggtggatcacatgaggtcaggagttcgagactggcctgatctgcatagcgaaaccccacctctactaaaaatacaaaaattagccaggcgtggtggcaggcacctgtaatcccagctactcgggaggctgaggcaggagaatcgcttgaacctcacaggcggagattgcagtgagccgagatcgtgccactgccctccagcctgggcgacagagcaagactccgtctgaaaaaaaaaaaaaattaaaacacacacacgcacacatgggcgacacaaccaccaccaagggaataccagaagcagagagagggtgaaataccctggcttctccctttctccccgctacctgccagtctcccataagggcctacctcccattggcaaatcccaagaggaaaccactaggaaagggagcctgggaaatgtagttttcaggggccggcccactgtgatacatagtggagcaggagaagctctagaatgaggcatacctggctgaatcatttaccagctatgcgatctcaggcaaatgactttccctctctgagcctcccacctgtcatctggaaaaaaggaccctaatgtccccaccttccaaagctgttgtgaggcaaagcacttcatgctgagggtggcaagtaggacatgcttgttaatgtggagtaggactatattatttccattatcagagagggcaggagccatttcagggttacacagcacaggaagtccagggctaagttcttcacacacagggaaggagaagcatagggcattcagattggggctggtggtgaatagagaatgatcctttctgaattacagggcttaaaagcttgggctatgaagtcattacccactcattcgttcattatggagcacctcctgtgtaccaggttattttgtttgttttgctctgttttgttttgttttgaggaggagtctcactctgctgtccaggctggagtgcagtggcatgacctcagctaactactacctctgcctcccaggttcaagcgattcttctgcctcagcctcctgagtaactgggactacaggtgtgcgccaccacgcccagctaatttttgtgtttttagtagagacggggtttcaccatgttggccaggatggtctctatctcttgacctcatgatccacctgcctcggcatcccaaagtgctgggattacaggtgtgagccaccacacccagcctacgttttttgttttttgagacagagtcttgctcgttgcccatgctggagagcagtggcaggatcacagctcactgtagtctcaacctctgaggctcaagcgatcctccccactcagcctcccactggttatagtcttggcctgggtctgaatctcagccgtgcaaccttgggcaagtcattttgcctctgtgagccacagtgtcctgaactgttaaatgggatgatacttgtttgggtccccagggcaggtagggaagtgctgggaagcagcctgggcagttgtgagcaggtggaccctggagccagactgcccgggtttgagatctgcctcttccacctccaagctgtgtgttcccttaggcagactcctaacctttttgtgccttgctttcttcatctttaaaatagagataggccagggacagtggctcatgcctgtaatcccagtgctttgggaggccgaggtgggaggatcacttgaggctgggagtttgagaccagcctggacaacatagcaagactccctctcaaaaaattggctgggcatggtggctcacacttgaaatcctagcactttgggaggccaaggcaggcagatcacttgaggtggggagtttgagaccagcctggccaacatggtgaaaccccgtttctactaaaaatacaaaaattagctgggcatggtggtgcatgcctgtaatcccagctactcgggaggctgaggtacgagaatctcttgaactggggaggcagaggttgcagtgagccaagattgcgccattgcactcaagcctggaggacaagggcgaaactccatctcaaaaaaaaaaaaaaaattatccgggatggtggtgcgtgcctgtggtcccagctactcaggaaggcaagcctaggagttcgagcctaacctccagtgagctatgtttgctgtgattgcatccatcctgggtgacagtgcaagaccctgtctcaaaaaataaaaataaaaaacaaaaacaaaaacaaaacaaaacaaaacaaaaaaccaataaaatgggaatgataatagtagcacctgagaagattaaatgagttaatatatataaagttggccaagcgcagtggctgacgcctgtaatcctagcactttgggaggccgaggcgggcagatcgtgaggtcaggagatcgaaaccatcctggctaacaaggtgaaaccccgtctctactaaaaatacaaaaaattagccgggtgtggtggcacacgcctgtagtcccagctactcaggaggctgaggcaggagaattgcttgaacccgagaggcggaggttgcagtgacccgagatcaaaccactgcactccagcctggacaacagagtgagactccatctaaaaaaaaaaaaaaaaagaaaatatatattttatatatatatatatattatatacacacacacagacacacacacatacacatatcacatataaagtgctgagtatggtgcctggtacttactaatcatgtttgatgaagatgagtgatgatgatgatgatgatgatgatggagtggaggtggagggagagtcctccctctcctcccctcctcctcacgacctttctctctccctcaagttgccatctgcacgaggtcagagctggaggatttcctgagtgaagcggtctgcatgaaggaatttgaccatcccaacgtcatgaggctcatcggtgagagaggggcagattcaaggggtctacaagccccatgggggccatagcagagggaagagccctgcttctggccctgggaagatcaaacttccaggcttcctgctccccgctccttcagggtcagcaggcttccccctcctagtctccctcagcttggaatgtgacctctgatcattcccagaaatagctgaggtccccaggagggctccggaaacgtccctgggaactctgctggaaacagcttctctgcagcttggtccttgccactgccactacccccaaacaatatggtggccagattggatgggtagtgagaaggagaggctggaggctggctggtggggggcttggcttccccttctgcccagcaggagtgacagggctacctggggggctcaggtgtctgtttccagggttctgaacgagagagcttcccagcacctgtggtcatcttacctttcatgaaacatggagacctacacagcttcctcctctattcccggctcggggaccagccagtggtaaggggcgtttaatcattcagtctacaaatattaactgagcatctatcaggtacccagtgctgctcagaccctgggaagaccacggtgaccaggagcttgctctcctggagcatttcttccagcaggggaggggcggatgataaacaagctaataaatacctaagcgagatgatttaaatgtttaagtgctaggaaggaaatacagtaggatggaagataaggaggccaggcagtgaatttgggtggacgtggaagatcttgccgaggaggtgaccgtgaaggagttggggctggggagatgtctggagatctgggcaggaagcgaccccaacagagcgcacagcataggcaaaggctcggaggtgggaatgatcatcgtttgtctgaagaccagacaggagtctggtgggagtgtcagtcaagggcaagaacataggcaatcaagtccaagaggaaggctggagcaagtttataggaccttgcaggccatggagaggggttgggttgaattgtcagggccatgggaaaccactgcgggcagagctaggcttgcacagagggatggagggaggagggatcgcatcaaggactctgttgacctctcctcccacctgccttggctccccagtacctgcccactcagatgctagtgaagttcatggcagacatcgccagtggcatggagtatctgagtaccaagagattcatacaccgggacctggcggccaggaactgcatgtgagtgcctttcagggacctccccccaactgctcctgcactccctgagggagttccctccctccttcttaggatggaagcagggctagacacccgctgagggcaggtcagaactcaggaccaggaaagtcagtaagggggtctgggaaggcttcctggaggaggtgagtcctgaactgagatctggaaggagcatttggatgcggagagggaagagaccagaaggtgggctcagtgcacagcatgaggtgagcaaaggggctgaggtgaccgatgggggtggggacacgtgagctgcatctctgtcccactccatgctgggtgtcttgcctggggctgccctttggaagcggccacactggataagaaaatcaaactccccaccaatggacaagcagaaaatatgccagatggggtgcagtggctcacgcctgtaatcccagcactttgggagtccgaggcgggtggatcacttgaggccaggagttcgagaccagccttggtgaaaccccctgtctactaaaagtacaaaattcagcctggtgcggtggtgtgcgcctgtaatcccaacacgagaattgcttgaacccaggaggcggaggttgcaatgagccgagatcgcatcactgcactccagcctgggcgacagagcaagactctgtctcaaaaaaaaaaaaaaaaagaaagaaagaaagaaagaaagaaaaaagaaaatagtaacctgtagtcccagccattcccaaggcttaggtgagaggattgcttgagcctcgagaccagcctgggtaacaacaacgagacaccatctcaaaaaaaaagaaaaaaagaaaagaaagaacaaaaaatcccccaaaagccagaatagagggtaaggggagggtagaaggtggagggaatggaaccacagagttagaatattagtcttggccaggcgcagtggctcacatctataatcccagccctttgggaggctgaggcaggaggatcacttgtacccaggagttcaagaccagcctgggcaacatagtgaatcctgtctttacaaaaaataaattagctgggcatggtggtgtatacctgtggttccagctacttgggaggctgaggtggaaggattgctagagcccaggaggttgaggctgaagtcagccatgatggtatcacttcactactgcctgggcaacagggcaagatcccatctaaaaaaaaattgatgtatattttacatacactaaaatatacacatgcagctcagctcgatgaatttttatgggtatagacccatgtaaccactagatgaaggtaaagaatatttcttagccccagcaggctccttcatgcctcttcgtcttcccaatcactaccgccaagtggtacccactatcctgacttctcagtgctagtttagcctgttctgaaaagtcatacaaatgggatcatgcagtttgtactgctttgtgtctggcttctatggctcagcatgatgtttttgagatggatctgtgtaggggtagtttgctctttttctttgctgtgtggtatggtattccatcatatgaatgtcctgtggattttcttttctttttttctctttctttctttttctttcttttctttctttttctctctgtcctttcttctttcttttctttctctttctctctctttatctccttccttccttccttccctccctccctctctctttccctttctttccctttttttctttcttttcttttttgttttgacagagtcttactctgtcctttagggtggggtgcagtggcatgatcatagctcactgtagcctccaactcctggctcaagctatccttctgcctcagcctcctaagtagctggaactacagacatgtgccaccatgtccagctaatttttaaatttttttgtagagacagggtcttgctttgttttccaggctggtcttgaactcctagcctcaagtgatcctcccaccttggcctcccaaggtgctgaaattacaggcttgagccactgtgcctgtttttttttttgtttgtttttgagacggagtctcactcactctgttgcccaggctggagtgcagtggcgtgatctcagctcactgcaacctccgcctactgggttcaactgattctcttgcttcagcctcccaggtagctgggatttcagatgtgcaccaacacacctggctaatttttgtacttttagtagagacagagtttcaccacattggccaggctggtctcaaactcctgacctcaagtgatccacctgccttggcctcccagagtgctgggattacaggcgccagccaccatgcccagccatgttctgtttcttaatctgggtgctggttacatgggtgtgtgtgtgtgtgtgtgtgaaaattcagtgagctgcttacttatgacttgtgcacatttccatatgtacagtatacttcaagaaaaaaaaatttcatcaaggaatcaaacccaaggaaggaccttagaatctagcaaagagccaaaattgggaagtcctgaggaagccctttgtcccatcctcacttgacagagtgaacaagaagtaaagcagttcccttctggactgggatgaaggtttaggagacagatccccacccgcagccaggacagtgaggggaggaggtgcagatgtgtctgagagccagggcaggcttcctggtggaggtgactgatgccctgaccctgttcctttccccaatccaaacaggctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtggtaggtgcactcccgccaagagtggggaaccatgggagggcatggcctgaccatcacacactatgcctgggtggctgtggatgcaagggtcacagggacatgtgggcttccctttgcaggggcttgtccacatgggctgggcatgtcttggggtatggtgggcatctctgaatagtggtgtgtacatgcccaggataaatacaggcccacgtgtgcatggtagcaatgtagacagtttaggttagaagaagctgcagtgattatgcgtgcatgtgcgcacactcatagaatgtggacagccagggtgtgcagagtggcacatgagctcatgtgtccatgaagtgtgtatatgtgtgtgatggtgagcatgtgtatgcatccacaaaagttacttattcatgtgtatacccgtgtcaagtattttttatatatatatatttttctttttttgagatggagtctcgcactgtcacccaggctgcagtgcaatggcatgatctcagctcactgcagactctgcctcccgggttcaagcaattctcctgcctcagtctcccgagtagctgggattacaggcgcccaccaccatgcctagctaatttttgtatttttagtagagacggggtttcactatattggccaggctggtctcaaactcctgacctcaggcagtccgcccacctcagcctcccaaagtgctgggattacaggcatcagccaccgcacccggctaaagtattatgtttctatgaatacttgtgatgctcccagaggatggttgtgaacatgtgtacataagtgtgggtgtacccatgaacctgggtattggtgcgggtgattctgtgcaggagagactgtctaattccctctgcccctcacagtggtccttcggggtgacaatgtgggagattgccacaagaggccaaaccccatatccgggcgtggagaacagcgagatttatgactatctgcgccagggaaatcgcctgaagcagcctgcggactgtctggatggactgtgaggacccttaggtctcccccaacccagaattcattccaaacccctgactacccccagatggccctcacaggtccaggactctctataacccagacagaatccctgagaatgctgagtgacccacttgcccctcaccaatgctctgagtagggccatcactaaccagtggggtgcaaatcagctaaaggcaccctttcctcctttgtctgtgtgggctgaatcagccccctggctccccacccccaagccaggtatccttgggtagtgaataacagcacagtcttacctggcggccctgcctttgggacatgcactcccagagacttctcattccagactcctgagcacaccatgcttccccgacatgctcctcaacacctgagactctctgcaaaacccttcagtttgttttattggccttctccagactcaggtctcctctgagatatttgcaggatccttcagggaatgcttaccaaactttgcaatattggagtatgcggagaaggccgtgacatttagctagcactttgagggtaaagagaggatgactttgggtcaggaggagacagcctggggcgtcagactcctcagtccaccttgggtactccaagagctgagacgagtaaaaataacagctaacattttcatataactgactagaaggcactgttttaggtgcctggcatgtgtcaaatcatttggtccttaccacagccatgtgatgtagataggtatcattatgattcccattctgcagataagaaaacccagtcctacagggagggtaatttatttttatttattgacttgagtctcgctctgtcgcccaggctggagcacaatggctccatctcggctcactgcaacctcccaggttctagcgattctcttgcctcagcctcccaagtagctgggactacaggcgtgtgccaccatgcccagctaattttttttgtatttttagtagagatggggtttcaccaccttagccaggatggtcttgatatcgtgacctcatgatccacccgtcccagcctcccaaagtgctgggattataggcatgagcctccacgcccagtctgggagggtgatttatttgccaaagattgcacagctggtgtgtttgttatctatatccccaaatcaagtagtttaaaacaacaaacgtttattatctcacacaatttctgaaagttggatactgggaacagcttagcagggtgattttggttcaggatctctaatgaagttacaaagatatcactgggggctgcagtcatctgaaggttgggactggaggattgctttcaaggtggcttactcacatggctgtagcaggaggcttcagttcgttgccatgtggacccctttgtggcactgcttgagcttactcacaacatggcaacccaggagaaagtgcgaggaagccacatgccttttatgacctagtctcagaagtcacacacaccatcacttctgccaaatcagaagcaagtcactaagtcctgcccatgctcaagaggagaggatttattctccgtcttttgcagggaggagggtcaaagaatttatggacctattttaaaccagcacagcttgtaagtggcatagccaggctttgatgcaagtctgttctggggagctggaaggtctgttctagcaaaccctcatcagaatactactccatacacagacaggtttcccgagacccttcccagctcctgagtctcccaggacccaactcagaaattcttgggaattcccaaatccccatagatggcctcaaactgctgaggctccctataaccctctaaaatgcccccagtcccctgagtgtcctaaaatgtccccaggcttccagaatgccccccttctgagtccctgctcaatctcccacccctcattttgctgccctaggtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctactttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacgagcttctgtctcctcttgtctccttttagctgtgatgtggccccattccctggcaattcagttcccccatcagaaaaaagaagggcttggtagggtcttggaattctgtcctcactagagagggtagaaatgaacacacagatagacaaaaagacatacaagcaaagagatgcaggttctcagaaacccccagtgaggaactggcatacagatccaggatcacagacacacacacacacacacacacctgttccgccgcaaactaacagacacatgaattaatggacacacccaggaggacctggtcacaaatacaaagactgaaactcagacgcatagagtaacacagacacacagaattacacagacacaagcatatttacaaacatgctcaggcagatacccgccacgaataggaagagacacagacctagagtcaagtgacacaaatactcaagagacatgtagagtacaacaggtactcacaaccccgaacgttcagactgacatagaaacacaggcacagaacacctccgatcatcacggacccacaaagggcctccagcgaagaccagcccaccgtgtctggcacgcactcgcgagcgggcgttcgcgggtgtggccggcagcaaatggagaaacccttggcagcgcccggacgccctccagtggcggctcctgagaaccggggacagttcaatccgggccacaaacttttttagaacaaatcattgtgggaagctgggaggagagagagagagaggaagtcggacgtgggcgaggggcggggtgtctggactggaacctctgggcccacgtgagtgtctgtcccgctgctgagtgggtgctgtgtgtttgggttgctgtagtgttcgcttgtagtgcaactatcctgtgttatctttattattcgatgccgcctgcctctgcggaccgtagtgggcacatctacactgcagcggggtgccttacccaaagcagatcggaattggggccgggcgcggtggctcacgcctgtaatcccagcactttgggaggccgaggcgggcggatcacttgaggtcaggagttcgagaccagcctggccaacatggtgaaaccccgtctctactaaaaatacaaaaattagtcgggcatggtggcggggacctgtaatcccagctactcggaaggctgaggcaggagaatcgcttgaacacgggaggcggaggttgcggtgagctgagatagaggccctgcactccagccagggtaacaagagcgagactccgtctcaaaaaaaaaaaaaaaaaaaaaagaacaacaaaaaaaagaactggatgcgtctgatctgacgcacgcctgtttgtttacgactgcggggtgtgcctttgtctgagtagagatagtgtgtggcttttgcgggcttaacgtgtggctcaggaggcagtgggagtctgcatcatgtatcccgattgcgtcttactcgagttttgttttgagttagaggcgacaggtggtgcagcgttagacactgggaagctctgtggcttttgtattcctgagcgcgaaggttaatgacggatccgtggggttgagcttgtcggtacagacgccagacagcccgatttacgggaacagccgattagaggattcgggagagcggtcggtgaacttctggatgtctttcgggaggggaaggctctatggtcgcgtgcagagcgcccgttccacgtcaggtacccgaccatagagcaaggcggccgcggactacccaagggaaggggaggccgtgtcctttacaacttgcctcccgttgttagtctagtttctatagccaaaccttcgggactctctcaactcaaaattttgcttttcctaaaggcaactgggttccttccagattacgaactgtgtatccacttaatctctatttcgtatacctcctcctacagcgaaatttgtgaggcagtcctctgaagcacggccaatctggtgaacttttcctaaaatgagccatcgct

SEQ ID NO: 13467 - DNA, 9074 bp, Human
tgtccttgtgtggcccatgtgataagctgcagtttggaaacatttcttgtgatagttcctgttagcaggcaaacgggagagcctcatcttgcgtgagagccctcccattaaagccttgctggctctgtctgctgaggttttacccaagtgactccattttgaatcttacaactcgcacactactcatgtggaagatttaaatgtacattccaggacctggtgctttctcttccgcctgttctcaaagcagctgcagggtgagcctgactgtgtcatttctcagcttcatctccctttccccaaaaaggtatagatgataatcccctgcaatggcttcaggacacaagatcaagtccttgcagtgcttttgtggcctcacagggcctggatccctgttaaactctgagttcacctcctgcctctctcccctgcccacctgctgaggccacactggcccccttgctgctcctgccacacgggctctgccactgctgtggcctccacctggaatgactgcccccccataattctgcctaggtcactgcttcacctccttttgctttagcgcttcatcaaataacattctatacatttagttatttattatgtttagtttgcccccattgctggtaaactctgtgaggatggatattttggtctgttttgtttacagtcctgtcccagtgcctagtcagtatctagcacagtgggccttcagttgagactttttttgaaaaacggaacatctgcctatcgcaaggactactattattctgaaaatcaccttcttcattagaaagtaatatttatcattttattatagaactttgatcttacttcttgtgacttcattctgcgtagagcacactcccatccttgaattaaatgacaaagcattttatattaactgacaatgactgatgccatgggcaaatcctatttctgtaaataactgaattttcttctggactgcgcatgaggggagaaagatgtctgcagtttcggtttcctggaaaatgaaacctatctcatttgttgcctgtgtcaaggggcagtgcttcagtcggggtggagctgcttaaaaggcctgggatcacaccctttgggaacacatccaagcttaagacggtgaggtcagcttcacattctcaggaactctccttctttgggtaagactgggagggtgggcaggagctacccttcccgtggccccggaccttgggtgggctgtgggctcagggagcggaggggaggccttaagcatccactctctgcccggtgtttttgttctcatcagggagcctcagatgggaagggactcgagccccacctgtccctggactctggaatgtaaggacaattagctttgtccttgcccaggttttcctcaggccttgagggcggcttggggtaaagtgggcaaggggaagagataagtgttaggaggaaccaagtcgaagccattgcaagtccatgcctgggcggggtgttgcttccctatggaaagcttctgacctggagcaaatcactgagccagatcgcgctccctcatctgtaacatgcggaggaggagggtcccatctttttcacgttagtgaggagattacataagagcaggcacctcgcctgctgtatatgccttaaaaatgcgattggttctgatttcttagttttggtgctttttcaattgctccgtggagagataagggagtcccggaagtgtctaagacattggcgctgggactttcaggagaaagaaagcagcccccctggggaaataaagtccctcagggccctgacctaacacaggtcctttggtagccccaactccccaacatccctccctccctcaccccaggatcctttcaaggcctgctgctccacaagctcagagcagcctccctagccccctggagcccgtcacatttttcaggacagtgggaagcaagtcaggttgtgtgcccatcccgtcctcagagctccatcccttcggcaggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctgggtgagtgttcctgggaggggctggtgctgggggcgaggaggcggctgggaagggcgggggtcctgtcccgggacccgtgggagagaaaatgggggacacccgcagccttgctgccctgtcctgtcttctcacagcaggcgtccaccctaactttccatctgggagggggcccggggcaggcagactctggccagatgcccagccctgggtgttccacaggtcctctcccctctgggcccgggcctcctcctgcctagccggaaagggtctatctaccactgagtcccactctcttcagctctcccttcccccagattcaccatcagaattcatctcctttaggagtttaccttgtcaatagggccccgtgtcctatgggatctcacatccagagtatcgattttaacaaaattcttcagctcacttttttcattagtttctgggagatctctttctggttttatttattctcattttcttccttttcaccctcgattcccctccctcaaagtcaacctttctaatatatttaatgtgtgtctgtttttcatatgtatttttgcagaatgggtattgtgttttgtttgcgggcattttaactgacatgcaggatggtgtgctgtagatcccattctattgcttttttccacactgagaaccatattcttgagatccatcagtgtcattcgatgagcatctaatcctggcttctacctgctgacaagtgctcctctgtgtgtatcccctgccctttacctttctgtctccgtgggtggacatccaggggttcccccaactccgccagcacaaatggcacaggcttgaatgggggcacagggcccctgactccgaccctgacttctgacccctgccccaacctctaacctctgtttgagcctgcactcaccctttgctgaccctgtcatcctcagctgccctgagccccaacatctctctcctcagacccttgctgggggcactggaggctagctccttcatgctggggtccctcactggcaccctgttttgcaacttggaggtaactggccctcggcaacacacaccactctgggctcccaactcagtacagagaagtgtgatgagcaagcaagggcctgggccacgcccagcagtcctttctgtttgtcagaaatgcagatgacttctcagtttaagatcaagcaattcataaaattaaaataataacagctcaacttaagcaagcgcttttatgttctagtcacttaccctagcacttgaggtttgtcaatttaattctcataacaaccccagaggaagataagaagataatatcgtcccttatttaccaactgggacaatttactgttgtccaagtgctctgggcaggacagaagggtgtgggtgtgctgcttccaggcttggaacaggaggtagaacaatgaacaatgacagaaagtattaataggccaggcacggtggctcacacctgcaatcccggcactttgggaggccaagaagggcggatcactcgaggtcaggagtttgagaccagcctggccaccacggtaaaaccctgtctctaccaaaaatacaaatattagctaggcatggtggtgcatgcctgtaatcccagctacttgggaagctgagtcagaagaatcacttgaatccaggaggcagaggttgcagtgagccgagattgtgccactgcactccaggctgggtgacagagctaagattctgtctcaaaaaaaaagaaagaaatattaatagaagtaggaaaaggttggagggaggtctcagggtagggcaggttctgaatggcacgaaataatggccaggctactccgccgtatgaatgcccatcagctgagcctaacaggcaggcctccagacacaccgcagccagttcctgagggcttttgtgtgtcagggtgcaggtctgctgggctgccagccaacttgacatcacctctcttgcctgccaataaaactgaaccttctaacgaggttatccattcctgattccctgggctcataacccttctaggtggcctttctggtcactcaggggtgggccttcatacctgcgtctctttacttcctcccaccatcactctaaggcctctccctgggagctggctgagctcactcctgcacatttggctgtctttagaactcctggtcccaaattgcagttctggcccctctggctgctggggaacataacctctgcctgctccccaggggctcaccgtgtgggggagcaaatcatgtatatccagtgctgtgagtggctccagtcatggaggagcaaggatgagttctgcctggaagaatctgggaaggcttcctggaggagggaacaatggcatggaccttgaagagtcagaagctttcaattcattccattcaagcattgctctcatgtggcattcaagcattctatagtgcttgccgtgactcaggcgcacagtgcaaaaggaagcacatctttctctgccatgaggacttattagtgtctgaagagctttttctggactataggagaaagtcatggtctccctcactaataaacactgaccctgcttcggatgagctaacagccctgctcagaaagcatgacacccatcctgttcacttttccctgccccggtcaaaccaccaagccctagatttcattgccaagtatcctgtatttactgggaatggacatcacagtagcatgccttcctagccacatctatgaggttttgttcattttcattctgctttttgtttgagctaaacctgccttgggaggcagaaaagaaaagataacatctgattcccccgatcaaccaaccaatcaactaggtcagggccacgtaaattcattcaggacaagcactgaggtcaaactccccagtgatcctcaccctcctccagaatttccacttcccgaaatgaagcaaagagcggtagacaggagtcatcccttcttgtggctcccaacctggggcagccccctgcctccctttagatgggcaatcggcttagaaagtggaggggaagccagtgtggatctactcacagaatgttcttttggtttccagccaggattgctacagttgtgattggaggaggtgagtctgtggggaaggggctcaagtaaccacctgcccctagggaggtggacttggggagcagctggccttgtccatgccaatgtttccctcacatgggtggtcaggggaggaggtggggatgaggggctaagtatgaaccaaggagctagaaatacagcactggaagctggaagcagggggcttggagactgggagctggagtgcgtgtgggcagggtgtggcagcagccggcagaggccatttccccttggcagaacattcaccatgtgaccctgagcatgtctttgaactcctctgagctcctgtttcctctccagagaaaaggctggtaatgcccattcagggttatggtcaggattgcatagggtgaaacaatagagattgaacacagtagacatgaaagagatgccagggctcagctccctttggtttagttgcttccagtgtgctctgtggcaacaccacggagccctagagctgtctctttgagccgctctgaatgtgcctcttacataatctcctgggcaacatctgctcccctaatgagatttgctccccagcaaagataagaaacttgccaaccactcccctggtccagcatttggccaaggcagacactgaggctctgaggacaagtggctttcccaaggaaggtcctgctgcccagaagagcttggcccagagccctgtgcccagtgaccccactagcttttccctctactttccccgcctggctgtgctccccttgattcgtgcctattggccgtgcccatagtctctcccaagctcaaagttcacctctttctccagatcccctggggtccccaagcctgactcagtgtatctgggggggtcccttctgagcccacgcaccgacccagctcctcttccctgcagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggtaagtatcctggcggggcttgctggggagggcgatgaggagggcaagagcctccaaggacccagtcccaatctcaaccctatgaacctcaatctccctgttcctctgtctctctctacacattctctcagggtttctctgagggagatggaggagggagggaaggagcccaagccaggaacagtgcactcaggaagactcagcccgaagcagatttgctgggttacctggggcgtctcctcccctctggggtgcagcctccttccctgaagagcgaggctgcttctagctctggagttcaccatgggggttcatgcctgcagcagcctctccccaaacaaagaccccgagggtactgggaaacagagaggggaactgggtggggtctgtaagcctcagcccctgctgagggtcactggagtctctgaccccacagtcctgcccacagagcttccccgacaggcatgtcccactctgtccaccctctgcttcttcccaggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttcccagaatctcttcttctcgctggctgtggggcaggcccagcatacttggggtggggagggggcatgttaggctcaggagtatcaggaaacgcgttcgtatgttgttttgctccttctttccacaccctctatgagcacatgctgtggtccaggcactgggctgggccccagggaacagaggggacacagctcggtccccttggtcccctcaacccccacagccagcgacactcacggtctgctgaagggatggacccacaggccgatggccatgggcacggacctctgataagtgctatgccagaggccagcccatggctctgggggccagaggcatgttgaggaaggggagtgtggattttatcctgaggacttcggagaggcactgaagggtttcaacaggccagcgaccacagacactacaaccccgcgcaccctgccctggggaggggtcatgttaggctcaattctctttccccacactgtcatcacaaaaacttgggatgtgatgaaccgaaatgaatctaaatttgaagacaagctgtcccctcccctgctacaactccatatataaccctgggcaggtcacctcctctctgaacctgtttgcccctctgtaaatggggagttgaactaaatgaccttcaagatcccagccagggtttgtgtttggctcagttcatgtggctcaggtttgtgtttggccgtagtgtctgtgatcactgcaaacagagtgagtccctgtctcaaaaagtaaaaaaaaaaaaaaaaaaaaaaaaaagaaattatccgggtggctctgatccaatgacatgagccctttgaaagcaaagaagcaaagagcagcagaactgtgagtctagtgctacagacatttcaaaaacttgaacaactcatccatgtctcttaattgggtcaacgaagcatggtttattgcttcattgcaacttaattgtttattgcaacttaattccagccataggaattaagcttctcaagatattctttcaatacgtgattcttttcccccacctccccctttctttgatgccttggggaatctgaaaaaagctgtgaaacttctccccacaaaatgtacacattccccaaataacaccctcattgtcagggctttcattagaacatcagaagaccctcattggaatgaaaggtacaaccccccgcattaactagaaatccaagcccttccaaaaggaaagcacttgggtctgacctgcgtctgggacgatggacgagcctgcatcccagctgaagcccagtaaatggtcctgcaaggcaggtcaccctggagcacccattattctaggtgtgagtcctgacctcctccctcgtccccctcatgaagatgaggccttccggttcccagaggacctgtttccattctggcactgagcccctcacccccacctcggttctgtggctctcacccccaccttggttttgtggctctcacgtggttctttatctttaaaccctcagcttcgacctttgtagcaggcagaattctaagaatggtgcccaataacctccctagaataatcccctcctctctgggtgttggtggaacttctgagcatgttgagctatcactcctgtgattttgttacattaatggcaaaaaggagattatcggctgggcaaggtggctcatgcctgcaatctcagcactttgggagaccagagggattccttgaacccaggggtttgagaccagcctgggcaacatgatgaaacttcatctctacaaaaaaacacaaaaatttagccaggcatggcagtgcacacttgttgtcccaactactcaggaggcagaggtgggaggatcacttgagcccaggaggttgaggctgcagtgagccacaattgtgccactgcactccagcctgggcaaacagagtgcaaccctgtcttaaaaaaaaaaaaaaaaaaaaaagaaaagaaattatccaggtgactctgatccaattacatgaaccctttgaaag

SEQ ID NO: 13468 - DNA, 23094 bp, Human
cgggaggctgaggcaggagaatcccttgaacccaggagacggaggttgcagtgagccgagatcacgccaccgtactccagactggatgacaaaggaagactccgtctcgaaaaaaaaaaaaaaaaaaagaccatatatggctattacaaacctcaaaacattccaaatgttcaatatcataatggacaatattctttgaccatagtgaaataaaattggaagtgaataacaagagaatagcctaaaattctaaataaactcagtgacatattactaaactacactctggttttaaaggaaaccagaaaagaaattttaaaatacttagaaaaaaattacaatgaaaatagtaattatcaaaaatgcgtgggacatagctcactcagtatttagatgaaaacttgtaaccttaaatacatttatgtggagactggaaatattaaaatgtaagaaagctaagcatttatctcaagaaaatagaaaaaagcacaacagaccaaaacccagagaatttaaaggggtgattaaaaaataaagatataaacagaaatcaatgaaatatcaattttttaaaaaaccagtaacaaaactaaaaggtggatctttggaaagattaattagctatatagatctctgtaacaggacttatcaaagggagaaaagacataaacaaaatacagaacaaaaaaagaaaaaagaattactgatataaaataataatgtaaaaataataatggagaggcctaatgaataactgtagtatttaatttgaaaatctagatgaaatagataaattcctagatataaagttcaaacttgccttataggataggaaacttgaaaagaccaataaacatctacaaaactaaggtgcctccaaaactgcagacccatttgtaggctctactctcctcttttcccctgggaagagattccctcatctctggatggaagcaatgatgctgtcaacccaacagagagcaaagaaccctagcgaggcattcacaatgcctcatccttctccacactgtgatcaatcagtcctaaggggggcaaccacgccatagacttttggggggaactgttatgaacattgagaaaaatgagaatttctctccttctgatatcaactaaccagttagaactaaataacccagagctactgtggccacatttgtccccaatgcagacagaataaagtagaagaaagcagagctaggaaggaataaaaaaaaaaaaagacagagagagagagagaaggagagatctgatgcctgatttagaactccgtagatccatgcctgaagtcctttccacccttggacctctcgttcattcctttttgctttaaagcagttcaaatttgatgtctgtcacctgtaatccaaagaaaactgatgaaaaataaaatgtggggaaaggggaaggtgctagactttagaattgaatggccttggatttgaatctcaagggcgtttaacttaacttccatgcagctcagtttcctatctaaagaggagtgacaatggtacccacttcacagagtcattgtgaagatttcgtgagataatccagaggaagcgcttggcagatattattccatgtctgtctctcccaccagactaagaccactggaaggcaggaccttgcccaagtcatccccaattggagctaaacacctatttttctttttacaagtatctgcaccttggtgctaattaagggcacctaagacatctctgccaactgacacagggcaaccacattgatgcaactccagccacattttggtattaaaaaaagacttcatagaattgaacgcagagcaaagttaatttgcagcatttctgtgtttactcagctctcctgacaaagcctcccattggttaatgactcgggggagaggactaccaagcggtgaaggccactggcccctctaaccattaaccacccaggaagctggcaaacaaaatttaacaggcagcatccaccgcaggcttactgtacacatgctagggtccaggacagcaggaccaagccagcagaaacagcctgagcccaccgcagactgtgagtaacacctgagaaccctctgtccctccccctgcccagcctccagagcaaagccatggctgcagctcgcttgtttggtttgttgagatgctttgtttttttaaagggcacattgaacattagggcagccagcagtgttatgaggcaatctggttaggattttccagaccccggagtctgtgagtcatccacaggggttccgatgtcccctgggttcctgccatgcagggggctgacacagagggctgtagctaagaaccattctcgtccactgccatgattgatgctcctaagcccagccagatagccacaacagccacaacagccacagagtcgcagcctgcaagctacaatgcatctgctccagtcggcaccaccgatgaaggatgctggccgcgggtcagggcctgggagggctcagctggcccagtgcaggggtattcttctgagtcacgcagacctgtctccaccatggctcctcactcagtgacctggggcagagataatgcacagagaacagaactgtctgcactgtaccacatgtcatgaggtttcactacagaaggtcaagaactgtgcctggctcatagggcatttgtgaaaacagagaacacagtgaatatttactaagtgagtctcttcagagatgaggaacaaagagggcatacttgacatgaaatgcatgaataatattgatactctgcatttttatatggctgggtacttttttgtttgtttgtttgtttgttttttaagatggaatttcactcttgttgcccaagctggagtgcaatggtgcgatctcggctcactgcaacctctgcctcctgggttcaagctattctccagcctcagcctcccgagtagctggaattacaggcacacaccatcacacccagctaatgtttttgtatttttagtagaaatgggtttcgccatgttagcaaggctagtctcgaactcctgacctcagatgatctgcccacctcagcttccaaaagtgctgggattacaggcatgagccaccacacctgaccatggctgggtactcttaagagctgctttactcatcattttgctctctgtagagataggcagaatggcatggcacaagctccgatgtcagacatctaggcttagaattccagctcagggggagttactctgtctccctggatctcagttttctcatctgtaaaatgggccccaggatgacccattaagtgaggtcacataagccaagcactgataacagccacgtctggtattcacaacaatattgtggggtggatggagttttcaccctcatcttagagaattaacgcaggagaaggtgagacatgcaatctccccagagctggcaggggagcccatcctaccattggcatcataccgcacagggcctgtgcctgagaggagatcccagataggtatggcagtgaccaaagctaagcaaagatttcactgcctgtcatggggcaaggccatagagaagcacagatacaaggcttcctggaggcggtgacctgggacctgagtctcaaaggacaagatggagtgagccagatgaggcagggagatgagggacctacagactggagccacataggcaggactgaggcagatccatctttgttccctgctcccagtccagagctgggctcagcaaacatggaaaaatcaaaatgacctgccctggggaactgcagtgacctgtcttgctgtaacctgccctatagtgatgtgacatgccctgccctgccccacagtgggagaaaaggctgatgtgtgctggaagaacccctggcacccagtgttgctgtggctgagaccccaaagggccagatttgaggctggaggcagaactgtcaccagggactgggtcacaaagaccccctgggctacattagtgagaatcagccctgtggtgggcaatggggagtccctgaaaacttcaaagcagaaccgatcagcttgaatttttgagaatttaaaaagatgcagctgcagatgggtaaaagggctggagggagttgaacaggaggcagggagacgaggtaggggctactgctgagtcctgagagagatgaggaggctgtgcagaggcactggagaatagacaaacaccagaaaaatgggtaaggctagaggtgttattatcagctctattttatactgtggaaactgaggcagagtttaagtagcctgtcccacatcacctaattcatacatggcagtgctagggccccaatccagcttgatctgccacgaaacccaggatcttttctgggtttcgcgacaaaagaattgtcgcgaggacccagaaatccaagtcagaaacccgatggagaattcaataaagcccatcatttgggtgcggggagtggggagcaggtcacacctgcctctattatctaaagcagagaactaggggctagagcagccaacaggggttgttttccaccctggtgagataagggagacacgcaaggagggttttgggagactcaggagaactaagggttttgcgggggagttcccacctgtcattcttgagattctgcttttggaacacaccagggaaggggcctctagggaattccagagcagaacagtggttcccacgctcggagcgcacctgttaaaagaaaactttagacaaattaaacgtagcagagtttatttgagcaaagaaacaattcatgaatcacacagcaccctaaaccagtaaaggttcagagagtgccacccagcaacgtaggcagtatttacaggcagaagaaggaagtgacatacacacataggctgataggttacagctctgtgtttgccttgtttgaacatgtctgagcagttggcaggctgtgattgactgaaagttcagctgctatgattggctgagacttggttacttgttacaaacatatactctcaagttaggtgcagtttgtttacatattaagctaggttacagtttgctacatgaggaggcagctttagcccatctttaatttaatttaacacaacacaacctcctggagcactggtttaaatgagggttcccagcccctcacccagaatggctggttcaacagtgggtggtgcagtaagacctgcttctcctgtaagcatcctgtatttattgtgatacaggtagctccacacagcacagggcctgaaaccactaaccttgcaggcaggcagtgtccaccgactgattccaaccttgggtggattttttttaattgctcttatggaactctttttaaatcatttatatttaattttttccttaaatttgtattgtgggaaaatataatacctaacgttttaactacaagcatacagttcataaaagtacattcacattgttgtgccaccatcaccaccttccatgtccggaactttttcatcatcccagactgaaactctatacccactcaacaataactccccaatctcccgttgccccggcccctggtaaccacaattttacttctgtccctaggtattcggctactctaggtgtagaattagactctatttgtccttttgtgtctggcttatttcacataacataatgtcttccaggttcatccatgttgtaggaaatgtcagaatttcattcctttttaaagttgaatagtattccattgtatgtttataccagactttgtttattcattcatccattgatagacatttgggttgttttcatcttttggctatggtgaataatgctgctgtgactttggtctacaattatcttttcaagttccttgactagctgcttgcagttctttggtgtatatactcgaagcaaaattgttgggtcaaatgacaatttgtttaatttttaaagaactgtcatattgttttccacacattgtagcactttatattcctaccagcaatgcataagggttccaatttccccacatgcaatgctaacatttaaattaaaaaaaaattttttttaaaggaaatcttgctatgttacctaggctggtctcaaactcctggcctcaagcattcctcctgcctcagctttcagagtagctgggattacaggcacgggccatcatgcctggtgtgccaacttattgttttctgttttgtttgtctgttagtagccatccctgtggatacaaagtggtatctcattgcggttttgatattcctaatgattagtgatgctgagcatcttttcatgtgcttactggccatttgtatgttgtctctgaaaagatgtccactcaagtcctttgcccatttctaactgggtttatttgttttgttgttgttcttgggttttaggagttctttatatatcctggatatcaattccttatcagatatgaaatttgcaaatgttttcccattctgtgagttgcatttttactttattgatagtatcctttgatgaacaaagttttcaattttgatgaagtccaatttgtttattttttattttgttgcccatggctttggtgtgatattcaagaaatcattgccaaagccaacatcatgaagtttttcccccatgtttttttctaagatttttataattttaactcatctttaggtcattgatctattttgaattaatttttgtatatggtgttaaaggtccaatttcattattttgcatgtaaatatccaaattttcagcaccacttgttgaaaaggctgtcttttccccattgaatggtctggcatccttgtcaaaatcattttactacatatgaaaggcttatttctgggttctgtattctattccattggtctctatgtatgtctttatgccagtaccacactgttttgattattatagttttgtagtaaattttgaaatcagaaagtgcaagactttcaactttgttcttcttcagtattgttttggctatccaggtcccttgagatttttatataaattttaggataaatttttctatttctgtgaaatacagaactggaattttgataggaattgcattgaatctatagactgcattggatagtattatcatcttagcaatttcttccaatccatgaatgcaggatgtctttccatttatttatgtcctctttaattgccttcagcactgttttgtacttttcagtgtatgtctcttacctccctgattaatccctattttattctttatcatactattgtaaatggaattgttttctcaatttccttttcaaattgttttctttgttagtggtgggaaatgcaattgatgttagtgttttgattttatatcttgcaactttgctaaatgtgtttatgagttctatagaatttttagggttttgaacatataagatcatgtcatctgtgaacacagacaattttacttcttcttttcaaatatggataccttttctttccttgcccaattgctctggctagaaattccagtgctatattaggtaaaagtagtgagaacaagcatccttgttttgttcctgatcttcggggaaaagctttcagtctttcactattgagtataaaaggttttataaatacgtagtcttgattatgttgaggtagttttcttctattactaattttgttgtaggactttctacttagtccagctaaacacggggtccttgtcacatggccatgaaagattaggctcacagacactttgaggtgtgaataaaatggaatttattgggtgaaaaggaaaacaactcagcaaagcaagagagagtcctgttaacaggccctcatctgactgactgaatccccagattaccacatcggatcaggagagagaggccaagctcctccccgctgcaaagggcacaaacttcccacagctccaccccattctcccagtgtgcaggccaactgaatgttctccaggcacctctttacacttgactgtctcaatctgctgtgtgtttttatcatgcgagggtgtgttgaattatgtcaaatacttttttctgcaccaattaagatgatcatgtgattttttcttttattttgttaatatgatgtattacactgatcaatttttgtatgttgaaacatccttgcattacagaaataaatccaaattgggtatggcatataatcctattagtaggctctcaaaattaatttaatccattatattagtcagggttctccagagaaacagaatctataggatatatagaaatatatataagaggaggcattatgggaattgccttatgtaattacagaagctgagaagtcccacaatctgccatctgcaagctggagacccaggaaagccagccatgtaattcagtctgagtctgaaggcctgacaaccggaggagccaatggtgcagctccacaataggaaaagggcctaataaggctgctggtttaagtcccagagtttaaaggtccaagaagcaggaggcccagtgttcagggctggtaaacacagatgtccagctcagggacagaagagagaatttgcccttctcctacctctttgttccattcagcctttaatagattaaaaatgcccacccatattggtaaaggtggctgtctttaactcaatccactgattcatatgccaatttcttccagaaatactgccacaggcctcttttatgtaggcactaattccttttatgagggtagagcccccatgaataggtttccacatatgaatttgtggggacacaaacattcaaaccttagcagctggtaaaacattatttttgagtgtgtctgggacaaaataaattgagcaaaaatggacataattgaagggtgaaatcgttctacagcaatttagacacttcaatatctcattctcaataatggatagaacaaccagacataaaataagtaagaaaatagagaacttgaatatcacactaaaagctagatgtatcagacctatacagaacaccctacaacaacagaatacacattcttctcaagtgcaaataggacattctccaagatagaccctatgttaggccacagatcaagagtcaatagattttaaaagacagatatcatactaagtatcttcttcaatcacaatgagatgcagttagaaatcaataacagaaggaaaactggaaattttacaaattgtggaaaaaacaacacactctttatcaaccagaggatcaaaaaagataccaccaggggaattagaaaatacttaaagacaaacgaaaatggaaacacaacataccaaaacttatggaatgagtgaaagcagtgtgatgatagaaatgtaaagctgtaaacacattaaaaacaagaagatctcaaataaacaatggcatatattcaaattcaggtgttaactttaggatgctaatgtaatccccataataaccacaaagggatgagaatagaattattaaagtgtttcaatacaaaaaagcatttcagtacaaaaactaaatacaaaaaaggacagtaatataggaaatgaagaaccaaaaatgttatatcttcttgctgtactgaaaactttattaatatgtcattgccctgtcttttggaacttttttaattcaaaatctattttgtctaatattagtgtagtcacccctgctctcttttgattactatttgcatggggtaacttttccatcctttcactttcagtcagtctatttacatttttggatctaaaatgagtctcttgtagacagcatatatttggatcatattttagaaggctaatgtgtaaaaataatttttagtctttgtttataatttagagactagaaaaagagcaaactaaactgaaaaatagcagaaggaaggaaataataaagattagagcagagataaataaaatcaagaatagaaaaacaatagagaaaataaattaaaccaaaatgtaatatgtatgctcataatacatttagtccatagtatatttgatataaccagctttacttcaatagcatacaaaagctctgcttccttatagctctgttcctacctgtttccagttactgatgtaacaaattatatctacacatcatgtgcccaaaaacataacttataattgcccacgcatctacctttaccagaggtcttttatttcttcattcagcttaaagttactgtccagtgtcctttcatttcaatccgaaataaaatgcctctcatttcttgcagggtaggtattgtggaaaaaagcttactcagcttttgtttttctgggaatgctttaattgtgttttgcttttcttccagcattttgaacatatcctttgggtgggttttaacctttctgagcacctatttctgcctgcctaaaatcatgttaataatacttgctttaggagtgttttggtaatggttagatgactgaatatagccagactacctagatcagtgttgggtacctgtcaggcactggataaatcataacggctgttattcatatctccagatgaggaaactgaagtccagcgccctctgtgatgtgctccaggtcacacagccagtgtggaggaaggaactggggcttgaatggggtcttttgcctgcctcctcttgcactacgccccattgactcagagactgccacagcatctaacaagcttttctgatttggcagggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgactatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggtattcccacccatccccatctgaaggcccatccactatggccaggaataacagccgctaaaatccagggcacactcttgggcaaagtctttgattctgtaaagcacatacacatctgggaatctccatcttcaccacaatcctgctgggtaggtggaattatattattttacaaaagatcaaaatgacacccagaagggttgaacaatgtgcctacattctggcaggttggtttgaggcccacacctgtaaccatgaacagtctggctgcttcatgctccacaaatgctgactgtcaagcactgggccagggactggaaaaatggcctagaactagacagaaccccacccagccccttgggaactcccagatgcccccaaagccatcctgcacacactgctctgaccaggtcctgcttcagtttttcaatcttcctgttcataaaaacctggaagctctaggggggaatgcacttccaggctttttccagcttctagaagccacatggcctgtgggcctctcttattttcaaagccagtaattgcaaattcccacctctgcttccctcatcacatctctctgattctgactttcctgccttcctctttgacttacaagaaccctcaggattacactggataatggcccacctgggtgatccagaataggctgcccatctcaaggccagccgattagcaattatgattccctctacaactttaattccccctggacatgaaagctaacatattctcaagttctggggattagaatgtggacattttggagggctgttattctgcctgccacaaagcccaggcctcttctgtctcatgagccctcttgcaacttatctgactgcctaaaacatcttccctcacttcaaatcttagctcaaaagtcacctcctctgtgaagcctccccagagtcacccaggaaagactttgccctcatatgcatgctcaacagtttgcccatgccttgtttgggcaatcatcttgccataacatgttgtttagcacccaggtggttgagtttcagttaagcaatcatattcaaaggaatgcaggtaaaacagccaaaataagcaaactaagccagtatctctactgaacatgtgtctctcgacaagatcatcagatcagaggagatgtgatccccagccaggacccctcatgcccccttcccctcctccccagctctctctcaggacctcccatcagactgtgcccacctcccctcccatcccgcacctccttactgcctggactgccttagcatctctacgagtccttcttctctacctgcctctgggtctttcctgctctccagcacaaggctgggaactcccaggagaggccgccctcttcgcaggatggtgaggctgagaggctgaccaggcaaaggcagccttcctaacacctgactatgggagggccagggaggctgggaacatttgcccagaaactcttctgtgtgctcccacaaattccatagaccatctcccccacgagactgtgcactcttgtgcagggtatctttgtctctttgggagattccagtgcccttgtttaatgcttggtgcatggaacaagctcagcagtggttgcacagaggttcaggcaacacaacctggggaaaaggcacagtaaacccaggtgcagggagggccctcctgagcctgagagatgcctgagcacatgtggtggaatgggtgctggtggaacgggtgctggcctggtgtcattctgtacgaggtttcacagtgtcctcaggaccacagtggggctaagtggataggagatcacagctttaggttacaaaatcagagaaacttggaacacctgaatgcaggaccagacattgatggagatgaaatgcctcattgtacacagattttctataatacaacaaaacgaatccgtgagtgtttggttaaaacttttggcaaaatactctgaaatatttctagcaagccaggataataaacagaaatcaagattagtgtaggtattatcactaaatgtagaatatgtaaaatggccctgatgtgttatttatttatttatttatttttattttttttgagacggagtcttgctcagttgcccaggctggagtgcagtggcagaatcttggctcactgcaagctccgcctcccgggttcatgccattctcctgcctcagcctcctgagtagctgggactacaggcacctgccatgacacccggctaatttttttatttttttgtatttttagtacagacagggtttcaccacgttagccaggacggtctcgatctcctgacctcatgatccacccgcctcggcctcccaaagtgctgggattacaggtgtgagccaccgcacccagcacctgatgtgttatttatcggactttcttgacagtttttttttaataacattaaaaatattgttaaaagattttccagaggagccatccttgctctctcagatcgtccccaataaattctttctctaccaccaattctcctagaactttttgagaatagatcccttaaagtagaggctgaaccccattttgtattttgttttgtgtcaaactatatacattatgcttactcctagaaaagaaatactccataaaaagcaagcagcaaaatgttaaggacgaaaaaaacctaacaatgaaaaatattttacccactttgtttttttgctgtaagttagccacaaaatacaactgccctctggttctgaggattttagacctcctttggaggatgatttgagaaccctcaaataatctcatttgccgtgagacagacggacggtgagtttactaccattggccagtgtctgcagacatcaaggttagtgaggtcattcagaagggaccagcatagctctggtgtctctagactccgcagccatggctgatttctctacatccatcagcctctccctgttgtctccataagtagctattacaaaaggtttgtggctggcttagaaccaagaattttggctgagcaatccatagatcccacagacagtaggatggagaaagggctacctggagtgatgttctggccacctttagggagcctgggctgggaaatggtggcctggcaagggcttcagggcttgtggtcaatggcagccaggacacctgggatctgctggactcaagggcctcagtcatcactttaagactggggagacgtcacctagagcagagagaccctgtgacactcagcccaggtaagtttcctgcaggtggactcagttgtctggaataagttcagaagaacagaagaggtcctgctggtggcggacaatcaggcaggctttggctcagtctgaggagcaattttcttcccatcagagctgacgagtaccgccaagtcccatctgtgaaggtagtgagctctccatctcaaggcaaaaaaacaagctggatggtggcaccctggaacatggtagatgggacttgagggcctgctgggggtgggagtctgtgaccctgaaggagtcttctcaccctgactcttcattaggacaacgtggcctagaaggaaggaccattcagcagggtcaggagcctcagctgggccggccaggctggcaggggtggagatggccccctcgcttcccaccagggactctgagtttgagacttgaggtctagcaccacttccagagccctcagaactgggacccactctaggcatggggagccaaggcacagtctgacctacccccaaatccaaggaccagtaccctcttggtctctccctacttccttgtttagaagccagtctcagaaacagagctcatcctcaacccattccaagaagtagaggatgaaacaggatttaaatttctgggaatttttatatcttacctaaaaacccttgaggcttgaatggggacattccaagcatgcagaaggccactgtgtcacttggatagtaggcccgtgaggtcacctggaactgtgttttcctctctgccctacagacctgtctcctcctcttcctaggcacatggacacagccctttgacctggcaagcaccagggaggagaacttctatgtggacgagacaactgtggtgaaggtgcccatgatgttgcagtcgagcaccatcagttaccttcatgactcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcaggtaagtcctccagccatcatgttgatttctgcaatgcacgtgtccccagaaagtggggcacgtggaaagggagtatgctggggcatccttccttccctggactcaccctccagggctcagttttcctgtctgctgggcccccaaaggctgtaagtttccctaatctagagctcacgcttatttattgatctgtccatcaacactgaaatactttggggcatttcacagagtgaggttccctttccctgtgaggttcatacataccctctgcattgtcatatttttgtagcattttcttaaagtaagttcaccaaccacccagctacacacttatctgttttgttatcttgcttacctgaaaccacaccctgctaaagattcttggaagaccccatagaaatataatgaaaatgataatgaaatgtatacatcatggagccaatgcaaaatctatgaatggttcttaagttactcagggcatctaactcttccaatcaatcaatcatcagtaaacaactaagaaagcaaggctaaagtaggtaataagtgagtaagtagaaagaaagcaagggctgcatatcctgaagaggcagtagccaggaggagaagcggccaatggattccctctatctctgacctcaggcccaagcaaggggctggtgcagggttgacactcaggcaaggtcagctgaggatgtgagtcagcaatgaatgaatgaatgcctgaatgaatggatgggtgagtgaatggatggaagaatgaatgagtgagtgaattaatggatgaataagtgagtgagtgcatagaatggtgagtgagtgcatagaatggtgagtgagtgaatggatgggtgagtgagtgaatggagaatgagtaaatgaatggatgaatgaataagtaaatggatgcatgagtgagcggatggatgggtggatggttggatggatggacagatgcacaaacaaatgagattttccccctaagcacccctgagctagacagtaattgaaattattgtcatgcaagtgcgcagccctgctcctcaccttaaaggaggaaggaggtgttcttagaacatggtcctcactctcagggagattcaagttccatctgtgcagaagggtcagaaaatgccaaccagcatgaaacctggtggcaggggggctgatgcagactcagaagcaggggggatgctgaggagagagtgggaatgtagatctggagtagctcaggaaggctggtggatcaggcagcatttcattcactcactcactcattcattcattcaatgtgcatttcattcgctcattcattcaatgcacataaacggaagcacttgctatgtaccatgccctagctaagcacaggggatggagtggtgaataggacaaaacagagcccttaaagacatgcactctagagcagaaaacagattctggtggaattaatagtggtacgacaatgtgagttctgagagagacagacagagatatgtaacatgccactggttgggaggtgggaatgcctgactctgcccgggaatggggaagggctgcagagcaggttgttttcccttgaaactgctttgagtgtgaatggaagttcagccagggggaagtggcctccagacccgacatgaagtcaggggaccatgcccagagtgccaacaatgcagggccagcagtaatgaagacaaatttggcttggacaaatgttgtggtctaaaaattttgcagtagataatctaggaggaagctcctctactttattaacatgtaggttttgtggtttatggtttcagattgttttcattttgaatgataccttcagagatctatttgatgctgggtgcttctagagaagttcatccagttctgtgaatgcacatggaagtgtctgggaatttgacttctctcctgtagggaagtcatgtagtcagccctgtgtttctgagcaatcccctatagctatgtggaggacacagttcttaaaccatccataactacgcttgagtgtgtacacatatatatgcgtgggtgtgaacctgtgtctgggcgatgctagggatccatttgccatctcttcctcctttctacccaccaaagaaaacctgtaatttaggtgtaataccacaagggggtgataacgcaccatgatgcaaacaatgcattccagctcatactccactgaaaatgacgggaaggactatctatctttctttacaccaaaaataatcttttcatgaaaatacttcaatgtgagcaacattaatcaataatacataccttaaagccccatcaccttgctctcagagagctgtcaacaacgcagcaggcggcagatggcaaaactagtcctggccttttcagttctgttgcctcccagttgtgtgactttgggggaattcctcaacctctcttaagtgttggtctctcaacctggaaattaaagatgttgattccgacttcataggtgcgtatgtgtgtgtgtgcacatgcatgtgtgagagagacagagagaggagaaaaaaaaagtaaagaacatagaccaggtgtttgggataaattggtctcccttcctttctttctgttactatttccgcacctggagaaggtacacaccgactcgcctctggttcttctccctctcctttagaaaaggacggcttccacttcacgcaggatggttgccagcctccgggcctcactcagggctgcttttgctcagtgaggagagggtctcgtgccttccctcccatctgccaagagagccggtgcgagttcactgacacccctcagtttcagtgttttagacatctgctctccctctggggagaaggcacaagaagaatttaaaaataacactaaggccttgacatgttaaaaagcgtagatgcccgtgctgcccctagtgtgaccccacttacctttctagaaaccccacctgcttcatctggtagaaactgccagctgaatcagattcttgcagaatcacagagatttcgcacccacctgccctgggagagcctgtgttcaaccacctttgtgtgcaggtgaggacattagcacagagaggggctggacttggcaaaggccacacagcattagtggcacagctggagccagggaccactgctcccagctgggcactccctccagtcctctgcttctagcaggggttctcctgggactaaaaaggcttcattatggactattgtcttaaatgctccatggtccagctgcatcccaggtggaatcagctcgaaggaattgcagagaagaaaagaatgtgcaattcagaggccccgtgggaaagctgcctgtgtcatggaggcagagacagatcctgcctcctgctctgtcccttctcctacccacaaagagcaagtcaggctggagggcaggagctggagggagcgcatgaggaaataagagtctggccaggagaagaggtgctgctctcccctctgccaggcccagccctggaatgtctaactctgtctgcttaccccgagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtaaatgtcatgggaacccaccttttcttccccctccaaaattcacaatataaatataatactaggaagtggcactgagttcgttcatgaatgagcctctaggtccctggctgagaaccccaggttgagtcaaagccccttgtctcaccatgaggtaaatggaggctcagcaagaaaacatgacatccccaagatcacacaggaagctgtcgacacaggagggccacaggccaggcacctacccatcccaccagaccacacagaggggaactgtgaaaaccaagttgtcatggcagagctgtgagtggcccctggcaaaaagaaacaggaaaagtggtaaatgtctaattgggatcatattgagccttctacccaattacatccattcaattacataaatccttcagctttatgttctgttattcatgcattcagaaaatgtttactgaacacctactatatatcccaaactgtgtaggccctgtgtatgcccccgttactcagatgtgtggcccctgacctcaagacacaggactttgtggcctccgtggtacctggcacgtaatatgtgctcagtaaaatgcgtgctgtgtgagtggattgagtcaacacagctgccttctcagaaggcaggtattatcccaatttctcagatgaggaatctcctgctcagggagggtatgcagcttccccacagtcacagagctagtaaataacagtttgatgtttgatctcaggcctgttgactcaaaacctcatctgctcaagacacactgcaggggttccaatcccagctcagcttcttcctagccatgggtgccactcacagagccaccagagcctgagtgtgcttgctggaaagagtcgctggaagttcccaccccttagggtgttgtgagctcaccaatatcacctgttacttatttagccaggttatgagttaccagagtcttttgatacaagctaggcagacgttttgctgacttcagaactcctcctaattttgatcacaacaaggacatatcaacagtcaaagatttacatttttagattctgcctcagctttcccaaacagaacagacataggcactttgcataacttgaaccctagcatttacccagcagagtggaaagggagcaagatctccctccgctaccccaggatggtaagaagcgcccaacatggacagtgaagcccagttcaagccatgagacttctaatctccatgtgatgggcccaatctgccctttgaataggaagtgtaggtgcggcccaggttctggaggtggacagacttgggctgtgtaatcctggggctgccacttggataagaatccagcaagtgaccttctctgaccctggatttaccttcctaaaaccaaggatgtgaagggtcccagcaatgagtcaggaaagcgagaacgcacagcaggtctcactacccatcttcattctgtacctaacaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgatgaccggtgtggttaaagagaagggcaggggcgttctggaggttactgtgttaaagtggtgtttgcaaatccccaggcctggcatcttcatccatgtgggctgccataacaaagcaccacaggctcatgaacaacagaaatgcatttttcacagttctggaggctggaagtctgagatcagaagccagccttgttgggttttggggaaggtcgcttcctggttcaggggtggcatcttctggctgtgtcctcacaaggcagaaagagcagagaaagctctctggggcctcttttataagggtcctaatcgcattcatgagagttttacccatgacctaatcacctcccagaagctctaactctaacaccatcaactttgggatttggttttaatgtatcaatctggggagacacaaacattcaggtcataacacctggtactgccacaggaggagcaactcctctggccaacaaaccctcccctcttccctaataaaagacaaacttcagctgaactaaatctaaagtataaatgaggaatgaatgattcgcaaatcggacagcctcctcagctgtgagactccagtgcagccacgtggtggaagaagatttacagacagaaaaaggaaagtgatgtacagaaaacagaagagaggaacagaaacagccggattggttataggttgatgtttgtcttatttggctacttttgatcagccaaaactcggtgactggcacaagtgtaggctatggtctgttcgtccctccacttgttatagttcatgatgtactgagaaatctttaggccaaatttaaaatatgtaaggaggccgcattaggctaaacttgatttaacagccctgacaactgcagacgaatgtggcatctttaatttgtcatgggtcttaggggtcagggcggtgcagggaggtatgtgggaaagggacagaatcccagccaggtccatgagagctaagatactgaaggtcttttaaggtttctagtctttaaagtttcctggggcggggggggcggggcaggggttggacatttctgggcccccaccagagcagctgacgctggaagcctgttgtgggtgaacagtggagtcttactctagaaagataggaggagactcagcagatgtgtgtgatatggtttggctctgtgtccccacccaaatttcatctcaaattataatcctcatatgtggagggagaagcctgtaatccccatgtgtccagggagggaggtgattggatcatgggggtagtttcccccatgctgttctcatgatagtgagttctcatgagatctgatggttttataattgtttgacatttcctcctgtacacactgtccctctcatctgctgccagtaaaatgtgtctgcttccccttccgccatgattgtaagtttcctgaggcctccccagccatgtggaaccattagtcaattaaacctcctttgtttataaattacttggtcttaggtagtatcttcatggcagtgtgaaaagagagtaacacagaatcagttccaacattcattggttttcctttcttattgcaaaagcaacatgcactgaagcaaaaccccaggtagaggctggggttgggccatcttatggcagttgccctaacactgcgctaatatgatactaccccctacagcgccaggaacactgtttctgtttggtgaatgattgaattcgtcttattcattttttcttttttttttagctttttcttttcttttttttaattatacttcaagttctagggtacatgtgcacaacatgcaggtttgttacatatgtatacatgtgccatgttggtgtgctgcacccattaactcgtcatttacattaggtatatctcctaatgctttccctccccccaccccacaacaggccccagtgtgtgatgttcctcttcctgtgtccaagtgttctcattgttcaattcccacctatgagtgagaacatgcggtgtttgtt

SEQ ID NO: 13469 - DNA, 46347 bp, Human
aatgtcagaggagatcattatgatatgtgaaaatattttaaattgcattatctattatgtaaatgtaagatggaaatttaaaggaaacacatacacagttttttcatgggttgagatctcttgctattggtcagcagagcctcaggaatgcaagtagacaatgaattagataactgcttatactgattccctgcattggcagggaaaaggccaatgcaaattatcaggatgtactgtgtggactaccaatcttatcttagatcagtgatacaacaatccaactaaatgctcctaagtggacacctcataaaataattattgtatggcatttgtcaaaattttaaatgctttacagctcctttgtttgttcttgttttgtctgtgggatttcatttctaggaaaataactaaatggactaagtttaaaaaaaaaaaacaccaatcatgtacattactaagggcagacagtccatcttctggatatttctgaagatgctcaataaacgttaatcaaagtaggtaatgattcccaacatgggctattgtgtcttccacgtttattttctacacttgatgttagccaaaaggccaaggagcaattccattttctttctttccttctttcttttctgagacaagtctcactccgtcgcccaggctggagtgcagtggcgccatctcagctcactgcaacctccatctcccgggttcaagcaattctctgcctcagcctcctgagtggctgggattacaggcgcccgccaccaagcccagctaatttttttgtatttttagtagagacggggtttcaccatcttggccaggctggtcttgaactcctgacctcgtgatccacccgcctcagcctcccaaagtgctgggattacaggtgtgagccaccgcgcctggccgtttattttaatatattcttcagctctgaatatttgctagtatcccagtaatagtttgttaaatcaataaacgtgttgacatacatgcatagcataatgtctggcacacagtaggtactccattgaatgaatgcatgaattattaccgtgtcaatttgcttgtctatttgcaaatgttaatagttaatttgatccctaaagtgtttgtgaacttaaaacacacacatacgcactttccctgacaacgcttatctgctaaccccttaattatgttcatctgagactggaccaaaacatgttgttttattcaatttaaataccaaattcaaatttattttgaatatagcttagaacacattcaatgtttgctaaaataataataataataataataataataataataataataccatgtacattcagttagccagacaattactccagcccaaataccctgctatgggacatgaaccggatgtctgcccggcacacattcatcaggtgacccctaaaacttcttctctaaggtccacactgtctaatagccaagttgaaatctttcctcgaaattttcctctctagtgtctcagtgccccaggtgtcatcaaggtgtcaaaggcgcttgggagtgcctgcaaaccgccccatccccggagacacagcctcattccccgccctcgcgcctaggcggccggtgggcgggcccagcgaagggccttgtggctgtttcctattggggcttggttgctatggtgtcactcgcctttaaactcgtgggtacatctttcggaaattaaaggagaattacttccagggctgcccatacttgccatggccgactcagtagtcactaacttcaacaaaaataaaactgttgcaatagtattctattaaagcttctttaactgcttaaacttgcggttttgacatggtacctatcctttcttcccttttcaaaagattcgctatagagtctttctctacatgccagtctccaaaatggcgcggacggcatcagaaggtcagaggtgagtcacgtgggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaaggtgcggcattgggcgacgtggggccgggagggaagacggcaggcttaggcgaggggaggctcgggttcgggggagtcgggccggcggaggcctgggagttgttctggcctcccgggagcgcaaaggacgtgcggtggagcccgccccctcaccccgctggttgcctgtcgcggggcggggcgggtcaccaacgcctgggaaccccaagaagggctgcgaggctttggcggatgtggtgacacctgagctggggcggttgtcaacgtcctataccagttttggtctcagatacattgaaccgtaatttggttctccaaataaatgttggggtgttgaatatttatacggattggcatcataagataccgcgatacctgcaggaaagtaaaggagacagagctaaccgtgattaataaaatgttatttattgagcatctgctgtgtcagttactgtgctactttgcatatattaccatttggttcatgcactaccctatgaagtaggtaggtactgttagccccattttacaaatgaggaaactgagactcagaggtaggataaactagtaagtgtcacagatggaatagattcttttttttttttcaaaattattattatactttaagttctagggtacatgcgcacaactttcaggtttgttacatatgtatacatgtgccgtgttggtgtgctgcacccattaactcgtcatttacattaggtatgtctcctaatgctatccctcccacctccccccaccccacgacaggccccggtgtgtgatgttccccaccctgtgtccaagtgttctcattgttcaattcccacctatgagtgagaacatgcggtgtttggttttctgtccttgcgatggaatagattcttacttagtttggtagttaagtatgttgagggaaaagcgctgcaaccttattccttccttgttttaaatttgtaatttctgtagttgattaaagtcgattattggttacaaaatggtctcagtctctagtcctttttctttggtatgccagaatctggacttggctcttttatgtaaataccaactatgctcttggatggtgacaactactgccataataccagtttgattctgttttgtagctaagagtagcctggcctggtctttgagacattaatataatttgatatctgtcagtatttggttgcattttaggtaattttattcattcacaataagcaaagtgtctttttttttctttgtaacacaatggggcttttgttatactaaatagaaacatttttacttttttttttttttttttgagacggagtcttgctctgtcgtccaggctggagtgctgtggcgcgatctcggctcactgcagcctctgcctcccggtttcaagcaattctcctgcctcagccttccgagtagctaggactacaggcgccagccaccacacccagctaatttttgtattttagtagagatgacggttcaccatgttggccaggatggtcttgatctcttgacctcgtgatctgcccgcctcggcctcccaaagtgctgggattacagccgtaagccaccgcgcctggcctcgtttttactttttaaaagggtttcagatataataagaccataacttatgttaaagtagtggaacccagtagtgtggtaatacatgtaatttatttctactttatttgggagagacaaactattttcagggcaattaatctgtgacccatcattttattattctgtttgggtatcaaactctctacccaggaaaatagtgatggcatgattttagaagcttagatatagtgtttccggggtgggagatcatgcttccaactcttcagaggatgttcatggactcagggaatttcagcaatgaaagagaccttgctctcatctcgtgttgctgtctgatttgttcttatattttaaagcccttcagtggctcactattgcttattgatagtttaaatttctcaacatgctttgttgtgctcttcatgatctgtttctgagctatacgtgtggtcacttcccactttgcattctacatggagccaccctggacagtaccctgaactcacttattttctgaactgtttttgtttatgccttgacctacttactagactgttagtatcctcagggtaggaactattttcaggttcatcttttctagaatgccaagcatgttaccttgcttctagtaagtactctataaataacaggaactgtagtttagcatggccttatgggaattacattgaatttagggctgctgaaggcacctcaacagcaggactttaggccgggcttggtgggtcatgcctgtaaccctaactctttgggaggccgaggcgggtggatcacctgaggtcaggagttcaagaccagcctcagcaacatgctaaaatccagtctctactaaaaatacaaaaattagctgggcatggtggcgtgtgcctgtaatcccagctacccgggaggctgaggcaggagaatcactagaacctgggaggcagtggctgcagtgagctgacaccgtgccactgcactccagcctgggcaacagaacaagactcggtctcaaaacaaaacaaaacaaagcaaaacaaaaaccagcaggactttgtgcatacaccctagcactttactatcactcagttgctctcctgtgtctgctctcttcttttgctactaaccagcttaatggaaccacaagggtcctaaacccaaatgccaaataggtaatatcattgaataaattggaccaggtattttaaaaaaaaaagcagtgatgataaatgggagaataattggacgtagtagaaactgttaattaggggtgaccaatacttagttcttgatgagacttgccatgcaagcatgtgggcctttttgccacatctgatttttcccttcccctcccctcccctcttccttcccttccttcctttcttcctccctctctccctccctccctccagtggcaccatcacagctcactgcagccttgacctcctcagggcccaggtgatcctcctacttcaggctcctgagtagctgggattacaggcacatgccaccatatccggctagttttcatatttgtttgtagaaatggagtttcgccatgttacccaggctggtctcgaactcctgggctcaagtgatccgcccatctcagcctcccaaagtgctcggattacaggcatgagccattgcacctagcccacatctgatttttcaaatgaaataggaacaccagattttgatgtgaaagctccagacttttaaatttcatcagccaggtttcagcactgcagagcttgggagctcccggcccacccgagggccatggatctcattgtcctcaccactgctttgccactccattttcctcaataaaatggtttggccccctaaaaattaaaaaaaaaaaatttcaccagccaattcagattggtttgggcattgatttgttttcagtgttatagggaatagtatagtgagttcacctttctacccattactcatattcaccaattatcaggatctttccacacgtgtcatcttaactgcttctgccatatcatttcatgctaaattgtattaaagtaaatcccagatgtcatgtatttcattcctgcctacttcagcatgcatctctttaaaaatataaaccacaatgttacgtggctaatcacgcctcacaaaatgaacaatgatggccaggcgcggtggctcatgcctgtaatcccagcactttgggaggccgaggtgggcgaatcacgaggtcaggagttcgagaccagcctgaccaacacggtgaaaccccgtctctactaaaaatttaaaaaaaaattagctgggcgtggtggcacacatctgtaatcccagctgctctaggctgaggcaggagaatctcttgaacctgggaggcggaagttgcagtgaagtatgattgtgccactgcactcctacctgggctacagagtgagactctgtctccaaaaaaaaaaaaagaacaatgattccttgatacccagtccatatagtatgatcccacttgtctcaaaaatatcttttgaaagttaatttgttgtctctctcaagtgtctaatctagagcagtctcctcttcctctcacctccttttttatccttgcaattgaattgttggagtcaattgctcttaaaagaatgtacagcatttcggagttgtcttttgcttcctagaggtgtcttttaaccagttcttccactatattttttgtaaaaggaatcagctgtaaagatgtaaccagaggttcagcaaaccaccatggcacacgtatacctatgtaacaaacctgcacgttctgcacatgtacccctccagaacttaaagtgtaaaaaaaaaaaaaaagatgtaaccagattcaggtttaatctttctgtcgagggtgtcactgcaggaacacacagtactttttgtgccccttattgctgctgctaagattgataagtggattaaggtgtgtcttagtgtcctattgctgctgtaacaaattaccacagatttatggcctaaaacatcagggatttgtcttaatcgttctgaaggtcagaagtcctaaaatcagggttttggcagagccatgtttcagaagtcctaaaatcagggttttggcagagccatgtttcttctggagactttttgggagtggggtggggatcagttttcttgccctttctagcttctagaagccacttgtattctttggctcatatctccttcctccatctttaaagccaggctgggcgcggtggctctcgtctgtaatcccaacgctttgggaggccaaggcgggcaaatcactgaaggttaggagtttgagaccagcctggccaacatggtgaaaccccgtcttcaccaaacatacaaaaattagctgggcatggtggtgcacacctgtagtcccagctactcaggagactgaggcaggggaatcgcttgaacctgggaggcggagattgtagtgagccgagatcgtgccacggcactccagcctgggtgacagagcgagactttgtctcaaaaaaaaaaaaaaaattaaagccagtagcatagtatctttaactctctccctttccttcccttttccatcctctgctttgttcctcaccaccccttcttcctctcttcctccctccttccccggctatcatcatctcatctcattctcttactcacctgcctccctcgttcccttataaggacccttgtgataatcttctccacctcaagacccttaatctgatttaatcacatctgcacaatcccttttgccatgtaagataacacattcgtgggttctagggattaggatgtggacatctttgtgtgtgggaggcatttttttctctacccgggtggtaatagcccaaagccttcattgtaaagtttcccattaacctttcacttaggaatccactgatgactactgtgtgcatttattatgtcattaaggttgtgaaatgatgactttctaattccgttactccttccatatttattagctgaaattattcttaaggaattaatatcatctgattatcctaaaatttatcattcacattggtaggataaatgcagaatttatttcttctaattgataattgtcagagtaaggaattgttgcccttgtcattttcagtgttgtccaagagtttttggggtttttttaaaagtattttactgaactctttttaattgttggcttcaacttttagaatcattgtgttttaggcagttgtttccattctttatgcccaatttgtccctttggttccttcatattggctcctgtattttttcaacataatcctgttaggttttgatagcatccttgttttctggcacaacaaagtgttctaggcttatcttgtatatgtctatcctctgacctcagaacaactgtttctctaaggaattctagttcctttttgtggggattggtatttggagaccacaagctaggtgtcatttttgaaaatgtaatataccatgcaagccacagaacacatttgtgagcagatgcagcccatagcggctttcagtctttttcatagtgtccgttcacttagttccactttttctttttttgttgagatggagtctcgctttcacccaggctgcagtgcggtggtgcaatcttggctcactgcaggctctgctccccggggttcacaccattctcctgcctcagcctcccaagtagctgggactacaggcgcccgccaccacgcccggctaattttttgtattttttgtattttttgtatttcaccgtgttagccaggatggtctcaatcccctgacctcatgatccgcccgcctctgcctcccaaagtgctgggattacaggcatgagccaccacgcccggccgttccactttttcttatattttgacgactgcttcaaggattctccctatgcatcattttagcttctggagtgcaactcctaagtgccagagctccttttcatatggtaggccacattctaggtctcagttcagccaatggattgtcttgtctttggtcatatttccacccctgctttaggcagctgtggtttgatttgaggtaggaggagaactggagactggtgcagaacctggccagctgagcttagcatttggtggttgtgctgaatgaggcagtcttttttttgagatggagttgcgctctttttgcccaggctggagtgcaatggcatgatctcggctcactgcaacctctgcctcccaggttcaagcaattctcctgcctcagcctcccaagtagctgggattataggcgcgtaccactactcccggctaatttttgtatttttagtagagacggggtttcacaatattgtccaggttggtctcaaactcctgacctcaggtgatccgcccgtctcccaaagtgctgggattacaggcgtgagccactgtgcctagcctgaggcagtctttcttataagggtctctgtgaatatagtgccttggttaatctgactgattcaccttctttctgtctaggaacatctcagtatccagtgaatgcacctatgttatcatataccactctgtgttgcagttgtgtatttgcccatctcctgggataaactataagctgcttgaacagagactaggtttcattcatcattgcaatgcttgtctaaaataaggcctggcacatagtaggaccttatcctaaggaattagtgaacagacgagcaagcactgtctttgcctcatctctgatctttccctcttccattctctttatttgcttcctcccactctgactctagctatactgaacaccttacagttctttgaatataatgttctctttacctggatcaatgtttgactttctgtgtcccctatgtgtcccattggcttataacttcttttttccccctcaccaaaagttgtatgaaaagatactgtagtaccattacatcctgttttacatggcacttttcatgtagtgtagtgtttactttgtgaactctttaatgtcttactcatctttgtgtctttagtttaacgtacacattgttgtataactgagttaaacatcttagtcttcttgagaagccttgtggtatggtagagactagatctgaagtaagatagatttggttcagatcccagcagctccaccatttaaaggttatgtgggtcttgcagggattacttaacccttcttctctggtcctgtttctgtaatatgggaatcgtagagctcataaacttgttagaaggactgattgagatgggtgaggtttttattgtgcagggcccattatggtgctccatagatgttagtactcttttctttcctctgtattgaatgaaaattgaattgcttctcagagcccctcatgctatatgtcattgaaataagtagatatggagtattttaatgagaggaattatgagtagtttgtgattctttcattcattcaacaaatatttatgtaatatttagtatgtgtcagacctggctgagaatatggggataaacgggacaaggtcctcaagctcttgtggggaacaaagacaaaaaacaagttaaaataatagaatttcaggtagtgataagcactataatgaaagttcaggcactagggagtagggggtgactgatgggttaaagggtgtttgagtggtcaggggaggcctttctgaagcagagagagataaatggattgaaatgatgggtggtcctctcctgcaaagatttctatttcagacctatattgagatgcattttgtgttaagatctccaaactgagtctattccatacttccctactcatttcataaagtgaggctaaatcaggctaactagtgtcaggtataaagactttgctgcacataattgaagcaggaagtatcaactcgtcatttacagtgaatatagaagtttcctccattacttcaggtccataataaaagcctgttgtagggactcagaaatttgggtaatatttttattattattttgctctggctggagtgcagtggcatgatcatagctcgctgcaacctcgaactcctggcctcaagtgatcctcccacagcactgagattacaggcatgaacccctgcacctggctgaaaatttggatcttataccaagttatgatttctgtccttcccaactagcttatagataagaaagccaaacagatcccttaaagagttcagccttgaatcacaggcctaccacaacttaagcctaaaaattatgaagaagtaacttggcagttgggaaactattggcttataacttcttttttccctcacccaaagctgtatgagaagatactataggccaggcatgaggacagagaggagagggaggaggaaggagaaaaggacagtggtgggggtgggggcgaggaggagaaaagagagagaggcagaggggcgaagaggcaggggagggaggaaggaaggaaaagatggtatatatgctatagttttcagattattttgtttggaattactgtatttcagcttttttattactggtatctgtactgaggtctgttctgtgctgacaaggagaaagaataggatgcttcggctgggcgtggtggctcacgcctgtaatcccagcactttgggaagctgaggtgggtggatcacgaggtcaggagaatgagaccatcctggccaacatggtgaaaccctgtctctactgaaaatacaaaaattagccaggcgtggtagtgtgcacctgtggtcccagctactcaggaggctgaggcaggagaatcgcttgaacctgggaagtggaggttgcagtgagccgagatcacgccactgcactccagcctgggcgacagagtgagactccgtctcaaaaaaaaaaaaaaaaaaaaggaataggatgcatgttgctcagtcatcgaaatgaaccatcctttttatcaataacgatcccatgaacccttacttatgccagactttttctgtagggagaaatatggccctttcagcgtgaatttaacgtgactgttgttcactgggttagaaacaggtcaataaacagatggttcagtacagaaggctaattggtacattgacatttaataatataaatcgaatttctttttgtattatatacaaagttcctagcttttaattataacttgacctttgcgtccttctccataaaagttaaaggatacattgcttcatttaaatctctcttattcagtaaacagttgtctacagccttccctgttttgaactgatctagagaagggggctgcttccagtttgaaattgctacaccatatctttatgctgacttctgaagactgagtctggtttctaggaaagtggaacaaatatataaaggtaacccagtaggggtgcagtgacttctatgctgtttcttgtgtgaattgctgactggtagtttgatcctgagccattgcccccatatgcatatagagcctggcagcctggacagtagagccctctgtgaaatcagccagctggccacagacctgaacttgggctcccaaacaagtctccgacttgagggaggttgatgtcatctgctttatcctgtgctcccaacctcattgttcaacataaaatgtgggaaatcaagggaatagttgttaagaaagaacaagactttgtttgtgctcataatgaaagggtcacgctggaggtttttaccgtaaataactttggaacagtatgaaaaaaaacatttgatctggcttcacccccgcagtagtattgttagggcagcaacgggtctttcgttctcgttcccctcctttcctccctctctttctccccttttcttacccccccactcctcccccaagtcaagcatgacgtattgcctatgttaagttaatgtagcaaatgctgatagaagcaggaagagagcatctatccattatcatgccagtgcctggaaatttgctatttctggttttcagcatttctagaaaaagcctcctagcctccttgatcatattttagcttaagcaatacttatgtactatgttatactatcagtgaactgtactagaaatttgaaagaatttagtgttgccaaatgctgcctgtgggctaagtttgactttgttctgggcaaaatctagatgtgatccttttatttcaggaatatatttgatagactttgtacatgcttttgtttaaaagatcagcttaaattcattttatgcccattaaatgtagcacctaagccgtcagagtttatgtttttcgtttttgagatacagtggtcccttttgaaagtgtttctgaggctgggcatggtggctcacgcctgtaatcccaacactttgggaggctgaggtgggaggatcacaaggtcaggagttcgagaccagcctggccaacatggtgaaaccctgtctctactaaaaatacaaaaattagccgtgcatggtggcgtatgcctgtattcccagctactcgggaggctgaggcaggagaatcgcttgaacctgggaggtggaggttgtggtgagccaagatcatgccactgcactccagcctgggcaacagcgtgagactgtctaaaaaaaaagaaagaaagaaaaagaacatgtttctgatatatttttctatctaaagccatagcatctttaatgagttggtgttctttctgcttttttatatcttaggggaatagaccctttggctcagtattcacttgtgaattcttatgaagagtagagataattatatatgcaacctcaatcctctctctctttccgccatatctaatgttggattcttcatgtagtttattccttattaagttaaaaaccacatacaggaaaagctggcatcatcttggattccttactgtctctctttttatcagctaaaaggatcaaacatctgctttcttaggcattttgtatcctttcattttctaaatcttgctgctgcttccttgagagtgtacctgactacccctttctctctgtttccatgcaatagccatttgggccctaatcatccctggatttagtgaacatagcacaatttatctagtttgccatccattagtactcttaggttagaacatatggttaatgggccagagatggtggcttacgtctgtaatcctagcactttgggaggctgaggcaggcggattgcctgagctcaggagtttgagactagcctggccaacatgacaaaaccccgcctcttctaaaaatacaaaaaaaaaaaaaaaaaaaaatatatatatatatattaggccaggtgcagtggctcacgcctgtaatcccagcactttgggaggccgaggtgggtggatcacatggtcaggagttcgagaccagcctggccaacatggtgaaaccctatctctacttaaaaaataaaaaattagccgggcctggtggcgcacacctgtagtcccagctacttggggaggctgaggcaggagaattgcttgaacccggaggtggaggttgcagtgagctctgatcgtgccactgcactccagcctgagcaacagtgcaaatctctgtctcaaaaaaaaaaaaaaaaaaaagccgggcatggtggcatgcatctgtagtcccagctactctggaggctgaggcacaagaattgcttgaacccgggagtcagaggttgcagggagctgagatagtgccacttcactccagcctttacgacagagcaaaactctgtctcaaaaaaaaaaggaagaaaatgtggttaatgacctaaatatttatggagttctgagttatcaccaacagttataacaataatataacacctattgaatgcctgctatgtgacaaacactgttccaggcagtttacctgtataacatttaatcttcacagtagctgggcgtggtggtgtgtccttgtaatcccagctactcaggaggctggcacaagaggatctcttgagcccaggagtacataaccagcctgggcaacacagtgagaccctatctaaaaaaaaaaaatcctcacaataaccttatgatgtatgtacaactgttgtccttattttacaaatgaggtagacaagttaaggaacatgcccaagtgtttacagctggtaaacggcacacctgtgatttgagcatggaccagaaagtctgactctagaaccttccatcttaaaagtactatgttgtatggtctctcagagagagaaaaggctagctattcctgtttccgttcttttttttttttttttttttttttgatacggagtctcactctgtcgcccaggctggagtgcagtggcgagatctcggctcactgcaacctctgcctcccgggttcaagcgattctgctgcctcagctgcctgagtagctgggactacaggcgagtgccaccatgcccggctagtttttgtatatttagtagagacagggtttcaccgtgttaggcaagatggtctcgaactcctgacctcaagtgatctgcctgcctcaacctcccaaagtgctgggattacaggcgtgagccaccgcgcctggcccgtgagttttttgtttgtgtgtttgttttgagacagggtcttgctctgtcacccaggctgaagtgcaatgacatgatcacaactcactgcagccttgacctcctgggatcaggcaatcctcctccctgaggcttctgagtagctgggaccacaggtatgcaccaccacaccaaactaatttttttttttttaattatttttagaggcagggtcttcctgtgttgcccaggctggtctcaaattcctggactcaagtgaccctcccctttcggcctcctaaagtgctggcgttacaaggtgtgagccagtgggcctggtggaccttgtgagttttgaggaccctggccaggtattttgtaggttgccctctattgggcatttgtcagatgtttttctcatgataaggtgaggttatgggttttggggaggaagaccacagagataaaatgtcattttttttttcttgtcaaaaccatgattcacttataaagtgtcattttcatcacatcatatcaacatgatttgtcacgttgatactgcccttgatcatttggatgaattagtgtttgtcaggtttcttcactatacaatattcttttctttccttttttcccccttaatgatgttttggtcagtccactacagagtaactcttttttccccctttctattctgtgttctttagaaggaagtcactttatgtagcccacacttaaggagtggggagttatgcttcacactccttacgggtgcctacataaattatttgagaatcttcacggaagatttgtctctcttccttatttatttatttaatcaatcatttatatgtaagtgtagattcatggatgtttactatgtactttggattataaaccagtactataattgttgccctgattgtttcagctttagctattgggagccctttaggttcctgtgtccctttgacatacccgcattcttgtattttttggattttcatttttgtttgtttgtttgttttgagacagagccttgctttgtcacccaggctggagtgcagtggcataatctcctctcactgcaacctctgcctcctgggttcaagtgattgtcatgcctcagcctcctgagtagctgcaattacaggtgggtgccaccatgcctggctaatttttgtatttttagtagagatggggtttctccatgttggccaggctggtcttgaactcctgaccttaaatgatctgccccccaccccgccccggacctctggtttttgtttttgagcacttcttactttctggcactataagatgctccaggctcattttgtacatttccttcctcagtcttaggatcatttctccaaggagccctggttgcttttattggagaagggaattaagtctgggtggatagtgttatttttaaggcatctttttctggtacctttttttttttttttaaatgcagttgtgctagcaagtggccaaaagtagtcccgtccttcctgcaactttagagtaagggtggaattctgtgagcagcaggagtgggctaggatggggagaaatgtagtgcttaggggcagggcagagaaccaggtctcacctctgcattagatcaggtcattcattgttagggagggtcactaaaagaactcatttgaactgtacttgtatctttagcaagatgatggttgaaaatgaagagtctgttagttacagtccttttacgaggatcttcctgataaattgttgttcgtggttacttccaggaaaattgtcccttagataaatttgtgagctttcatcagaaaacaaatgatgtctctttagtcttttaattttggcttccagaaaacttagaaccaaatttattttacagatatcatttgctcaatttaggttcttgataagacttttttcttccctcaggtgaactctattccattttattcctaattgccttattgacctaagctacttatagatccttttgaagttttattttgaatgtttggtaaaggaatgagagcaggcttcagtggcaggacctgctcaaaaatctgtttccagccactgcctagcacggtccaagaaaatccaattttaaatgagtttatcttcccagttacctgttttcgcacttctcacaggctcagtgtgagtattcacatattcttgacatcacctactctgcatataaaattaacacttttttttccttctctttttttcttgagatggagtctagctttgtcgcctaggctggagtgcagtggcacgatctcgggtcactgcaacctctgcctcccaggttcaagtgattctcctgcctcagcctcctgagcagctgggattacacgcgcctgccaccatgcccggctaattttttatttttagcagagacagggttttgccatgttggtcaggctggtctcaaactcctgacctcaaatgacgtgccaccttagcctcccaaagtgctgggattacaggcatgagccaccgtgcccatcccccctactttttaagttgtgaactttgttttgcttttcttcagaaggtgatatctagaaacaaatctttattacttcctattccttgatgtcatatgggcaaattttatagcttggtattacctttgtttaattaaagaactttattatcactattataagtatttattgttaaaaggaaagaaaagaatccttttaaggtcttgctattatagtaggtaaaagtagcagttattgattcaccaaggtggttctctaggacaatttaagaagaaaaaaaaaacctctcacttcttgagaaaccagatgaccttttaaggtgatctgtaattagaacattttaatgaaaggaaattaagctatcattttatttttttagcctattagactttgctggctctggttagtcattgagtttggcccagtttcctattccctaattttagctacctggtttatgtaatgatattggggttgggagatgtgatttttgttttgttttgtttttctttaagactaatgacttggctcctaaataactacaaagttatatgaactagataggaaacctactgattttcagaaaaatcgtgagatgttttagaatgcccaaacaggccatatgagtgagccccacctgaaagttcagttgtcaggttgcctgcctggatttccaaatatccagataaattccctcatgtagttgtgtcatctgaaggttatagggagtgtagacatgtggaggccttgggggaacttccagcatcatcacacactatttctgggaggtaaatttcatgttgataaaaggtgcaggctgcagtggcgggccctttgccttcagcctcttgaaatgaatttcagtttttgccttaaaatgagtctttaataatcttcggatgtcatagagagaagagacaatgcaaatggttcttctgtgattgcagttcctcagtacaatgtggtagaggacaatttaaatagtatttacccctttggagtaccagctggagatgtgattttcctgaagtctttcagaaaaacatagcagatttcttaattcattttgtaaggtacttttagcaatgacttaagaattttatgacgtgcatttaagctcctttatgatgtagagagactcctctccttaagttaaaataaaaaaaagtttttgaaggacactgttcatatcttggaggaaaattaagagattataatctcttcttccaggaaataaggtggttgggcaaatgtgtgcaaatcctgcaaacactgttaaattcagttgtttgtcctaggccaatgacttagtctctttccttgccttagcatggagatgatgaaatctgtgatgactcttttcagtactttcaccttgatgcttattccaggctgtcctctaccagtttcacttacatttagacattttcagcaacctgtaattattagccttcttccttcagaattaagccaatgcaatgagcaaatctggaaagttatgttacccaagttcaatgttgtctgcaactttattcttaggaggaaagtccaaatccaaattagggtctctagattggcttggaatgtgaaaaatctgttattcctgctgtctacctttttgaacttcttctttgctcttaaattttgtctttatgctttataaagtgagaatcttggggaagtgagtatctttgtgggtcaactgattctgaagaaaggaagagaggcatcacactgatgactacacattactttgtgatttggttagttctcagacctttttgactgatatgtgtgtatccagggttctaaggtatttatttatttatttatttattttgaaacggaatttcactcttgttgcccaggctagagcgcaatggtgcgatcgcgactcaccacaacctccatctcccgggttcaagtgattctcctgcctcagcctcctcagtagctgggattacaggcatgcgccaccatgcctggctaattttgtatttttagtagagatggggtttctccatgttagtcaggctggtctcgaactcccgacctcaggtgatctgcccgcctcggcctcccaaagtgctgggattacaggcatgagccaccacacccggccctctgaagtactttttggctgggcacggtggctcatgcctgtaatttcagcatttgggaggccaaggtgggaggatcacttgagctcaagagttcgagaccagcctgggcaacatagggagaccctgtctctacaaaaaataagacaattagtcgggtgtagtggtgcacacctgtagtcccagctacgcggaagactgaggcagaaggatggcttgagcctacgaggttgaggctgcagtaagctgtgattgtgcagctgcactccagcctgggcaacagtgaggccccctctcaaaaataaataaaaataaagtagtccttttttatgctgcttctttcagtttatgattcagaaaaattatcacacaaacaagaggcctttaagaatcttcaaggctaaatttcccttgattgtttagctgatgctaacttcaaggtctttaccttgtggctgcctgctgatctctctaaggtggagaatgcagactgatcagtgctgtgttaacacttgagaggactctcaactctgatttgcactgatgcaaagattctattagtctttcttggccactgtacattcctcttttttcagacattccttttgggggaaggcagcatgggatgcagaaagagagtgggttttggacatttctcaaatccacgtaacactatttatttatttttacttctttttttttttgagatggagttttgctcttgtcactcagggtggagtgcagtggtgcgatctcagctcactgcagcctccgcctcccaggttcaagcaattctcctgcctcggcctcctgagtagctgggattacaggcacctgccactacgcccaactaatttttgtatttttagtagagacggggtttcgccacgttggccaggctggtctgaaacacctgacctcaggtgatccacccgcctcggcctcccaaaagtgctgggattacaggtgtgggccactgcacctggctatttattgagacatgttctcactctgttgcccaggctggagtgcagtggcacaatcacagctcactgcagcctcgacctcatgggatcaagcagtcctcccatctcagcctcctgagtagctgggaccacaggcgcatgtcaaccacacccagctaattttattttttgtagagacggcatcccactatattgcccaggctggtctcaaactcctgggctcaagtgatcctcccaccttgaattcccagagtgctggtattacaagtgtgagccactgcacctgaccaacacgatttatttattaactgctataatggacaagttactaagtttcctcatcagtaaaacaggaataacaagaccagtttccatggagttgctgagaagattaaagattatgtttgtaaagtatatagcatgattctttaacccttttatctttccaaaccactcagttgcagaaccccaagctccgatcagttcatgcatgtgccttttcttttcttctgcatcctggctgctaggttgtaccgctagaaatgtgtggttcattatcttagctgagatctcagtgctacccagcagtcattctatgtgatgttagtcagctttctttctgtcctgtggagagggcaaaattgttggcccagaagaacttggttctataggtgtgttttgtttttccttgagatagtttttcttttcttttcttttcttttcttttcttttcttttcttttcttttttttgagacggagtcttgctctgtcaccaggctggaatgcagtggcgtgatctctctcaccctggtttcaaacgattctcctgcctcagcctcccaagtagctgggactacaggcacgcatcaccatgcccagctaatttttgtatttttagtagagacggggtaggatggtctcgatctcttgacctcatgatccacccacctcggcctcccaaagtgctgggattacaggtgtgagccaccgtgcccggcctgagatagtttttcaaatgttgggattggttgtaaagatttaaaaattaagagatttcaaatgaaagttaaaatgtctaccttctcttgaaaaactggatgatctgaaaacctggagtgccatggcagtcattggcttttcctataacacaggccatcttttctagtttgctgtgtatggcttgtgctggtccagtagactcagtatgtttctcacttgatctctgtgggcatttactttttggttttgtcctgtagactctacctccttaaaatccctcaaactcttcagttcatgggttactaaacttttttgtaattacataaaattatttaattaaatacaatttaataaaccttaataaaattaaataaaatttaaaattattttaattaaataaaatctgtcaccttctctctatactgaaggcccttctcctttcttacctggagtactggaatagtgtcccaacccacctccttatctctagggttctctctctatagtctgtcttcatagtactggtagcgtcatctttctgaattgtcattgactcacatcattctgtttcaaattccttattgcccttccactttgtactaaatgaagcttaaactccttagcatgctattctagttctacatgattgggccagtacctctccaggcacttaacctctctgggcctcagtttcctcccatggaacacgggggaaataattcttgccagtagggttatagtgaggattaaatttaaaatgcttataaagcagcaacacattatttgacacttagtaagtattcagtaaatactagctattagtaatatgataatgccatatttttgttttatgtttttctggacccaggccttcatatttgctgtctcttctaccctgaacttctttacccctctttcccttgattgaaattcatcctttaggactcagctcatgtgctaccccctcctagatacactccctgaccctccataatcccatggcacttgtgcatacctctggtagcatgccttgcacattgcagtgaagcgctctctctctgttagctttattgaggtataattggcaaataaaaattgtttatattcaagatatataatgtgatgttttgttatacatacacattgtgaagtgaataccacaatcaagctaattaacatatttcatcaccccatacaaatgtctaacaaatacattaaaagttccccagtatcactaaccatcagggaaatgcaaaccaaaaccactatgaaggcatatcatttcttatcactctcctctcctcatttagactcataagccctttgaagacaggaactatcttactcatacttgtatcccagtgaccagcacaggtctaggtatcttaaatgtttgataaattaggccgggcgtggtggctcacacctgtaatcccagcagtttggaaaagccaaggcaggcggatcacttgaggtcaggagttggagaccagcctggccaacatggtgaaaccccatctctactaaaaacataaaaattagccgggcttgggggtgcatgcctgtagtcccagctacttgggaggctgaggcaggagaatcacttgaatccggaaggcggaggttgcagtgagccgggattgcgccactgccctacaacctgagtgacacagcgagactctgtctcaaaaaaaaaaaaagggccaggtgagatggcttacacttgtaatcccagcactttcagaggccaaggcaggtggatcacgaggtcaggagatcaagaccatcctggctaacacggtgaaaccccgtctctaccaaaaatacaaaaaattagccgggtgtggtggcatgtgcctgtaatcccagccacttgggaggctggggcaggagaatcgcttgaacccgggaggcagaggttgcagtaagccgagatcgcatcactgcactccagcctgggtgacagagcgagactctgtctcaaaaataaataaataaaaataaatttaaaagtttgacaaattagcaaatggtgctggatggcagaagacagttgactaatactactgtttattagggaatttagaagatgtgccataaaactttttttagttaatctgtcatttcaaatttatctagtagtgataacttttctttagttattatcaattttttccaaaataaaataactttattattatttttgaatataagtgatccagtgatacatgccttttttttttttttttttttttttttttttgagacagagtctcgctgtgttgcccaggctggagtgcagtggcacagtctcggctcaccgcaacttctgcctcccgggttcaagcgattatcctgcctcagcctccaaagtagctgggattacaggcgcccaataccactcctggctaatttttttttttttttgtatttttagtaaagacggggtttcaccatgttggccaggctggtctcaaactcctgacctcaggtgatccacctgcctcggcctcccaaagtgctgggattacaggtgcgtgagccactgcacctggcagagctaccacgcccggctacatgtcattttcaaaaaaggccgggtgtggtggctcacgcctgtaaccccagcactttgggaagccgaggcgggttggattatgaggtcaggagatcgagaccatcctggccaacacagggaaaccctgtctttactaaaaatacaaaaaaattagctgggcatggtcgtgggtgcctgtagttccagctactcgggaggctgaggcaggagaatcacctgaacccgggaggcggaggttgcagagagccgagatcacgccactgcactccagcctggggacagagtgagactccatttcaaaaaaaaaaagggaaaaaaaaatagaaagtctcacccctcagaaataactactgttataaagtacttttaaatatataagcttaaatgtgtgctacttaattttcctgcttaaaatttccccttaaaagaattatgttttaacaaatagcattagaacatccagtttaatgtaattaagccactacttttgtgttccacattgcaaagtagcttccagtcttaagtgatgaaatatgctttctactaagacagccacgtgctctagaaatgaaggctaagatccagtctgttaaattaccatggaattcccttgctttgtatgtggctgtttacttagcagtatatgccctttattctgtgctgataggccattctttggtaatagagcagcttaagtctgaagagctaaagctaaggatctagaagaaaggaataatcatttatggaagccaaagatacctttttttttttaggataaatttctctcctttttgtttttgtttttgtttttttgagacagagtcttgctctgtcacccaggctgcagtgacacggcaagcttcccagtacctgggactataggtgcgcaccaccatgcctggctaatttttgtattttttgtagagatgaggtttcgccatgttggtcttgaacactttttttttgagacagaatctcactctgtcatctgggctggagtgcagtggcgcaatcttggctcactgcaacctccgcctcccaggttcaagcgattctcctgcctcagcctcctgagtagctgggactacaggcatatgccactgcgcccagctgattttggtatttttagtagagacgaggtttctccatgttggttggccaggatggtcttgatctcttgacctcgtgatccatccgcctcggcctcccaaagtgctgggattacaggcgtgagccaccgcgcccagccaggtcttgaactcttgagctcaagtgatcctcctgccttggcgttccaaagtttgggattacaggcgtgagccaccatgcctggccagaaacttcttttttgtttcctgtgttttgttcccactctacctggccgttgacataattaacatgaaatttgcaggaatagatctcctggattgtcttctctatgtatgcttttcttcctgctgtccttgtattgtgtgtcctaattttattctccacccacaccccttccccatcaaatttgttttatagaataaatgtgtttttatatatctttgtccctcttgtataatcttttgataattgtctactttcatttttgtgacatgttcctctatgcggaatgatactagtgagtttttgccaataaatccaatgtatgtaacttggagcattagctagattaactttttggtatggtaagacatcctatagcagcaacagattttagcccacagtgtgattaggctatttgaatgaatgaaatttgctgtatttggatttaatcttctaatccagtttttgtctttggggatggttggaacatagtcatcataatgagaactatcaattgtctttcatagatagtgtctctatcttcccagtttctgtaagttctcttcctgagtgttatttgctgcctattcttactacttttcttattttagatcacagattctgctggccatattctctactccaaagaggatgcaaccaaggggaaatttgcctttaccactgaagattatgacatgtttgaagtgtgttttgagagcaagggtgagtaatcaagagtgtttctctggattaagaatcttctccaactctaatgctccttaatacagtcagcacttaatatctagtttcatttgtattctttatttattctgatttggagacctgttaccttgtagtctttggagcaccttttaaaaggtcgactacatggaataaaagattgaataggtggaacagagagaatttttagggcagtaaaaatattctgtatgatactgtaatagtggatacatgtcattatatggttgtccgaacattacatttggaatgtacaccaagagtgaatcctaatgtaaactgtggactttggtagatagtgatgtgtccatgtaggttcatcatttgtaatgaatgtaccactctggtgggaaatggtgataatgggggaggctatgcatatgtaagaggaagggggatatgggaaatctttgtgccttcctctcagttttgttgtgaacctaaaactgctctaacaaagtgaagtcttaaaaaaaaggctgggcatggtggctcatgcctgtaatcccagcactttgggaggccaaggcaggcagatcactgaaggttaggagtttgagaccagcctggccaacatggtgaaaccctgtctctactaaaaatacaaaattagctgggcatggtggctcgtgcctgtaaccctagctgctcaggaggctgaggcaggagaatcacttaaacccaggaggtggaggttgcagtgagcaagattgtgtcactgcactccagcctgggtgacagagtgagactccatctcaaaaaaataaacaacaacaacaacaaaaaaaactggccgggcgcagtgactcacgcttgtaatcccagcagttgggaggccgaggcgggcggatcacctgaggccaggagtttgagaccagcctggccaacatggcgaaaccccatctctactaaaaatacaaaaattagccagatgtggtggtggcacatgcctgtaatcccagctactcgggaggctgaggcaggagaattgtttgaacccaggaggcagagattgcagtgagccaagatcgtaccactgcactgcagcctgggtgacagagcgagactctgtctcaaaacaaacaaaaaggattgtctgtttgccaggcaaatgcagagagaaaaattatgaagggtccttttacaaaggagactctttagggctatgatgtcagctaagaggataggctgacagttctatgcaagagactgtatagtctggactcgaccattctgagaaatggtggttaggtgatttcgttgtgcaaatattaagtgtacttacacaaacctagatgttatagcctactacccacctcggctatatggtatagcctactactgctcctaggctacaaagctgtaaagcatgtgactgtactgaatactgtaggcagttagaacacaatgctatttgtgtatctaaacatagaaaagatatagtaaaaatacagtattataataatcttatgggaccaccttcatatatgcagtctgtcctcgactgaactgtcttcatgtagtgcatgactgtactgtgctgtgacaatcagggaggtagttggaagaccttgtaagaaagaagatatcctgatcatttggaccaggtggggctgtgaactgcttaagtttcacaactttttcaatgaggaagtacatcttccatggacaatgtcgtaatcaggattacacattggatttgggagaacagaacactctgggtgccacattttgttttgttttgtttgaagacttgttgttttcatgctcagaagacacatgtgacttgtcttactttgttctcagtcttaccctgtgcagtcttatttatatttctcttgctttcgagttaatctttccagtctatccaaaagaagtcctttttttgtgtgtgtgtgaaacaagagtcttgctctgtcacccaggctggagtgcagtggtgcgatcttggctcactgcaactttaccgggttcaagtgattctcatgcctcagcctccggagtagctggaactacaggcacgcaccactgcgcctggctaatttgtgtatttttagtagagacgggtttcatcatgttggccaagctggtctcgaactcgaacctcaagagatccacctgccttggcctcccaaagtgctgggatgggcctcccaccgtgcccatcccaaaagaagttctttactgtctttcaagcatgccatactccgattttaatatctgagcctttgctcatgctttgccatctgcctagagtactttgcctaagtcctgcctttaggtgttccctttttagtgaagtctgtccacaactacaatcttctctcctcttccctttgctccatattggaattgtctgaaccagttcctttggcttaaacttttacagtgctttgcattttcaccatagttgttttgtgtatatgtcttagatcccaattgaattatttgaaggcagggattgtatcctggcttagtccattttgtgctgctataacagaacatcgcagagtgggtaatttataaacagtagaaatttgtttggttcatggttctggagtctggaaagtccaagatcaaggggccacatctggtgagggcctttttgctgtgtcacaataacatggcagaaggtatcacatggcaagagaatgcacaggagagcaagaaggggctgaactcacttttataacaaacctacttctatgataatgacgttaaatctattgatgagggcagagccccatgacctagtcaattcttaaaggtcctacttctccgccaggcacagtggctcatgcctataatcccagcactttgggaggctgaggcaggaggatcgcttgagcccaggagttccagatcagcctggacagtatagcgagaccctgtctctacaaaaaatacaaaaattacctgggtgtggtggctcacgcctgtagtcccagctacttgaaagactgaagtgggaggattgcttgagcccaggagttcgaggctacagtgagccatgatggtgcgtgccactgcactccagcttggaagacaagagtaagaacctgtctcaaaaaaatttttttaattaaataaataaaattaaaggttctacctctcaacactgttgcattggggattaagtttccaacacatgaactttgagaggggcacatcgaagccgtagcatatctctttaaaatctccagcacagttttagtacttagtgagttttcaatgagtagttattgaattgacttcagttcatttcagaaaacttccagtgtctctcaggcatcagagggtacagtaccattcagtgtggcttatggtttcaggaaccccagtgcttcagtggcactgtttcccacaacttctaatttcatgcaggcagttgtaaattttataactaggtgaattccaggggattggggctgaacagttttctggggctccttgggtcttttcctttctcctgcttgatgatttaagattagaatgcttctttgatccagctgaatcagattgactcttctaacatgaactctattataagaagcatccctgagatttgaacacttaaagttgttttttttttttccttgagctgttgtaactcttttaagggcttagtgggaatagctctatgacattgtactcctactgaactaggccatacattgatcaaaatgtttgaattaaagtggaatattagataaaacttatgttcttttcagtactcagatttatattaagtaaatccaagcttagcacatatccaataatcctaattcatcatggccttccctcaaaatttgacagggcaaccttttcagatgtggaaatacacattttcagccgaagttgttgcctactatctcttgatttatatgccactcaatttcacactgttttgatttttgagttttatttcccaattcaataagcctgtgtggtttcccttctgttctgttcctctgtagtaccagttgcagtatcttgtgtccttgcctgctcagagatgtttgccagcagcatgttcttgttgctttccggcaccccacacagatagaggctttgtctggaatgtttgtgattttagccagagccaggaattttctgcaactgagcagggggaggagttgtggctgtttccctctattgagagggtaggggttctgtagagggagggcgggcgggcgggtgggtgggtaatttcccagaattttaagtatttcacacaatgattcctttgatttctttctcaggaacagggcggatacctgaccaactcgtgatcctagacatgaagcatggagtggaggcgaaaaattacgaagaggtatgtcctgctctaacagccagaggaggcagcagtgtgctatgctgtgaggtttctgtgacctcggcaggccaacaggctgtgctttgcccaaagggctgtggtttcttagcagtcttgtgacagccagccatgatcttactgatacaaaaagtggtattaacagccttagccgggcgcggtggctcactcctgtaatcccagcactttgggaggccaaggcgggtggatcgcctgaggtcaggagttcgataccagcctggtcaacatggtgacaccaagtttctactaaaaatacaaaaattagccaggagtggtggcgtgcgcctgtaatcccagctagtctactcgggaggctgaggcaggagaattgctggaacctggggggcagaggctgcagtgagccgagatcgtgccactgcactccagcctgggcgacagggcaaggctccatctcaaaaaaaaaaaaaacagccttgaagaataattctggctgtgctgtcagccaaagactgaacaaactgtcccacagaatgttggtttgataaaacactgaagcatatggcattagttctcttgaactgtgtgtgtgtagagagagatattttaaattttttaaagctggaattcagttatttgttaatgcccaaggttaagaaaagtgatttgtttttaattcctaagactttttccccaagaccaacagttgtatatctatctatctatctatctatctatctatctatctggggcatggattcagtgctgtttagtcttgaacaactgttttgtgtttgggaaataacaatagtcaaagatagtttttagttaaaataatttcaaactttcaaggaagagggcaggatggaggaaaaagctgcaagagactaggaatggtgataatagaaatttgatgctgataagaagttatttattatagactaataaaaactgacacttatttgggtgacagggagatggaggtgtacacagaatgaggagaaggacaacagcctttttcatctctgcgagacttgggggcagcacaaaagggttcttcaaatgaagggcacctttgaaaaaccacaagaactatttaagactagataattgatctttacagaaagataagagtatttttacccaacaaaacagtacgtaagggcatgaaggaggagtggggtacaggaaatagaatgggcttttgaagaatgcaaactaagtaaatgaaggaaaattggtttaagtgatttaggaaaattgtctaggaatagtggaacagaagttgctctctctttggacagcactttggaagggaaatatcctaaaatggaagaagattggaaatgactggttaattctgcaacaggaagtagtacaacagttgcagctctttccttgttcaaatcctcaattgaatgaaactaggtagcgttatttagaggcagtaaataggagcaagtgatacagttgtgaatgggagacagtttccggtagagaattttcaattgtttgtttctgtttccaggctagtttaatttaaataaataaaacaagaagacctctttatttgatgaacttgagtaaattgaaaaatttttttaaaccttcatgattcagaagaatcttaattatatttaaataagattatgttaaagtgcttttataagatataaaacactagggagaatgttctcattattataaggtagaagaataggtaaaatgatttccagtttgtggttactgcttctgttcccgaactgtggaccattctcagttgaatttgtactctgtggaattttacctattgtaatctttttctccaacatgatgcctgtcattaagggtatttatttatttatttattgagatggagtctcgctcggttgcccaggctggagtgcagtggcgggatctctgctcactgcaagctccgcctcccgggttcacgccattctcctgcctcagcctcccgagtagctgggactacaggcacccatcaccacgcccagctaattttttgtatttttagtagagacggggtttcaccatgttagccaggatggtctcgatctcctgacctcgtgatctgcctgtcttggcctcccaaagtgctggcggattacatgcgtgaggcaccgcgcccagcccaagggtatttattaaataacaacacatcaatgccctattagacagtagacatagctagttcccctcaaaaacagatgacattattgtgggtttatataaagaatgctttggacacagctgtcttatagcattttagaacccctatacctcctggaatttccatcatccttggactttatagacattaggaaaggggctttatctttcctgaccttttgcttaacccaagaggggaatccctagcccaaagaaaaccacggtgcttcctttgcctgcttcctgcttcagacgtctgacatgtcctaagcctgcctttacgcatgtagttacaacacagctccaaggttctgcttcttaaccaagaaactcctccccactactttctttaacatctatccccaccctcctgcccttcacccctgctccccagcagcagaccagattgatgtagaggaggaatggctatgacacagtccgaagaccagccctttcttcagtctgcagcaaggctgccttgaaccttgcttagaaatggctgttagctggcagggcacggtggctcacacctgtaatcccagcactttgggaggccaaggtgggtggatcacccaaggtcaggagttggagaccagcctggccaacctggcgaaaaccccatctctactaaaaatacaaaaattagccgggcatggtggcgggtacctgtagtcccaactactcgggaggctgaagcaagagaatcacttgaacgatttaatttcaggcccttgagataatggagaggctttatctccagaggatttggaatctttggcatcagcattaagattcgggaatgtggcatacttctttaattttcatgtccaacacatctctccctcatatctgtggactcataattctgaaatcccatgtggtcctgtaagattgaatagtaattgtaccacactacctacctaaattgttattaattaatccatgtgaaattgctatgtaacacaatacaaatgtaagatgatattatttggaagacagaatgcttgtcatactgtgaagaagcattaagtcttgttgtttgaattctttaaagagaaagaatgcctttgtcctcggaaataaagcacttttgattttgatttcttgcattttattttatgaacctctgaccactgtctcacttctgcccttcagagggtgtatctttgtagattcaggatgtgaaccgagccacttctttttagtttgtcatctgtgaactagagcagttgtttgtagggacttactgtctgtgcagttgggagaatgcaggcaattactgtccgacaaagaaggagctatctgacacatcttctaactcctgggctgtgtgtcccacgagtaaaataccgctttgcctaggcgattctatttgtctgtcatttgctatcaatctatattccaaaaacacagctgccctggttggagcaacagctgaagactttccaaaagttctgtttctctgagtgctctcaggaaggaggaactctgattccatgtactagatccaaagtccttttttttttttttttttgagacagagtatcactcagttattcaggctgtagtgcagtggcgtgatcttagctcactgcaacctctgcctcccgggttcaaacaattattctgcctcagcctcccgagtagctgggattacaagtgtgcaccaccacacccagctaatttttgtatttttagtagagacagggtttcaccatgtaggccaggctggtctccaactcctgacctcaagtgatctggccacctcggcctcccaaagtgctgggattacaggcatgagccactgtgccagctctgttatgtttatcttgcttgtgttagactagatggtcttcacatttattgctgtgctcctggagttggtgggggctgtggtgggaggcatggaggcagcaaactactttgactgaatttgtcttgtcacaagaagcttctctcttggatcttgatgctccaccaaggaaaagaatttagagattccctagaggttagattaacacctctgttttaagaagcagttttttcagagaattaataccttttcttggtacagttacatataactctgtgaactctttagattcaaatcttcattataatggaagatttggatatggttttagaagagtttaattttactggtattttggaggtgttatacagaaaaaggctttgtaacttgtagcttttccaaacagtacctaccatgaccagtaagaatgatgttaatagatatggtggtagagaaggctttctcctaggcggcgggcctcatgaaaatagatgcaggctgggcgcggtggctcacacctgtaatcccagcactttggaaggctgaggcaggtggatcacctgaggtcaggagttcaagaccaacttggccaacatggtgaaaccctgtctctactaaaaatacaaaaattagctgggtgtggtggcaggcgcctgtaatcccagctactcgggaagctgaggcaggagaatcatttgaacctgggaggcagaggttgcagtgagccaagatcgtgccactgcactccagcatgggtgacaaagcaaaactctatctcaaaaaaataaaaaaaagaaagaaaaaaaatcaatgcagagtgcttttagtatacaagaaacacttgcttcaggggaccagcagcacttagctactttgagaaagttggcttctttgaagaaggcatagagtgggcagaacaggtcaattacaagtgtttaccaagtctcaggtctttacgactatataaactataaatcattttaatttccttgagttcaggagccaaactagtgtggagggacaggataaaaataaaacaatttgtgaatatgacaatatatgattgagtgttaactgtgtgacacagtaagtgttgtagggcttcagggaagacagtgtggacaagagtggttgaaggaggctttcaaggaggcttgaaagataggtcagatttgggtacagagagcataaatgcttttggaagtcagggattctgttctcgaattttacagcagagtttggcagtttaaatgctgtgatcaccctgggtagggagttaagagaccatggtactgttaattttggttggacacccaaagggctgagtaactttatggaatctttagtttcctcatttgaaaaatgagggactcactgcaaaatgaagcaccttgtaactataacatcctttgattatttaacaactacatgcagcttgccagggggatatcaccccctattggagaacctgtggtgcacattgtcttacagacttggcaaaacatacctcatgcttccagtgatgaaggagagtagaatagaataccagcctgccttcatgaaacatgtataatttggcatttttacagatactctgaacagttcaatcaactgcttacaagagcagaataacagaaagtgggaattttgatattgaggattttttagctttttgtactgtgatataaagcctcaatgctatgtattgaatgcttagtccagagcaagtaaagagcgtcttcttgagaatacttaccatgatttgttttaaaattttactctgttgccctgcaaaaataatagcaatgggaaacccaggaagtttattagtcaaactttattagtcaagcaaacaggacaacttatatagatccttgtggcctaatatagcttgttcatttcacctttgattcaggaaaaacttagtatactcatctggttttctttattaaatttctagtacttacagaataaactcacatagacttggattctaatgccaactgcaccaagctgtgatactttgggcaaattatttaatacctcagagccttagtttcctcatctgcaaaacttaaggataaaaatattcaccttatagggttacgaggattaaatgagattacaaaatatactacattgtgagcatatatgaatggctctgattcattatactacctttttcatccccttccctaatttagtctcagcctaacttttgagccttttatttgctattatcccctaccctccccaagcacaagtgtgtggcagttatgtgtgtacatgcacacataccctatagtctagtttctagcacaccagactacttatgtctagactattcgtagttgctaaacatgcctgcactttactccctccgtgttttggtttacaggttcccctcagccttgaatgccctctcaaaagtcctgcccaacttgtgagacccagctcacccacttcctgttaagcttcactttgtcctcccaactagaactgtttttaatgtgtattttttgttatagaagttactacataaagccatatattatggttataacttactatgtaagctgtgagagcttaagatcataacttaccttggtaccttgcacataataagaactcagaaaaaaacgttaaggccttaaaatgtttaaaaaaaatcaagaaacttttttatatttgttttaagctggtaataaaagtctattgttatatattcttgcaataaagtttttttttctttattattattactactttgtaatagagatggggtcttgctgtgttgcccagcctggtctccagcaatccacctgccttggcttcccaaagtgctggtattactggcatgagccactgtgccctgcctgcagtgaaggttttttgttttttgttttaaaccactgactactactactacttcttcatttatttatttttttgagacagagtccacccagcccaggctggagtgcagcggtgccatctcagctcactgcaacctctgcctcccaggttcaaaggattctcgtgcctcagcctcctgagtagctgggactacaggcatgcgccaccatgcccagctaatttttgtaattttaataaagactgggtttcaccatgttggccaggctggtctcaaactcctggtctcaagtgatccatccgcttcagcctcccaaagtgctgagattacaggcgtgagccaccacacctggctaatttttttcttttgtaaaaataaacaggccaggcccagtggctcacgcctgtaatcccagcactttgggaggccgaggagggcggatcatgaggtcacaagttcgagaccagcctgaccaacatggtgaaaccctgtctctactaaaaatacaaaaattagctgggcgtggtggcacgtgcctgtaatcccagctacttgggaggctgaggcaggagaatctgggtgacagagcaagactccatctcaaaaagaataaacaacagaaatttatttctcatagttctggagtctaggaagttcaagatcagggtgccagtgtggtcaggttctggtgagggtcctcttctgaatgcatactgcctcctcactgtgttctcacatggaggaaggcggaattactttccttaatagcatttaattgttaagtccgtcagattttggtggtttgaaaagatctttgttctttgatttcctccaaatattatttggatttctaggtttagattcaacatagaaatatatccatgattgttgttttttactattgagtatccatggtgtactaggtgtttggaatggcaagctagatttcagtactgttttagtctcttgagatttctttaagatttctagattttaaattagtatcatgagtgaaggtacttattaggcaaaaatggcttctaggaaatgagaccaaaatgagaccttcatcccactaatgaaggtctgaaaataattttctggatgaaagatgggattcaatagatttttttttttttttttttgagtcggagtctcagtttgtctcccaggatggagtatagtggcatgatcttggctcactgcagccttgacctcccaggctcaagtgatcctcctgcctcagcctctcgaagtattgggataacaggtgtgagccaccacgcttggcctcagcagagattttgttgaggaaataaaatcaactttgaagataggaatttgactgtttggttatgaatagaggtgtagagtctgaagtagcacctgtactagaaaaggggttgggaattgaatgattaactaaacaatgtggaatactagctgtgtggaatgctgtgcagcagttaagaataagatgaattgataagcactgacatttttggaaagatcttactaaatggaaaaaagctatagaacaatgtgtgtagtatgccatttataaatagattttaagttatatttttctgtgtacatttacatacaaaagcatagtgtctcagaagaaaaggtgtggaaagataatacatcaagtttataagcatctttacctctggaaagcaatgtgggaattgaggaaccatgaaggtagacttttggtttatattctctttgcttctggatagtttaaatttttagccaaagaatatatttatgtgttggttgtacaactaaaaaataagttttattactggaaagggattgggaacagcttgtggggggctgtaatctacaaaagccatcttcagtaccaggtttaattccatcattgtttttcgggttttaggtctctggactattgtcctttaacaacaacaacaacaaaaataaaaaaaaaaaaaaaaaaaagaagcaaaggctgtgggattcagtaggctttaaagtaattttttttttaatatcattttcagctggcagaggcacagccatagtttcacttccagtttcttttgcaagtttctatttagggaactttaaataatttatctctaagaagtatcatgccatttcctttatactgtctcatttaggaagctctgagtggggaagtatagagcaggagggaagatgttagactaaggttcagcttgtatagctcctgtatttttcttgaggaatttttttttgttctgcagctctatatgagatcaatgaacagatatatattctgggttaatgacaaaacctggcatttggccattcacttaggaaagttagctctgtgcattaactattggttaaatcttacacccagaagctgttctgcagttaccagtcacaccgttaactctagccaacattttacaaacgcaagaaaatgtgcttctggtgagagaaaactgtaggtgtatcatcgcaagtctatcaccatatttttatggaccttaaatataaactcaatttttacatcccaattttaacagcagtttgttttattttaaataacttttgttcatcacacatttagtgaagaatataataagaaaacataaaataaatgcctcctattcatcccttgttaactgctgttaacatttcacaaagaaaaggacaaggacaatgaattgaacaaaggagagaaaaaaaagtgggccatagggaatgtacagtaaatagggagtaaagaagcagatatataaacagaattattaaggccaggtgcagtggctcacgcctgtaatcccagcactttgggaggtcgaggtggatggatcacctgaggttaggagttcaagaccagcctggccaacgtggtgaaatctcatctctactgaacatataaaaattagctgggtggggtggcacacacctgtaatcccagctactcaggaggctgaggtgggaggatttttttgaacctgggaggcagaggttgcagtgagccaagatcataccactgtactccagcctgggcaacagagtgagactccatccttaaaaaaaaaaaaaaaagaaagaaagaaacagaaattttttttttttttttgagatggagtctcgctctgtcacccatcctggagtgcagtggcacaatctcagctcactgcaagctccgcctcctgggttcacgccattctcctgccgcagcctcccgagtagctgggactacaggcgcccgccaccacgcccagctattttttttttttatttttagtagagacggggtttcaccgtgttagccaggatggtctcgatctcctgacctcgtgttccacccacctcggcctcccaaagtgctgggattacaggtgtgagccaccacacccggccagaaacagaattattaaagaattctctatgtggaaactttaagagcaactggtatgtaaaagttttaagatctggaaagctggccgggcatggtggatcacgcctgtaatctcagcactttgggaggccgaggcaggtggatcacgaggtcaagagatcgagaccatcctgaccaacatggtgaaaccccatctcgactaaaaatacaaaaaattagctgggtgtggtggcgcacgcctgtagtcccagctacttaggaggctgaggcaggagaatcacttgaacccaggaggcagaggttgcagtgagccaaaaccacaccactgcactctagcctggcaagagtgagactccatctccaaaaaaaaaaaaaaagatctggaaagctctggtggtgtatctcattttaaagcaaagcataatctaagactgataagaaaaaaacaataatgacatctttgctggtgtgacagatgcctctagttattagatactcttaagagttttcttaggggtctaacttgagagcagaagacagttaatttctttctcacatccttcattcctcagcatacagggaattccttgaagatttcttttgataactggctgtgtcattctaaaagaaaaaaatacataaaaaattcagtgcagttttctcacatctgagctctgatattaaaccttaaagttgttgtaggatttatatgaaccagaattctctaattgtgtattttgaattattactttaatgctataacaacacatgctcacattcctatgtactgtcaaaggtttaatgaatttagtggtttttcttctaaaaccaggtttgacttaatatgactcccacatttattgtattaacaatagtttacttcttagacatgagtggaagtgcaaagtaaagtgctttactaaagtcaaaaatcagctgggcatggtggctcacacttgtagtcccaacactttgggaggccaaggcggacagattgcttgagcttaggagttcgagaccagcctgggcaacatggcaaaaccccatctctagaaaaagtataaaaattagctgggtgtggcagtgcatgactgtggtcccagctacttgggatgctgaggcaagaggattgcctgagcccaggaggtcgagcctgcagtgagccaagactgtgccactgcactccagcctgggcaacagagtaaaaccctgtctcaaaaaaaaagtaaaaaatcttgagacaatagtatatcttactttatagcctacggttattatattacttctaagattttagtcaaaattaaagtatcaaaaaaggtctgaaatggaaagatatagtctatagggaaagaaagaagcccaaattttaaaatatgttaggatgattgataggagagaatttaaatctggtgaaactttaaaaaagacttctctgttgccttctttatgttcttgactgaagcgatgttttcagagagctgaaaatattccattcttttccagattgcaaaagttgagaagctcaaaccattagaggtagagctgcgacgcctagaagacctttcagaatctattgttaatgattttgcctacatgaagaagagagaagaggagatgcgtgataccaacggtgagggggaaggcgactcttacttcttaagtgacccataaatgagacagtctccaaactttcaattctggtgtacccttttctcagttttgccaaggtgggtatatggaggggaaattgcttgcttcgctgttgttgctgctaaaggtaaatgagccttgttagattttcaagagagtagaaactcctactgtgataggcaggtgacaacatcctcaattagtctatacccacatcaaactgatagcaccaatctttgtaattttcaacatttatatataggataatgaacttttatttttatttatttacttatttttgagatggagtctcgctctgtcgctcaggctggagtacggtggtgcgatctcggctcactgcaacctccgcctcctgggttcaagcaattctcctgcctcagcctcccaagtagctgggactataggcacaagccaccatgcctggctaatttttcgtatttttaatagagacagagttagccaggatggtctcgatctcctgacttcatgatctgcctgcctcagcctcccagagtgctgggattacaggctgggattacaccatgcccagccaggataacgaacttaaaaagaaaaattatctgaaatcctactgttagacctagggacagagtgaagttaattaattgcctttacccacctcccctgccattgtttagccagctgaggaggctcacttcattacgtttacaatgcttttgtttttttttagagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagtcatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctgggaatataggtgcacacc

SEQ ID NO: 13470 - DNA, 38814 bp, Human
aagttttctaagataaactcagtggtttggtttttattattaatagagatagaactattgtgtgttaatgttagcattagtcaataagttattttaatgtcagatttttgaatgttattatatattacctgtatgatggaaggattaccactgtacacaaatctaatcaataaaaacgttagaaccttctgcttagagtacttttaaaaaatcttcagtgaacttccttttgggcgaaatgagaggtctttattcagtaaacatttgtaggaagaggattttgaggtaatttaaagaggtctgaaagaaaaaaagtctgagtcatttctttaaatggtttctatgaaatgttcttcaagaaattccatgcctaataagaacaaataccacaagttcaatttgttagctctgttcaccttatgtttggatgaattacttctgctgttgtttcttttctctgggtaaggaattcacataaagttatgttatgggctgaactgtgtcccaccaaattcatatgttaaagtctcagtccccagtacctcagaaagtgactgtatttggacatagggcctttaaagaggtgattaagattaaatgaggctgtgagggtgggccctaatccaatctgactggtgttcttataagagaacatattggctatagacacgtgtgcaaaaatcaaagaccctgtgaaaatggccatctacaagccaaggagagaggcctcaggagaaatcgttgctgccaacaccttgatctcagacttccagtctctagaactgagaggaaatagacttctgctgcttaagctactcagtctgaggtattttgttatggcagccctaggtatagtaataatcataaacagttatcaggattttgcttaatcagccctagaagactggttggttgggtttggttagtcactaaactagcatatatcaaatgcttaccaggtctgacaaattcgttataaattccactttaaattctcaatgaaaatgagatagaaagcaaaaactaaggactggttaacaattccaaaacactttattctcacagcattctcagagttctgctctcctttagttatttttataactaaaagctgtggtggcactggggagattcaagtcagtgaagagagtcttggtgttgtcatctgtaaattaagagttgagcaaaggccgggtgcggtggctcacgcctgtaatcccaacactttgggaggccgaggcgggcagatcacctgaggtccggagttcgagaccagcctgaccaacatggagaaacccccgtctctactaaaaatacaaaattagccgagtgtggtggcgcatgcctgtaatcctagctactcgggaggctgaggcaggagaatcacttgaaccctggaggcggaggttgcagtaagctgagatcgcaccactgaattccagcctgggcaacaagagctaaactccgtctcaaaaaaaaaaaaaaaaaaaaaagagttgagttagacagtttctcagccttttccagctccaaatgccataattctaagatggcaggctctggaattattcattcattcggtgcctaccataggccaggcactgttcttggtaactgggatacagcagtaaacaaaatatataaactccttaccttcacatagcttacattctagggagagaagacaataagtaaacacataaaatatatattgaattaaacggtagttaagagcaaaggtgaaaatgagaaaaaaaaggaaagggaaaacacgggaaaaaaaaataaaaacaaaagtaaaagttacgacatagtctttaacaccatgccaaaagggaataaggattgagactgtaggtaccggttcactgaaccctgggatgcggatccttggctggaacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggtgactctgggggaagcacgcgacgaaaagatgatgccggggtctcttctaacaccagaagggccctgatgatggctgcgcgcagctttcggagccggatgcgcgagggccccggaggcccggcggcctggcggccgggcgggcccagtttggggacaaggacggggctggccagggaggggctgggcctggcgggaaggcagcgctgccccggactcggcccgcgcggccctcccaggcccccgtgccctggatccaggcccgtgcgtcccgtcagtcccaggcgctgggaggcgtcatcaggaaatcattgggtttacattaatcggaatacttgttaaacgtttacccctcagttgctgccggctgcttagtgcattagcttagaaagcagcagaaattctgcagttaagagccctgatttgtcccgagtttggaaaaccggccccaccgcctgcaggggcccacccacgtggctctcactgatggagaagaaggggagacctttaatggcactggaatcttagggtttggttttttttgttttgttttttgtttttgtgttttcacttgcaggaaaacttaaaatcaagttcaggcagccccatgccatcattattattaccaaggtagtttatgcccatctgtaaagaccaaaagaatattaataatgaccttctggccgggcgcggtggttcacacctgtaatcccagcactttgggaggccaaggcgggaggatcacttgagttcaggagttcgagaccaggctggttaacatggtgaaaccccatctctacataagagacaaaaattagccaggcatggtggcgagcgcctgtaatcccagctactcgggaggctaaggctggaggattgcttgagcccgggaggtgcaggctgcagtgagccgagattgtgtcattgcactccagcctgggtgacagagtgagactgtttcaaaaaagaataataacgactttctaaaaacatcagagtaatacatgaacaggatttaacaatcaaatggcaaagaaaggtttatatgaaaaggaattttcctgctttatcttttcccattcccagcctctttccctgaggtgactatacttaaccataataataataacctcttaatgcccccaatctctctttgatacaatttgattcttaaaatttcttcctattgcttcaccttattacaatgtcttagcaattcattataagtatttttctaaaagtcatggttattgtgtaatgtataaatgttatgaaactagcttggacatttttgtcatgaataatttctagctaatgttccttagctgtatttaatttaggcatctgtttttggtgaagtggttagaatttcgaatactgtgtttactggtcaacttcaagtgtaattatgatttcactttaggacatgtgggatttagaaaggagcattgaaaattatgaaattatgaattttttttggatgttaatccattgcaccaagcatgagctgtgcctagagatcagcggtataactttgttttgctttgtttcacaatttggtttaataagagtgatttcatttacctcaagtgctatttcttcataatgctgtgtaatgctaaagctttgattatgtgcgtgtgtggtttttttctccaataggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcttagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatggtaagtacgtagtattcatgtgcatgagatgcttttgaagatgggaatgctggacaaggagtaagatcctcattatccaaagagattatctcaacagatagaacattttgaagaccacttataaaacatatgttgtattttcatgctatatgaagatttgctacgtccaacactacttttttttttttttttttttgagacggagtcttgctctgtcacccaggctggagtgcagtggtgcgatctcagctcactgcaacctctgcccccctggttcaagcgattctcctgcctcagcctccagtgtagcttggattacaagagcatgccaccatgcccagctaaatttttttattttcagtagagacaggatttcactatgttggccaggctggtctcaaactcctagcctcaagtgatccacctgcctcggcctcccagagtgttgggattataggtgtgagcccgcacgcagcctctaggtccaacactatttaaatggagaagtacagtgaaaggatgtcagtgtgtgtatatgtgtctatgggtgtgtgtatgtgtaagaaagggggtgatgggtatatacctagagcaacaacaaaaggggtgagactgtccaattttaataaaaatgatactattaatagttgggaagatccacagtactttcctaccttgttttcccttcctgttaaatgcccagctttcctagaaatgtgtctttaaaggcacctgcagtgtcagcatggtattttactggaagtttctctgcgtggcttccaggttaagggccagaatgattctgtaatcatcctaggtttcccagtaaactctatggcttagtacagtactacatttatgagctttttctttctagaaagtaggacttgtccatgaattttcaaaatataggtcaagtatatactttcatgactatacttttcaaatgtactttattataatgcatatggtaaaatctccttgatgtgtttatggtacaagtagctgttattcaggaagacaataatatggcatttatttatttgagacagagtttcactcttgttgcccaggctggagtgtagtggcgtgatctcggctcactacaacctccgcctcccaggttcaagggatcctcctgcctcagcctcccaagtagctgggattacaggcacccgctaccacacccggctaattttttgtgtttttgtagagacagggttttaccgtgttggccaggcttgtctcgatctcctgacctcaggtgatccacctgcctcggcctcccaaagtggtgggattataggcgtgagccactgcacccaaccaatatagcttttagatcgtaccacagggctacattagagcctgcactaggactctgggttctcggtccacatttaaagtgatattgctttggcagtgtgttgagagccagatgttgggaggtgataaagctgatttccatctggctataatcttggctttgcactaggaggataaacattacatctgtatccgtatttaaaattttgaatgctgcagaagaatggaacatgtataaatgtagttataagtcaatttctaatttctcctgacgatgaatatctctagcagaaagctgtggtttctttaaggttaaatgaaacctttacttttcagtgtttttctgtttttccttgtgaaaaaaaaatcactgtagtaacttcagtagtatttcatagtattttgtagtattcattaggagaaaactcatttctttcactgttgttcctgagactatcaagttgctcttaaagccactttatgtgcttttcaatctatgtggttttatgtcctgacttacactgaaggcttttcagaggtaaatctacagcactgacacctcatcttcctgaaatgcaactgcttctgatatggtgccaaaaaataactggattacattatactgtgagatggctgttgctaaaagaaagggggaaatcttagctgccatattcaacgtaaatatttcttccttttgaatatagacgtttaaaacactttaacctacttaacattctggattagcatacttttttatgaacttttgagggtcatgttaactgatagtttcctaatgaaaaatatttttggtatagaaagaagttccatgaacagatggctcctcagtaccctgctacctttctggaaatggctgatatacatcatgacatcaggacattgtcaaactttacataaaagtgttacatgaaataaattgttaaaagacaattttttttttttgagacggagtttcgctcttgttgcccaggctaaagtgaaatggtgcgatctcggctcactgcaacctccgccttctgagttcaagcgattctcctgcctcagcctcctgagtagctggaattacaggcatgcgccaccatgcctggctaattttgtatttttagtagagacgggatttctccatgttggtcaggctggtctcaaactcccaacctcaggtgatctgcccgcctcggcctcccaaagtgctgggattacaggcgtgagccaccagcctaaaagatacattttaatgtacagaaggaggatctataaaggtgattttgaggagtagtgtcaagtccccaagccttggtaattttttctttaaaatatattttatgcagttctttctattgtagttataaaccttatttcacttcattatcttaattttatcattcttaacctctccaggtttagtccaacagatttatctctcatgttttcctcctgttctaaagctgtcaaattcagcattgtttctaaaactcaaatctgattatccttcatggagaagaacagcatttgggccagatcttactagactctggagtttgaattgagaacctttcatttgtctacctgttcactttttcatgcagcatttgttgatcatccacactgtgctaggtgctgtcacgttgcaggttaactgactttgcttttaggagttcacagtactattagggaagatagctatctaaatataattgtattataatgagacaaatgttaggatagagacatacattggagataagagacataagttggagatttgtgaaggttgcaccaagttatggctgacaagtactgctgtatgtctaacacagggcttctctgggtaattttttgttgtaaggtttgtcctatgcattgtagaatatttagcagcatccgtggcctttatctgctagatgctagtagaacgtagaaccctttactcaagttgtgacaatgaaaagtgtctcaagccgggcacagtggctcacgcctgtaatcccaacactttgggaggccgaggcgggtggatcacaaggtcaagagtttgagaccagcccggccaatatggtgaaaccccatgtctactaaaaatacaaaaaaattagccgggtgtggtgacgcatgcctgtaatcccagctactcgggaggctgaggcaggagaattgcttgaacccgggaggcggaagttgcagtaagccgagatcacgccactgtactccagcccgggcgacagagcgagacgccgtctcaaaaaaaaaaaaaagggtctcaagacattgccaatgtcccctcgtgcaaaattgccccccagtgagaatcacagtgacctattctaggtcttcattctgtctggtatgaatagataatggaactaagcattaatatagagtcctatatggacagcataatttcattaaaggatttctgattctcaatctagtgtttagtagtctgctttatgtcttgactcagtttgtgcagaaagaggttttatgtgattaaatttttaaagagtttacttgtattttaagttcacatttctaggtttttctttcttatatttagggtctcagtacaggtgtcaaccttttagaagcgaccttgttcttcctttccttccgagagctcgagcagagaggactgtgatgagacaggataacagaggtaagggtggcagagagtgctggggcacacagtacacatcgtaccacctaactcaaaaaacaaagcaggcttgcattaagcttgatcagtgccagctgtgctgtactggaatcaggaattccccacggccctgtttaacagcggaactaattaattcagcgcatgcatttaggtcagaaattacttttccagacttgaggtcaatatttgctgattatgcatagtctgtggtgtcttgtgattaggggacatgtttcttatttttaaaaaggctggacttgcactccaagttgctgtagttttatgtaagcaaaactcttcaaaaaaagctacagacatcaattttgtgtgtatgtttaaaaatagataaggtatattttgcttaaaggcagtaaggctataaatttgagccatagcttctctgtcagtattccacaatatctcttttaacagtttggagaaaagctgtaatgccagaagatacagtcaccaactctagtttaaaaagtaacagatcaaaataatttagagatacagcaaacactgaacatttgtagaacatagaaacaatgtacgtgacctttggtcttgaggctatggctcaccaaacaggaaatgccattccctcctttccctgtggttctggatgccaactttacctgttcccttttgccctagatactgtggatgatactgttagtagcgaatcgcttcagtctttgttctcagaatgggacaatccagtatttgcccgttatccagaggtgggtctgtagcagtttttctttgccttttttttttcttcttcttcttcttattttttaaattttgagatggagttttgctcctgttgcccagactgaaatgcaatggcatgatctcggctcacgtaaccttcgcttcccaggttcaagcaattctcctgcctcagtctctcgagcagctgggattacaggcacctgccaccacgcccagcgaattttgtatttttagtagagatggggtttctccatattggtcaggctggtctctaactcccaacctcaggtgatctgcccgcctcagcctcccaaagtcctgggattacaggtgtgagccatcacgcccagcctttctttgcctgttattttaaactttgagtttcaagatgggtacagtggcatgcacttatagtctcagctactcaggaggctgaggtgggaggatcacttgaggccagaagttcaaggctatatagtgtgctgattgcacctgtgactagccactgcacactatagcctgggcaacacagtgagactccatctcttaaaaaataagtaaattagttaaaaataaaatttgaattttatttaagctgggtatgggcatgcaagactatattaatttgtaattatgattggaaactgggcatatttccaaattatgtatttggaaattactgtttaatgtagaggggagaaataaaatttatagcatttgggaactcaggcattttggattaaacatgtataatcaatgtgagaacagtgaatgtgtttaccactctcagaaaccctgacttgtagctttggcacagtattcagggtggtgataatgaaattgttatcattagataaagccacacatcttctactggaggaacagttcctcattggccccgcatggatgttctctcctcagtgtattttcacagaatgtactgtgcatgttataaacagggtgtataatagatgagcatttgtttaccagttctttcctcaagatatcatttgaggacttgatcatggaacatagacaaattgttgttgtgaaacaattttttttgttttgtcagtaattttgtttataagcaaaaatttttatgtaagactcattattcataaattcttttgaatttttttttttttttttttttttttttttttttttttgtgacagagtcttgctgtgtcgcccaggctgaagtgcagtggcgtgatctcagctcactgcaagctccgcctcccgggttcacaccattctcctgcctcagtctcccaagtagctgggactaaaggcgcctgccgccacgcccagctaattttttgtattttttagtagagatggggtttcaccatgttagccaggatggtctcgatctcctgacctcgtgatctgcccgcctcagcctcccaaagtgctgagattacaggtgtgagccaccacgcccggccgattcttttgaatttctataaattccctgaattaaacccacctctagtaggctaaataaaaatgaatgcttttaaagcactctgatatctttggtaaaacaattctgacacaaaaattaaaatttcaattatattttgctgagtctttctaggttgctgttgatgtaagcagtggccaggctgagagcttagcagttaaaattcacaacatcttgtatccctatcgtttcaccaaaggaatgattcattcaatgcaggtaaaagattaacttcaaaatctcataaatatatatatatatatatatggcctaactcttctaaaatttgatttatttaatgatatagaccaccttggtcaaggcacgtgtgtgtgtgtgtgtgtgtgtgtgttcttactagaacttttatcatcagaagaaaaagcaagggattaattataattacaaagaaagaaatatctttagtagtgtaagtaggtttggagggaatgaattatggattcaggctgacagtttcaaggattctcaaggttctcctgcagaagattatatattgactttatatttggcaataatttataaatcaaagtcctttagtgaccttgtccttaagtgtgcaacagtgcccttttagaaattaccttctattgtgtgagcctacacaggtttgggaaagcccatattgagaagtcatttcacaaaagggaccctttgtctgatctgcttttctattttgccttgtgtttaccaccatggctgtcttattccctttgttttcagtacggaaacaaattaggaggctaacaaatttgggtaaactcctaacctggcattgacctggtaccagagcaggcaagcagttgatccagaaatagaccctggggcagtggtataggctcgggggtattggagagcctcaagtacctagacagagaggaaccaccaaggtctaaagccaccagtggcttttaacttacttctttaatagactagcagccgggcgcgctggctcacgcctgtaatcccagcactttgggaggccgaggtgggtggatcatgaggtcaggagttcgagaccatcctggctaacacggtgaaaccccgtctctactaaaaatacaaaaaattagctgggcgtggtggcgggcacctgtactcccagctactcgggaggctgaggcaggagaatggcatggaggcaggagaatggcatgaacccaggaggcagagcttgcagtgagccgagatcacaccattgcactccagcctgggtgacaaagtgagactccgtctcaaaaaaaaaaaaattaaaaataaataaaaataaaaatagactagtttctccataatcgttttccttgctttcatataaattttaaaaatttatttcagcctgtatgttagcaatctctggtcacattacctattctcaagagtcactctgttgggaacatctcaggccttctctaaagtattgctagcacaccactctgagacgtgggagtctgtcttcccctgtcgcctccctccccttacatcttctgatcaactccacctgcccattctttcatccttcctagtgactttttctggttcatcagaaccttacccagtctcaaagaaaggagtgtgataaggcaaacaactctaaataaaatacagttctgtatctttctatgcaaataagcctttgttaatttttatttagtgttgtaccacttatttgaatgtctgacaggttctccagcaagtagataacaagtttattgcctgtttgatgagcactaagactgaagagaatggcgaggcaggtaagaatggagtttagcctgaatgactaaccagctggtcttcttgtaacctttttttaatgattatttttggtatataatatagtttcaatgatttggatggattagggaaagccaatctaaaactaagaatattatgaaggctgggtgcggtggctcacacctgtaatcccaacactttgggaggtgaggcaggtggatggcttgaggccaggagttcaggaccagcctgagcaacatggcaaaaccccgtctctactaaaaatacaaaaattagctgggcatggtggtgtgcacctgtagtcccagctactcaggaggctaaggcacaagaatcgcttgaacttgggaggcagaggatgtagtgagccgagattgcgctattacactccagcctgggcgacagacatttagttttatgttcatacacatacatatactcaggatgcacattaaactatcaagagtatttactttgggagtgaaaatgagggtgtgcaaaggagatatttcaacttttactctttttgtcttttttttttcctttttgtggagaacggggtctcgctatattgcccaggtaggtcttgaactcctgggcttaagctatccttccacctctgcctccctaacagctgggattacaggtgtaagccaccacgcccagcccatcttttattcttttaaatattttctattgtttgactttttaataatattttcatgttttccctttataataatagaaagtgtatataatgaactctgctaggtttgtcaatatttacacagaatctcttggtgacctgctctaatgaaacaataatagtttgtaaatatattaactcattcaacaagtattaattgagtgcccattgtatgccagggactgtaccaggccctagggatacaataatgagaaaagatatatatgcaagagaaaaaaataattacacaaacataaaattttagttctagcccctgtaatggagaaagagatacaagatgctctaagaacctgtattgggagatttgatttcatcagggagttcagggaagtgcttcttggtaaaatgaggtctgaatatgaatatgagttaactaagtaaagaaaggagggaacaaccatgcaatttgtgatttattctcctcagtgagtggaaacagggcaaggggaactggagatgaggctagagaagtaggtaggagtcagatcttaaatgccagctacaagctttgctttgtcccaatactgttggaaaccattgaaagcttttttttttcattttttatcatttgtattttgatgttgtttttggggtggtacatgtcacatcacatttgcattttaaaaagattgctctggttgcagtgtggagaatggagtaggagtaggggtggagtcccagttaactgtagattgactgttaaaagaatattgcaatatctgagacatggttagatgggaccagggtggactagagagcagtgaatgtattggaaagatatttaggagatagagtcagcagggcttggtgatggattggatatggggaaagtatgtaaaagatgacttctggtgttctggcctccatagctgagttgatgatgttgcaggacccgtgttgcaggcagagcagagaggatgaaaatcatgagttcagtctttgaaatgctccagaagagatgtcaaggtggccaggcacggtggctcacgcctgtaatcccagcactttgggaggccgaggtgggtggatcacctgaggtcaggagttgagaccagcctggccaacatgctgaaacgctgtctctactaaaaatacaaaaattagctggacatggtggcagatgcctgtaatcccagctactcgggaggctgaggcagagaattgctttaacccgggaggcggaggttgcagtgcgccaagatcgcaccactgcactccagcctgggtgacagagcgaaactctgtcaaaaaaaaaaaataaaaagatgtcaagaatgtggttggatattacaagtctggcctagacaagtgttctgacatggagatacaaatttgagccatcagatgcagaaaagtgatcactgaaaccctggatataaatgttatcacctagaaaaaagaagagtgaggagaggtcttgaatctagaataattctagcacttaagagctcggtagaagaggatgaaccagcaaaagagactgtgaaggaacagctagagaaataggaagaaaacagaagaatgttatgttggaaaaccaggatgtcatgccaaacgctgccaagacattaagtaagatgaggatcatctgattttgtgacagtagagattagggattttagcaagtgagagctgtttcagagaatagacaggacgagatgctgatggtgctaatggagactgcaaggagatactcagaaatgtgcccatgacacggaagagggactacagagggtgagggtgacagaggaccttttttttttaatgggagaaacttgagcacatttgcaagggatgcctgatgggataaagtccctgaaaaggcctgagtggctgagccctgagcagcagtggagggctggctccagcttgatagtacctgcaggcaagtgctaaagttttagagcatttattctctatgtatttcaaaatattccctttaccttgtttagtaaatgtcatagcagatcaaaggcaaattaacctaaagttctgtcagaattatcatgaatatagaatttgtgaagatcaaattcctatagttttactatttctagaaaagtaatagttttttgttgttgttgtttttgagacgaagtttcactcttgttgcccaggctggagtgcaatggtgcaatctcagctcactgcaacctccgcctcctgggttcaagcggttcaccagcctcagccttccaagtagctggaattacaggcacccgccacccacgcccagctaattttgtatttttagtagagacggggtttctccatgttggccaggctggtctcgaactcctgatctcaggtgatccgcccgccttggcctcccaaagtgctgggattacaggcatgagccaacccgcctggccaattttttttttaagttttcattatctggaattctttgttgtttttgagatcagaatctctactaatgatactcaagatgggtgtaactacaaaatctgcagatgttgaaagaagcaaaatggatctgttgaaatttctctttttttctttacttttttttttttttttttttttttgagatggagtcttgctctgtcgcccaggtgggattgcagtggtgcaatctcggctcactgcagtctccccttcccgagttcaaggaattcttctgcctcagcctcccaagtagctgggactacaggcacctgccaccacgcccggctaattcttgtatttttagtagagacagggtttcaccatgttggtcagctgatcttgaattcctgacctcaagtgatctgccctcctcagcctcccaaagtgttgggattacaggcatgagccacaggcccagccagaatctgtgttttaataagatccccagggggtatgtgatatgaacgtttgagaagcccaagtctaaggcaggataaacatggcccgaggggaatctgggcatcacctctttctgtacagccagggagatgggaatggtttttacattttttaatggttgggaaaaaaaaagaagactatttcttgacacattaaaattatatgaaattagtatttcagtgtccataaataaagttttattggaacacagctacgatattcacatattgtctatggctgctttggctcaaaaagaattgttgagtaggcatgacagaaatcgtgtggcccaaaaagcctaaaatatttatgatctggcccttcagaaaacgttctccggcttgtgatctaaagtgcactggaagtacattctttgtgggtttccaagtagcttgtacaccaaggttagctgattataacaatgtgttgtttaacgatcctttatcatattaaagttgaattaataaggcaaaatcagtatttaaacataagaattatatattcaagcttcaaacttgaggaaatgccactttgactttttttttttttttaagatggagtctcactctgtcaccaggctggagtgcagtggtgcaatctcggctcactgcaacctacacctcctgggttcaagcgattctcctgcctcagcctcccaagtagctggaactacaggcgcgtgccaccacacccagctaatttttgtatttttagtagagacagggtttcaccatgttggccaggatgatctcgatttcttgacctcatgatccgcccgcctcagcctcccagtgtgctgggattacaggtgtgagacactgcacccagccctgactatgttttctaaatgagatgctggtgaactaaagagtttcttagtttaccttttgtttcctaaaaaatgaaattatggggaaaataataaaacttataggataaaaattagtaatactggtaatctctggagagagaaactagaaggggtgggggcaagagtataaaggagactttattaaattcccttttgtgcctttcagaattggatctgggattcaaacatatgggataagtttgctatcattttccccataatttcatgttttaggaaataaaagatacaattgttactcctcagaatgttttgtcttatgctgttgttagatagtttgaattaagtcttctctgtcctcaacacacatgatggttgtcgtcttgctctgagaatcaaagttcacaatccttgctcatctaggtgggaacctgctcgtgctggtggatcagcacgctgcccatgagcgtatacgtctggagcagcttatcattggtaaggatctgtttgcagccagaaaaaatttgagactcccagcagaatcagtacacctcaaagagcttttctaactgcaactgttgtgagaaagcacactttgtactgtatgttcaaaaattaaactaaagtcctgcagtttggcctgtgttataattgaaagaatgtggtagttcactaattgaaagatgtgaacttatttatgtggtcagaggcatatttgccagatgttattaacaacccagaagtacgcaaggataggctgcttactctgacatccagcacaaagctctgcccctccatatgcccggtgatcttggcatgccttcccacactccatcaggcagagaccagtggcagctcagaaggcccagtatgctgttttgattttaaaatttagtttgcttttgaatatgcagtataatcaaatagatccaattctgaaaggcacaaaagggaatataataaagtctcctttctatccttgtccccacccctcctagtttctctccccagagacaaccaatatctctggtttttaaatctatctttccaaagcaatatatgctttttaaatgtttttttttgctacccttttcctcatcatgaggcagtgtgttcaccaagtggtaaaataccaggaaagtctttactcctgtggccaatgagtaatgtcaaagagttaggcaaggacctaaggagtgcttcatggactagaatggcaatgatattactactgttttcacttttccttataaaatgacggcctaagagttgggaaagatatagtaaaaacagtgttagaaaaacttacctctacaggccctgcaccatttgagaatagtactaattctctccagagactgggagaccctgctcaaggaaagggaagccttctggagccataagactgtgtggtcaacccacatatgttcctggtaatccacattattcacctctgtcatcaaaacaacatttattaactacaggaacattggcttgttcatctgaatgtaagatgcaagtcttatatttcttattttgaaaaatactaccaaaattgttaataggctgaatatttattagtttgactttaaaaatggaaatccaaaatctaaaactgaacattaaacattctgctttgcattagaatgattatctcaaggccgtgctttatttttatctgaatctagaagacttcccttcctactcttaacccattcatctttctgccaatagattcctacgagaagcaacaggcacaaggctctggtcggaaaaaattactgtcttctactctaattcctccgctagagataacagtgacagaggaacaaaggagactcttatggtcagtaccaccatgagaatgtgatgttgatggtatcaattctcacaataattctgtgaggaataagcataactattgttccatttctcagatgagaccaagagaggttacaagacttgtctaaggtcatagcagttattaagtagtggagcaggcactcaaaggcaggtcgtctgactccacaggctgtttgtttccttttttaaaatatatttttttctgcatccaatcatccattaaaatatttattttgtgagacatggtctcactctgttgtccaggctggagtgcagtggcacaatctctgctcactgcaacctccaccttccaggctcaagcagtcctcccacttcagcctcccaagtacctggaactacaggtgagcaccaccatgctggactaatttttgtaattttttggtagagatgggttttcgccatgttacccaggctggtctgaactcctaggctcaagcgatcctcccactttggcctcccaaagtgctgggattacaggcgtgagccactggacccagcctattctttccactgtatcccagctgaagagtataggatagagtttccctgataattttttccagcagttggcttagaacactcttctcatttcttggaacagtctgtgtttatgccatgctttgtgaaagcaaagtttctgcagtaattggtcccattctgctttgctttggtgcattctagactcttagttttcattatcgtaatcataatgggaagaaagtaaaacattgggatgtaaggaaggggcgaatcatatagtgagtcacaagataggatatttttcctcttctaggcagcacaaattattgaaaatgaaaaagaaatttctcccaatatgtttcaggtttgggaatatgatactgccagtaaatctttttttccctatgacataatttatattagaggcagatctatttacttacatcccgttagtcaggacttctcaattccttgggctgttaattacctccctgctttaatgctgattcaaatcactctcagaccttttcttcatgccagactcccttaagtgccagcagccagaagttagcagttcctcaatgaagaaaacacacttagaaacaagacttagacacagattgattcccaatggaaaagagaaaaacaataaaggttactgtaattcaaaaaggaaatttgataataaaaaatcccaaacacccacacataagtgtgagaaaaacaatacggttgttaagccctgtggcagcttttgaaaaactattaagtagtatttggaaccagtagtgaagtgcaaatgaagtagcactctttttttttttaacatttgaggttatctctttaggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggtaagacacagctgcagatgttaaggaaattgctgagtgatggtaacctcatattttgtctgtagattctctgaattcatcttttcttcaacaagtattcatggtatttacctgctgtgtgccaggagctagaaattcagagatgagttagctcaaaataaggaagaagggcatttaaagaattatagtcagtgaactttggctagtagaggtatgtgttttgctttcttcccagtgataaaggtaatgaaaactaagagtctagaatgcaccaagatagtttttcagaagtgttatggaaacacagaatgacttgtgtgcctggggaggtgaagtcaatgaaaatgtcacagaaaagctgttttcttaagaaaagtttttacttttgagagaccaggtctcactctgttgcccaagctggagtgcagtggtgcaatcatagctcactgtagccttgatctcctgggcacaagcaatcttcctgcctcagcctcccaagtaactcggactacagacacgcaccaccatgcctggctaattttttccttttttttttttgtagagatgggggcctcactatgttgcccaggctggtcctgaacttctggcctcaagcaatccccttgcattggcttcccaaacccccggcactacaggcatgagccactgcacacagccagaaaagtcttacagaatagtgggaaactaggctgggcaaggtggctcacacctgtaatgccagcactttgggaggccgtggtgggtggttcacctgaggtcgggagttcgagaccagcctgacaagcatggaaaaaccccatctctactaaaaatagaaaattagccgggcgtggtggtgcatgcctataatcccagctactcaggaggctgaggcaggagaatggcttgaacctgggaggcggaggttgcattgagccaagattgcaccattgtactccagcctgggcaacaagagtgaaactctgtctcaaaaaaaaaaagaaaaaaagaatagtgggaaagtgctgagtacagaagaggggagaagggcattctagacagaggaatacatatcagagacttgagatacatcctatgtttagggaactatcaatagatatggctcaaattaagatctacagttgatccttggataacttgggtctgaactgcacaggtacacttaaatgcagattttctttcacctctgccattcctgagacagcaagaccaacctttcctcttcttcctcctccttagcctattcaatgtgaaaatgatgagggtgaagacctttatgatgattcatttccacttaatgaataataaatatattttctgtttcttatgattttcttaacattttctttttctttctttctttctttctttttttttttttttttgcgatgcccaggctggagtgcaatggcacaatctcggctcactgcaacctccacctcccgggttaaagcgattctcctacctcagcctcccaagtagctgggattacaggcgcacaccaccatgccccggctaatttttgtatttttagtagagatggggtctcaccatgttggccaagctggtattgaactcctgacctcaaatgatccacctgccttggcctcccaaagtgctgggattacaggcatgagccactacgcctggccaacattttcttttctctagcttacttaattgtaagaatacagtgtgtaatatatacaacacacaaaatatgtgttaatcaactgtttatattattggtaatgcttctgatcaacgttaggctattggtagttaagatttggggaaatcaggccaggtgcagtggctcacgcctgtaatcccagcattttgggaggccaaggcgggcggatcatttgaggtctggagttcaagaccagcctggccaacatgatgagaccccgtctctactaaaaattaaaaaattagccaggcatgatggtatgtgcctgtaatcccagctacttgggaggctgaggcatgagaattgcttgaacccggaaggtggaggttgcagtgatccaagatcactgcactgcactccagcctgagtgacacagtaagactccgtctcaaaaaaaaaaaaaaaaaaattggggggaaatcagaagttatacttggatctttgactggatgggagttggctagatgggttgtcaaggtcaaatcataaaataatttagcatattctactaagtagtttgcattttatcctataggcagccagtgaaaacttttaagcaggagagtaaggtccattttagattgcattccaaatatgattactttacatatatgttttggtaaaggtttggaaagctactgctgggctgtggcattggaggtattagagagaactattactttttattttgattacttatatgtttctttttttatagcaaatatcatttattttgtctttattgtctttttcctctcctttcctgttttctattatagttttctgtatttctctttttttttttgctctactcgtttagaagttatatattccatttatatccttttagagattagccttaacttttagcatgcatacttatcaaagtttaaaagtaattcacttctctatcctcttcctaactgtaccaaaatcttacaaactgttcatctcccatcaccctcctcccatcttccatgttgctgtctagtactttaattccaccttgtttttaattccctggtggtcatttattttatagtcaatctttatttagattaaaaaaagtgttcaccagagtctttgttcaccattgcctcttgcatcctacttattctgtgttcttttgggttttttgtttttttttttttttttttttttttactgaagtaaatctcttacaagatcttttatccacaaacagatcttgagacaaaaaatacaaaaatataaaaataaatagaagttattttagtaagagtccgtgggccaggcatggtggctcatgcctgtaatcccagcactttgggaggccaaggcgggcagatcacctgaggtcaggagttttgagaccagcctggccaacgtggtgaaaccctgtctctaccaaaaatacaaaaattagctgggcatggtggcaggtacttgtaattccagctactcgggaggctgaggcaggagaatcacttgaacccgggaggcagaagttgcaatgagctgagatcacgccattgcaccccagcctgggtgacaagagtgaaactctgtctcaaaaaaaaaaaagtccgtgaatgataagctgtcttttaaagtatctttattttgtcttcatacttgcatgattatctagctaaaaacagaatttcacattgccagttatcccccccgcattttgaaaatatttcactacttttgactttctattttattttattttatttcattttttgagacagagtctcactctgttacccaggctggagtgcaatgggatgatctcagctcactgcaacctccgcctcccaggttcaagcgattctcctgcctaagcctacaaagtagctgggattacaggtgcccaccaccacacccagctaatttttgtatctttagcagagatggggtttcaccatgttggccaggctggtctcaaactcctgacctcaggtgatctgcctgccgtggcctcccaaagtgctgggattacaggtgtgagccactgcacccagcctgactttctgttttagccattgaagtccttagtcaatccaattattactctgtaggtaatctgattttccctctggttgcttttacgatggttcactttgtctttggtgttctgcaatttccctatgatgtatctttgtatggatttattttcatttccttctggagattcactatgcttcttcagtttggaaagtatgcagtcattatcacctcaaacgtttctttcccattctctctcttgtctcttggaaattttgtcagatatctactgggccttatctttctactctgcatgcctcttcaactctcttccatatttcccattgctttctctctgtgatacattctgtgaaatctcctcacttatcttccagtgaactaaagtatctcttcatcttctgtttaattatgtgtttagcttatccactgagttttttatttcagtgactaaattttttatttcaatggctatattttttatttccagaagttgtgtttttttccccaaatctcactcttccttttttatggtgtcctgcttttttcatgattgttccttctcctttatcactagctttcttgatttggagcacaggcaaatccacacccacctcatctagaagtctgaagtgctttagtaatatctaaaatagtaaaatctaaaattagaggatagatgtagtagataaattgggggatggatttatgtgggaagatttgagtcagggagagcagctgacgggttattgcagtggttaaggtaagagaagatgaggattggactgggtcagtagcagagggagtagagaggagtgacatatttgagacagaatttgggaggcagaagcaagaggacttggtgagcaatcaaacgtgaaaggaataaaggagaaaacaaaagcaacagtgattctgagggttgtagcatggatggctggaaggatggtggtgccattgacagagaagggacacagatgaggaggaacaaacctgcctaggagttccatcgtgaaggtgggtttagacacagtgaatgtgcctgcaggtggaatgcccagtggataggcacacttaaaagatctggtacttggaaaataaatctgggctgtacatatctatctgagagttaacagtatatatatattgatagtatcagaagctggagaagggccttgaggaagtgaggttgtccagggagaatatggagagtgaaaaggaagagagaaaagagtggagcctgtggaacatcagcatccagggtgcatatgctttggaaaaggtctggaaagctctgctgaaaagaggaaattctaaggatggctgaaaatacttggttagagagggaggaggaaaaccaggaaaaagcaatattgccaaaactaaggaaagttttaagcaaggagggaatggtcaataacggctatgaagtagagcctgaaacgctggacttgactgtcatgaggacattagttgtcttgtggaatcatttcctggggatgaggtggggcagaagataagagtgcagtgagtcaggagtgcgtgaagcaggaggaagtgaagctaagtagacaactctttcaggaactttggctacacacagaagaagagagatggggtgagagctaaaggttagaagtggttgggaagtgtggggtgggattcaaggctgaggaaaggtgtttgtttgctttaagacaaaaaagacgtaagcaggtttgcaggccaagggggaaacattcaagaggaagagcagctgtcagtcagctcttgggtcatcttggctttgccctttccagaatcgcctttggatcagacagatccaaagatttgctctgcttccagcaaagctctttcctccccacagacatgctttctctaagacccctgctccaaattgtcctaaatccaaaagataggatctgttagagtcttttattgtaattcaatccctaatatgtaaccagaaaattataagaaaaacttttcctgaaggaacttaaaagactactgttaaggagtttgcttcaaatggaaacaaacctctggtttcataaaatcttgattatcctatgtcaggctgatcaggagagactttgtgtgattctggaagaagctggaacagttttggtgttttgaggaggtagctatttgaatcctagcagttgaaagatcattaatacatccttctataaagctctatcttctagcctggtgaggaggtggaggctgcagtgagctgagatcgcgccatggcactccagcctgggcaacaacgagactccgtctcaaaaaattaaaaataataaataaatacggccaggtgcagtggctcacaactgtaatcccagcactttgggaggccgaggcaggcggatcatctgaggtcgggagttcgagaccagcctgaccaacatggagaaaccctgtctctactaaagatacaaaattagccaggcgtggtggtgcatgattgtaatcccagctactcaggaggctgaggcaggagaatcgcttgaacccagaaggcagaggttgcggtgagccaagatcgtgccattgcactccagcctgggcaacaagagtgaaactccatctcaaaataagtaactaactaactaaataaataaataaaaaataaaataaaaatattaaattatccagcattaaacagaccattggaatataaaatggactgagatgagacccatcaccccttcactaagcttacaaacagatgttttaccatcccagatgtacaaacacaagaatgtttgctctccatccacactaagctttgtcagtggattgagtcttatgagaccatctttctgtttaggtttgtttgggaaaacatgtgatttttaaattatatgtaatatagtatctactacctagctcttgataactgtgctcatttataggcatggcagactagagtatagatgaaggagggaagagaatttcctgagtctggttttaaaagaaaaggtaccatgttgtaatcttaggagcagatttacacatagccttttccaggagtaaagaaatgattttcttataaagaaatcattaaatgtgcaacaggtttttttctttttacctccagaggttaaacaaattggtagcatgaaatagtgtctgctttaaatttctttaagcttcttttgtaaatattaatatccacagggatataactattgaaaaggttaccccagggacagagacatgcaagggaggagaaatttctcaacaaagggcctcagaaaataaactttctgacctgaagggaattgtccccaaaaagcccgtgggaactaaagtgactgtttacttatgtttatgatatttaagcaagtgttatactgagcagtggttgtgttgatggttgttgtgtatttattctcagtttgtgtgtaatattacgcttgttctggctaagattacacacacaaacagacagccttttagtgagaagccttcctgatgttttgaattggttgaatcatcaaggctactctcaccagctacataacctcattagttgagaagctatctctggaggaagtctcagtagctaaatatattctgtgttcaataagagttctattcagttgcttggttttttcatattcaaagtgccttacaacaaataaatttgtacccaagtgctgtattgctggaactctttctttcaggaggcatgatttaaagaagaaaattgagatattttgtaaactatcaaagggcaagtaaaacataaccgtagattaaagccgattttccttttgctttgcaggaatttatccgagaacaactggaggtaagcttttcctttattttggggtttcacacagaagcaccacacataaaaggcttcgttgttccattttcttttcctgttaataacgtgtttatgcattagctactccagaccaccggaggcatccaagggacattgccactgactgtccagaaggtgttggcatcccaagcctgccatggtaagcccttcaacatagcagtgatcaaacacctctgcatgcagagccctggcagggctgccgggattacgaaagaggcagagggtacatttactacttgactcttggagaatacaatttagatcaagaaactgaatatacccttttaaaaatcacttttacaaaaacaaaatcccaacacaaaaatttgactatagtgctgcctgacctatatgagtggaggaataactcctagaggagatgcattttgagatgaattttgaatgagctggggaacatgggttcatagcatggaaaggggaattcactatagggagagtaaacagcctgtgcagagaggcagaacagaaacaagttagttatatgagaagcagcaaagagtatcaagaaactaggcaggtaagagaacagaaacctagaaggtcacagcaaaacctttggatttgatacagaaggcattagaattagcaagcgttctttttttatctttccaactttcattttaggttcagggggtacatgtgcactttgtaacatgggtgagttgcatgtcgcaggggtttggtgtacagattattttgtcacccaggtaatgagcatagtacccaataggtagttctgatcctcacccacctcccaccctccaccctcaagtaggcccaggtgtctgttaccccttctttgtttctatgtgtattcaatgtttggctcccacttttaagtaagaacatgcagtatttggttttctaattcacttaggatgatggcctctagctctatgtttttgcaaaggatgtgatctcgttcttttttatggcgacatagtattccatgatgtatatgtaccacattttctttatccaatccaccattgatgagcattgaggttgattccatgtctttgctattgtaaatagtgctgcagtgagcataacacatgcatgtgtctttatggtagaatgatttctgtttctttgggcatattcccagtaataggattactgggttgaatggtagttttgctttaagttctttaagaaatctctaaactgttttccacagtggctgaactaatttatatttcccaccagcagtgtataagtgttctgttttctttgcagcctcaccagcatctgttattttttaactttttaataccagccattctgactggtgtgagatggtatgtcactgtgattttgatttgcatttctctaatgattagtgacattgaacattttttatatgcttgttggccatgtgtatgtcttcttttgagaagtgtgtgttcatgtcctttgcccattttttaatagggttttttggtttttgcttgttaatttatttaagttccttatagattctggatattagttccttatatagattctggatattagacctctgttggatgcagtttgcaaatattttctcccattctgtaagttgtccgtctattctgttgatagtttcttttgctgtggagaagctctttagtttaattaagtctcacttgtcaattttcgttttattgcagttgcttttagagtctttaccaggaaatctttgccaaggcctacgtccagaatggtatttctgaggttttcttctagggtttttgtaaaaagatggaatgcgcccaggcgcggttgcttacgcctgtaatcccagcactttgggagaccaaggcggatggatcacctgaggtcaggagttcgagaccagcctggccaacatggtgaaaccccatctctactaaaaacataaaaattagccaggcgtggtggcgggcacctgtaatcccagctactcaggaggctgaggcaggagaatcacttgaaaccaggaggtagaggttgcagtgagccaatatcacgccactgcactccagcctgggtgacagagtgagactccatctcaaaataataataataataataataataatgaagatggaatgcttcatgaatttgcatgtcatccttgtgcacggaccatgctaatcttctccgtatcactccaattttattatatgtgctgccaaagcgaacaccattgagggttcttgagcagggtaatatgatacaatatagaaaatggggagctgggtgaggccctgtgaggaaggtgcctgcttctccttcaccttccgccataattgtaagttttctgaggcctccccagccatgcagaactgtgagtcatttaaatggtctttcctttataaatgacccagtcttggtcatttcttcatggcagtgtgagaacagactcatactcctctatcaccaaatgtcatcattgccaccttcaaaatgtatcttcggtccgtctgattcagtctgtctggctcctccctcatttttgccactgttgagctctcttacttagttcttcacatccactctggctccctttcaagctgctcttctctcagcacccagaggaatctttttgaaacatccctccaagcatgttgttcttctaactaaaatgtgtcaatgatgacccattgctcttgggatagaaatgtgattttttactgtggcccacaagggtcttcgtgatttggcccctgcctgcctctccagtgtcacgtcatatcactctccaccttgttctttacatcccagcctgcttttttggtcttctgcttcctgtgtgctaaacatttgtcagcgtcggggcctctgcactggccttctcctctacctgaaacacttttctctccttcttcaattagccacgtctttcttaacctaaagtctcagcttgaatactactttgccaggaaagccttccttaagctcctaaactgggtttggtcttcctattatatattcatatcctgtattttatagcacctatatttatcatttaaattattgtataattatctgcttcatgtttgtctcccctattagaccataagcgccatgaggatggaaattatctgtctcactaactgcctgacaaagctcccaatacaaagtatatacttaataaatatttgttgactgggtaaattgtgcataaaggcaggttataacaatatgagagtttagattaggaagattattatggaaattagaaaaaaagaagcaaataaaatgaacattgtaaggaaacaatcagagattgctattggacgatccatggagaaagataaccccaacttcacaaacccataaagagtaggcaaaaatactgctcttgcctcttggagaaaaactctgaaagccagatcctaacaagttaaggaatgcctcctacagagattagaaatacaaatactccgtaagaaaaagctgagagacagaaggtcagtcctgaagccttagtttcatccatggtcataagcactaatttatttccctctttttttttttttttttttttttgagaacggagtctcgctttgttgcccaggctggagtgcagtggcgtgatctcggctcactgcaacccccgcctcctgggttcaagtgattcttctgcctcagcctcccaagtagctgggactataggcgcgtgccaccacacccggctaatttttgtatttttagtagaggcgggatttcaccatattggccaggctggtcttgaactcctgacctcatgatctgcccgcctcagcctcccaaagtgctgggattacaggtgtgagacaccatgcccggcctataagcaccaatttcaagcaggattaaagcttcattaaagaagcctaagaaacatgttactttttccagatatttggcagtgacccaaggtcagcattggtttcccactatatacactataaccttcttgtttctgtctttcatttaggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacaggtacattaatgactaacaggagcaggagggagcaaagtttatcttctctttcttttctggcttttactatgcaactgtaatctgtcttaacctttccaaaataggagagttttgcaaaatctgcattggaagtttcacataaagcctcacccatttcattttccagctcaaatccaaaatggaacttagactgaactgtcaggtcacctacataatggctttgtattttaaaacttaacacatgtacagacttatgtaccctgaatatctattgcctgctggctctaggtttcataatatgcagttctttctgaagctactgaaagttggtagaagcacagcaaattcactgttggcaatatagagcctcaacttccagtttcttgatagtacctgctggaaacggtgatctgtgactgtagctggccatccccaaggatcttgagttatggtttgaggatcatcagacagggacccaagcttggggatctctacattatgctttggccctaattacccagcaacctgcaaactacaatgtggataatgcagaaaaggcacagaatggcttaaatgaagaacttctgtccttgttataatcttcagtgaaggagaacatggagaacataacaggaatgtccctgttgctgctttccaaaatctttccttttttttttgttttttgagacggagttttgctgttgttgcgcaggctggagtgcaatggtgcgatcttggctcaccgcaacctctgcctcccaggttcaagcaattctcctgcctcagcctcccgagtagctgggattacaggcatgcgccaccacgcccggctaattctgtatttttagtagtcagcgtttctccatgttggtcaggctggtctcgaactcccgacctcaggtgaactgtccaccttggcctcccaaagtgctgggattataggcatgagccactgcgccctgcccaaaatcttttcttttgctaacctttccctgctaagggatataaaatcttttcttgcatggagttttcaggtactaatgttgtctgactcaactagctgattttacttcattaaaacctctttgtttcacaaagaaaaatatgaagaaagtttttctccattgctgagagctgggaatctagacttaaagttctgagtccccttggatccttaaaacaatctgtaatctctattgaatccagaagttagaaatctaaacagattataacagccagactttggaaatatttgtatgctacctacattttcaattttttttttttgagacggagtctcactctgtcgcccaggctggagtgcagtggcatgatcttggctcaccacaacctccgcctcccaggttcaatcaattctcctgcctcagcctcctgagtagctgggattataggcatgcgccaccacacccggctaatttttttttgtatttttagtagagacagggtttcaccgtattggccaggctggtctcaaactcctgaccttgtgatccgcctgccttggcctcccagagtgctgggattacaggtgtgagtcacctcgcccagcctgtatgctacctaccttttcatattgctaattgaagttattctttcttcccatagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagc

SEQ ID NO: 13471 - DNA, 38814 bp, Human; identical to SEQ ID NO: 13470

SEQ ID NO: 13472 - DNA, 17731 bp, Human
cacctgcaatcccagctacttgggaggctgaggcacaagaatcgcttgaacccatgaggcagatgttgcagtgagccgagattgcgccactgtctaccagcctaggcgacagagcaagactctgtctcagaaaaaaaaaaaaaaaatacaaactcatacacaatagacacatcccatgcataagtgctagaaacactcagttatagacaagcatatacaatgaagatacttaagcacacgcgcacacacttgtgcacaatacacacctgtgcccacatacacaaatccatacccaaactaaagacacacacaaacacgtgtatgtatacaaagatgttatgggcaacatatacaatacatatatgcacaaacacacacctactcaccctcacacacatgcacagtgaccctccacaatgattctgggcccaggaagcagtttgtctaccccacgaaccccagcttgtttgaagctcgtcaggatgttccttgcagaccccgcttagccagctggtgactggcccccgcctcctgaacctccaggcttagggccggccaggcaggcaggctgcatctctggcagcccctcgtgggtgggcaggcaggcaggcagtggacgcagaggtcactggggtgagagctggggctgccctggcctccctgctcttggctggaatgtgagctgtaggggccacttcccaggcctcgctcctcccccacagccacccaccagccccaggcccagccaactcgtgactcccagtcctgccaggttcctgcagcctgggagctggacacagaaggcagtgagaggagtggtggtaaagaaagatccagaaccaagggagggcacacacaaacgcagagagagaggcacagtcttcacccacagagacagacacacacacgcagagacaggcaggcgtgcagactcacagtcccaccgaaagatacacattcagacacttccaaacacacccagatacacagcggacacgaacagatcacacaagcatacagagatacagagagacctgacccccacacagaggcgtatttggaggtacagtagtcacacgtactcagaccacacagaggctcagatgcaccgctcatggatattcacagacccgcaaatgcccatgcacacgcgcagatgcacacagacccccgcgcagcgtacagttcctcctcggccagggaccaggaggagatgcctgagtgagaccactctctaccacagggggctgccccgcagggagggcctgggaagactgcttcccaaggaggcaacaggcctgatcctccagccaggtgccctgagaggtttcctgtgggaggcccactgtgtccgtgcctggctaggagggtggtaggtcgggttagagttctggagtcacgtaggcttgggttttgtctctgccagttcctcggacacacagatgcgcgcacacacacaacacacacacactttccaagaatgcctatgtccattcgacatatgcaggcaggggtgctctcggagcctcggtttcttcatctatataacctggctaggaatcccttggccccctaggggtgtgggcatggctgccttcccaggcatcccggacggcccttcctgcagaggcggttagatcatgagccttgacggctgacgctggactcctggatgcccccatcccaggtgaccgccctgagagccgaagcagggctgtgggccctgtgggcgggcgcggcgcggcccggggagctgcgggctgggctcggcgaggcgtctggacctgccgagagcccctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccaggtaagagctacccccacctagcctggctccccagacctccccatcccagcactggaagcatgggactctgaaatcacagacccactccagggagcagcaactccaaggatgtccacacacttcctaaaggccaggctggacttctttcgtttgggaagagacctcaggctggctgtcccccaggtcctgggggctgtcttggtgggggcagggaagccacagggagggagggagggagggaggtttcctgtctggcccctggagccctggtggctttgctaaaagcatctgtccactaatcccaggcgggtccctggccttgtggtcagggtcgaggccccatggccaaccaggcgtccccaggacctctgacctggcctggtgggggtggcggaggagccagctgaagaagctgttggtggggaggctggccctgcccccaccagggctcaggactgagccgtgggctcctgggtgggctggggacgagacaaggggtctcgctgtgccttttctcctgggtgggtggccggaggtcctgagtgcagggcctggggaagtgagcagggcccttttcccaggagccgggtgagtctggctgggagccagcttgggcagtgaaatcctgacaaagccaatgaactgccttcccactgcgttgtcccactgccctgggagtccccagccccagcccaagagtaggagtgggctgggcagtccctgaggagtccgagcagcccagccacccgcctgcctgctgcagggctggccagaggtgtaacgttaccggctgcaccagctcatggcgccacccgctccagcccctcagctcccaccagctgatcacctccccctgggctctggcacccagccaaggcgggctgtgcagggcccagcagggttggcctgggggctgggtagaaggcagacccgcaggattggaagatctttgggatgcagcaggccaagggtctccaaaagcttctagcctcccatccttttccaaatgaggaaaactgaggccagagaggggtgggacctaacctacccagggtccagtgagtttttagtggtactcaggctgctctgagacagggcagagcatgtgcagcaagtgggaaggaacccagaggggcccctaccttcttgccatcacacttggcccaagagtgcagagctccaaggtacccccagctcacctctgcacttttctgtccatagcagtgggccttgtctgctgggaacggctcgtcagaggtggaaggtaagctggccaggctgggggtacgcatgctccccaagcccctctcttcctttctcccaagcccaggtgtggcatgaagcgtgggtgcaggttgataaaagctggggagagcctacaagctagacatgctgggtgatgactttggcagggcctaagagatcccctcatggtgacccagagactagagaggtgtgggctggagtcaccagcacacggagagtggggctggggccagtatagccagggttcatccagctggctcagagcccttccccagcatgatttaagggtatggatggggtcttggaggacagggtggggagtgagtgccaggggccagaatgggggtctgggagctgaatgcagtgggcagtcaagaggatcaggaatgggtgaggggccctccccagcagcccagccctggtggaactgccgggatctgaccatgcgtttccattgattataaacagacagaacatagtcgcgccctccctggcccctccactccccgccctggttgcatcaagagggagtcttcaaagggcaacgagacgtttgccaaagagacatatgtacagaaggcaggaggcccatgccaggccccctacctcgctcctccctccctgcctctccaagacgtgcaaagtggccacacaccaccgctgaggtttcccctgcgccatgggagagtgggcatgtagggacatgcacacgcacacgcgtgatagccatctgcgtgctgggaacaccctctgctgggctgcctgcctggcagcccgcctctcccgggcctggccatactctgacacctaaggcttaggcccctagacccctgagcaggtagaggaggtagctgcccttgacttcatggatgcctcccttgctgtgcctctggaaccagcacaacattatgctccttgggatttggggaaggacccatcccctacctccacactatgccctttttggtgcttttagtgtaggtcaggccacagctaccaaagatgccttagcctcagttttctcatctgtaaaatgggagccttggctacatgatgtctatggtttcttctttttccgagattgaaaaagggacttgtcctctgactccagggaggagaaatgggtgtacatatcacccaggatttgaggtggggaggcctggaagtgtagattcattaggtcagctctcctgtcacacttatcaatcagggagtctgcaatctgaccgggagaagtacaacgagctttgcaccccagctctcaaaatctgaaaatggcatccccacctgttaacaccacagccagagacagcatggccagccatgggcattgatttttactattactattcacggtaacaatgttaggcattttctgtcattctgttttgaccacaggctgtgaagtaggaaggggttgtactccatttttacagatgcaggcaggccctgaggctcagagaggccctgggggtcgccccaagcctcagacactcctcatggatctggcagaaccaagtgctcccaatagctccgtggctgagcgggcatgagcagggtgtcccttgtggcaggctgtctgtgtgccctgccagtgaccatggagaggacacttgtgggcttgggctggtggccagtggctctgcccagccctgtggcccgtctccagtgccctccacagaaacttgctctcaggattaagcatttctctcctggggtctcccccatcccaggtggtaggtaggcaggtgggaggctcactcacagggctggcgagagagctgagggcacacttgcagcctcaggagcagccctggggaccacccagccctggcagtgcctgagggggccctgagggggccacagcttcccgttgctctcacctccaccccctcccggagcaggtctggggccagcggaagtgctctcggggacagctgagcagagctctttcctgagggacacagcccacatctgggagcggtcactgtactccctcagcccggcccctcacccagccccttttgtttctcccacacacccatagcggggccttcagggatgaattgccctttcctggtggctgccaggtaaaccaggctccagcccacctccttctcagccctcccccaacacagttcggccacagggctgggaaagtggcagattccagggtttcagggacccggaacctgcatggtgggatgtggggtgaggaaaggaaatcccttcttctgctgccgaggcccagccagttctgccaaaggtggccatggccccgcagcccagctgggtgggtgtctgtttgcaggatggagggggctggggtgccccttctctgctgctgtcccctcgctgacggctggtcccagggcaggaacctgagtcttctgtggtgctttggcagctcattattcctctgctgttatttatgttttccaaggtggagattaaacgttcagagtcacgtagtgctcatgaagattttaaactaaacacacagctcaaggagctggtgatagggaggtgctctctgacccaggattgcaaaggcaggcttccctgcactttgggcgcctttggggagagaggccttgtttcccactgggttccggggcagtatccagtggcgcggagtggtagagtcagaggaggcctatggattccccccaccaccagcccctaggccctagtgccctctaagcagagcacggcagaatggagcagaatggagcagcaaacaagcagataacactgtttattgcctctatgactgcctagccagctccacatggacacaccgcctctgggtattttccaccagtttgcagcctttcccgagggcctctgctaggactgaagtttatttttcttccgagattaccaggaggctcatgtcctcataggctcagtggaatggactttggccccttctgcctcctaggcagaggcatggaagaaatgaggggttgctgggagaggccattgttccatggcagaggctgcaggacccccagctccccattcttccccactagctgaggatgaccatcagatgcagagcaggatgacccaggcctgggggtgtttctctgtccatggtctctgggctgggctgggttgcaggcactgattcacaggcggttggtcagagagggaaagaccttagcaaccatttattcccaaccttcttttttcccacctgaggaaactgatctatccagaaaggttaagtgatctccccaaggtcacatagccagtgtagggccaggactggaagccaggtgtctgactctggccactctccctgtgagcctctatttggggcctggtcctaggccttcccccgaaagagcagcatcttttgagggattccagatcagcccccaaaagatcccattcacgatcgccaggacatcgtgaggtcagggatgacccggatgatcctcagtgaaatgtcatctaatcaaccaggagtgacttagcctgtgtttacgggtacgtccatctctgccctcatggagcctcgagttggttgtaaaggagataagagcaagcagtgccggagataaggcaaccccttgaggccagaggccaagcagtgctcaagggaggctcatctgtgtgcactggaattgctggggaagtcttcaaagaggaggtggggaggcaggtcgtggaaaatggcgggtggactttatttggatagaaatgagaggagggggaagaagagcagctgtacgggctgcagagtgcacaagccagagctgggagtgaatgtggtgctgccgtggctcagtgtgagcgctggttggactcagtggagaggagggtcgggccacattgctggatgtggtcttggttgccaggcagaggagctggcacagagtggggcaggaaatgagggagccgtggaaggtgtttgagcagaggaataagggaaggccaaccctccctgcatgactccaggaatgactgttttctgcaagttctccaagttggaggaagcaccgggtcaggcttgagaaagatccagagggcctgggtagctgccggggctacaatcctcaaagctccagggagccaaggcagacgtgggtgcctgagttgaggacagagcaaagcttgggaccctgagagattctgttccatggggatttccatccagcagatgagctaaggggcccgcaggcatttcggagggatcacattaggagttcagagttgagggagctcggatggggctgggggctgaacctggaaggccagcagggccttgggagccaggtttagggcttcaaggggcaggtctctgctggcctgacccagcccccttgcttcctcgcagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcaggtaggtccataccctgcccagggggccaccgaatctgcccactagaaggtacctggagagggaagaagataggcccaggtcccagggctggagcctgactcccaggccagtgctcctaccaccccagcccagggcctcttcttcctaagccctccgatggctctgagcccactcatctccacccccaccagcattctcagcctcacgctgagtcctatcccaagactcagggtgtctagttaaagctggaaagaaatctgcttgtataaagtccctgttgacaccaggagcatttggtcccttttcaagcaagtgcagcttacatgtcacacacgcagtggtttactgagcacttactgagtaatgccaagcactgtcctaggcgtgccacaagtggtgtgtcattcaatccttcaaggctggtgtcattcccatttcacggatggggaactcaaggttcagagatgttatttcacttgttcagcaggtaaaagagtcaagatctgaacacgggtctctctgactccagaacatgagcccccttcctgtgctattgctgtgctagtgctcccgggcagggagggacaggggcctccctcagatccccatgcagctgagagagctgtttgccccacgttcagagtggagtgagggcctgtagtccacaggctagcaggaaacagagtcgggttctccttacaaggagagagagaagagtgccggaaactcgtgggccactccccaatccaggcatcaactctttcttccttcagctcctaaagatccgttctggggaccggccctcctacgtggagctgacgttctctcagcacgttcgctgcgaatgccggtaggtctccggggtggggtgggtagcaaggaaaggcccccgtcctcttggcagcctcagcaaagatgggtcccagggcagaggcaaaggctgcccatccccgctgcgggctgaacttttttccagactgagggagaccaagagggcaggaccaggggtggctaccattcattttgtccccccaccagccagttttgccaagggagctggtcccagcagctggggtacagctgttgagatactgcaagggaagagagagggtgggtccctcccagcctcgcaggggttcggtgcgtgtcgttccccttctctgggatgggaggcagctgccacgggcctctgaaagaggtgcctggaggcaaagacattgcaagtctgaacttcgttctgggccaagctgtgtgcccacaggagcgggcaaacggggctgagaagcagcaagaaggacaagctcgggtaggagaaaaggggcagaagaagagtgacactgtggcttccttgatgttgcagcacccctctacggcccctcccaatccacagagcctctgaccagcaccagtcttgctgcctgtgctgggggcacttggaacattggttagcaggagcaacaggcctggcactgccagctaggttcagggaagagagaaatgggctgagctgctgctcctggtactactgggccatggatgaaggcaccagactagaagtccagagccctagccaggggcggcaggagggaagactaccacttattgtgtacctattctgtgcctagccccgcaggaggcacttgaatgtttctcatttagtcacatacatttattgagcacctaccacatgccaggcattgtcctgatgggatgcagtggtgagcaaggttcctgctctcataacaaccctgggaggtaggccctattgtcatccccattttacagatgagaaaatcaaggctcaatacagtttcatgatttatcacagctagtgagtgtgggaggagggattctgggccctgacctaactcgtaagccttcgtttttcaggctacctttcatggccatgaccacttttctaatagcccccaggcttagccttgcctcctgggcagggctatggctgccccttttgttggagtgttggagaccctgcctcaacttgtttccacccatccctccaagccagagcttagccatataacaagagctcggtaatgaaccctcctgggtgcaatgctgggtggtgacccagagtcaccttctccatcccctttgccctgacagccactcttttggggcaggcagatgaagagactgaggttccaagagtgtctgtcacttgcccaatatggagaggtacaaccagacagtcccaagaggccctggtaccttgccctggctcccaagggaggaaccagctgagggtagcatgtcctggccccaaagctgactgctaccatgctgtcccatgtctctacccactgttcccagtgaagactgaggccctatcccctgccaggggccaggcaacagggacacctttcttcttgcttctgggccaacagccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtccctgaggaaattcccagaatgcaccctggaaggaacggaaaaaagcagcaaagaaagtgagaaagaaaaagcaacagagaacagacagaaacaaccaaatttgatgccaagaggctgagaagtgcagaagcgggtggcaggggtccccaggaggttgatttgtccctctcgtggtggggtcaccagagcctggagtgggagtgaagccttgaggctctggccacctctcccttgccaactccatgctaccccctagtggcctcagtgtcagctgcaggaccaggactggggatgtcggaggggacctgtccgggcggcagggagccccacttattgctttcctaacgttcctctgcccctctctctgtctgtttccctaggcctctgcgggagaagatgaagccggaaaggtaagtggtttggctggggctcggggctattctcgggcctgccagcctctgtcctagcatggggttccccagccaccttgtcctgacgcttggcttattgcaggaggagacccaagggcagggggaagaggaggagagagaagcagagacccacagactgccacctgtgagtgcgcggggtcccagggatggcgaggaggctgggcccgaggggagccccgccttgccgccagggttaggttggggagggggagaggcaggactgaggccagtcttgggggcagaacagggagctgcacctcctcaagactctagggcccaggaagcatcagtggaccttggtttttgtcccggcttagccctaggtttccattgaccttcaacaaatcatttcacctttgtcagcctagcttttctctgtgtagaatgaggggcaggaggtccagcaaacattcagtcactctacaaacatttactgagcacttactgtgtgtcaggtacatctgtgagcaaacaaacaggattcctgcacattagtgtttaccttttagtgattaaaagtctgtcatcagctgagacgttatctggggccacttcctagtagccccggggaacatgtgcccctcgccactgtctcccaggagtatttttgcctgtgggtccccttgctgcttctaacccacttcgtaccttgtgggcagcagaatggagccccaggcctgagtgtggctgggagagaaggatgagaggagggaaaacccaaatctgtgagagtaaatagaaaaaataaaatatttcacgtgcacagtcaatcagtcactgaagagaggtggctctccttcaggggctaagcctcccccacgcacgtgactccaggaagtcatttcgtgctatggagtggagttgacccaagccctgaccccatgagccccactccatgaagacagggatcctggggactgcgccccctaggggtttatgctttcatctcttttctgggcccgcgcggcaatttgggaaacaagctggcagggaagtccatccaggcccgagttacccgccggcagccggaggcagaaagtgtcccgtggctcctgttcccaaggcagcagtcttcagacatttcactcgggaatctcctgaaagaatttcaaaagtggccgggcgcagtggctaacacctgtaatcccagcactttgggaggccgaagtgggtagatcacttgaggtcagaagttcgaggccagcctgaccaacacggtgaaaccacatctctactaaaaatacaaaattagctgggcgtgttggtgcatgcctgtaatctcagctacttgggaggctgaggcaggagaatcgcttgaacccgggaggcggaggttgcagtgagccgagatcacgccactgcactccagcctgggtgacagagcaagactccgtctcaaaaaaaaaaaaaaaagaattccaaaagcccatgtgctcccttgcccattcttaagttgacattgaacattttcatcagaattataagtcaagccaggctcagtacctcatgcctgtaattctagcactttgggaggccgaggcgagtggatcgcttgaggccaggagttcaagcctagccggggcaacatggcgaaacctcgtctctacaaaaaaaatacaaaaactagctggacgtggtgccatgtgcctatagtcccaactactcaggaggctgaggtggaatgatcacctgagcctgggaggtcaaggctgcagtgagccgagatagatccactgcacctcagcctgggtgacagagtaagaacctgtctcaaaaaaaaaaaagtataagtcattacaaaggatataatttctggcatattattaatattttaatacaaagctattgtagaacactctccaggtgtatcctattaaatacgccattttaatgttatactcaccatcatccacttttaagaaaatgaacaagcaggccaggcgcggtggctcacacctgtaatcccagcacttttggaggccaaggcgggcggatcgcaaggttaggagatcgagaccatcctggctaacatggtgaaaccccatctgtactaaaaatacaaaaaattagccgggtgtggtggtgggtgcctatagtcccagctactcgggaggctgaggcaggagaatggcatgaacccgggaggcggaacttgcagtgagccgagatcacgccactgcactccagcctgggacagagcaagactccgtctcaaaaaaaaaaaaagaaaattaacaagcaaaaaaaaaaaaaaatacaggaacacttcctttcataattatatatttacattgtttcttttttcctggaacttgtatttccatttcactccccacccccaagaatttcagcctagtgtaacagtacttttaattttcagaagtcttttattgattaccttgtcatatttatctgccacaaaaaaatgatatatgagtttgaattattttaaatttcctgtgagcataaacctaaattaaattttctcctggaataaattatcaaaataattcttattagcaccatttggtcaaaacagcacaaatacttcctattttaatagatgttcaacataaaaatacaatcaatttgattgggaatgcatctcaatgagatggatgtggctacctcgtttcaattagtgaatgaatccattaatgaatgttacttcctgccagactgagacaggattctgcattaatttaattcctgtttatcatttttttattgatgagaaggttgagaaaccatgttcacataaataagtaaatgagactagatgtcactcaattacttgaactccttccttccaagttatttgccagaaatctcaaggtgctctgctaagaacaaattacttctcatgatatcctggctgacaatttggttaagctgttcttcagttttgttgaaagccttggttacccagtcattagccatattttctttctcaagacctacatcaatatctcaaattgttctttttttcatgtcctcagaatacttttacctggcagcaaagcactttatgaggatttagaatgagcaagatgtgttgtggccagagaagcagatctcagccactgcctcacaaaaataattttaaggcaatgtagacctggaggctgaaaatggatttctttaaaaccgtcagtactcaggcctcacgtgcgtctagcggtactcccctgtttggagactgctgtcttagggtaatcagaggcatgattgcatggagtgtgattaggttcaaatgtggctctgtcaccgactggccgtgtgaccacaggcaagcttcttcacctctctgggcctcagtttcctaatcttcacaagaataatcagggtgccttcctcgtggaaggttgttgagggttaagaagacagtgcttggcacagggctgggcacatgggtaagtgtttggtgaagggtagctcccagcttctcctcagcttgaagcaagcagggacccaggagcactgcgccctccccatgctccctgcccaagctcctcctctgggcctgccccctcctccataggaggagaccgcaccctccacagtgtgctgatacccgccccgtctgtgcttggtctctggcaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgctgatctagtgggtgtgtcttccggggcagtgagtgtcagccgggaacggaagccagacagacccagggatcggggtgtaacaggaagagcacagcaccttctccgagcctcagtttccttatctcaaaagcctcgctcagtcgacgagagggcatgtcacagctcacgacaacatgttagcttgctccttccttcctccttttgacagctgaggacacttaggcccaagaaggtgaaatggctgatggagagttaagagcactgaagcgggggtcagaggcctggctttgtctataactcaccgagtggcactgggcttccctctgccttcacgtttcatctctgacctgaggggcctggctagatggctcttctggctttgacacatttctactggggcccaggctcaagtctcggtggccctgggtggtcactggagactgttcctgtggaggccacttcaaggctgccccggaggtcgcccaacctgcttctacagcaccctggggtcgccccttccctaacgaggagctcccaagatgtagttttgtttccaaagttgaggagaggctggtcccagccactttttaacagcatcaagagcacaatctcctcctctcccagggcttagggctgccccagcccagtgccgcaaggactcccgaactcctccggccctcctgatagacatcctgggctgggtctcagggcgctgaacggcagcacgtatagcctgctcgggctgctgaacagacgcaaggaccagcagatgctgcccggatttctctgccttttaccccccagttccttccgtcttcctcctcagtgctttggcaggaaaaaaataaatcttcttattattttttaatggttttttttttgagacggagtctccttctgtcgcccaggctggagtgcagtgccacaatctcggctcactgcaacctccacctcccaggttcaagcgattctcctgcctcagccttctgagtagctgggattacaggcgtgcgccaccatgcccggctaatttttgtatttttagtagagacagggtttcaccatgttgaccaagctggtcttgaactcctgacctcaagtgatccacccgcctcagcctcccaaagtgctgggatgacaggcatgagccaccatgccaggcctattttttttttaatccaaaccacttactatcaaactccactctgcttctgacctgcaaggggtgtgtgtgtgtgtgtgtgtgtgtgtgtgtgtgtgtgtgtgtgtctgtgtgtctgtgtctttgatgttatatgctgctatatgtattgggggaagagaagttcccccattctctcctcagcctcacttcctcatttgaggctgctgaggagaaacccacagggacccaggggcacaggggcctgcctggggctttgaggggagctggggatgtccagcggagtggggtggccctgctgaggcagctgtccttggtgccctgttcaccgaggcctggggactctgcaggacacgctggtcagaatgtgcttctggctgtggtcatagacgggtgtgagtcagccccaggagacatactttgccaaagaaatgcacttcctctcctgcctctcctctctttagctgcagctgttctgagctgttgcctttgacccactgtgaactgggaagagcacccatcccctcccactggccaggcctctagctcagccctgaggaccccaacccaggcccggtagcatcttcaaggcttttggctccataaggtcacccacatggcgggcagcctcccgacccaggccagtgacccctgtagagagcaagacagaaaccagaaaagctcctggaagccagaagcaaaactccacatccgtgggcaggagcctcgcagcaggaatgggtaggaaggagccagctggcctacttgactatattggcagccgttccagccatttaggtcctagagggatttgcttgtcatctatttgtggagcaccc

SEQ ID NO: 13473 - DNA, 33731 bp, Human
tttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcttagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatggtaagtacgtagtattcatgtgcatgagatgcttttgaagatgggaatgctggacaaggagtaagatcctcattatccaaagagattatctcaacagatagaacattttgaagaccacttataaaacatatgttgtattttcatgctatatgaagatttgctacgtccaacactacttttttttttttttttttttgagacggagtcttgctctgtcacccaggctggagtgcagtggtgcgatctcagctcactgcaacctctgcccccctggttcaagcgattctcctgcctcagcctccagtgtagcttggattacaagagcatgccaccatgcccagctaaatttttttattttcagtagagacaggatttcactatgttggccaggctggtctcaaactcctagcctcaagtgatccacctgcctcggcctcccagagtgttgggattataggtgtgagcccgcacgcagcctctaggtccaacactatttaaatggagaagtacagtgaaaggatgtcagtgtgtgtatatgtgtctatgggtgtgtgtatgtgtaagaaagggggtgatgggtatatacctagagcaacaacaaaaggggtgagactgtccaattttaataaaaatgatactattaatagttgggaagatccacagtactttcctaccttgttttcccttcctgttaaatgcccagctttcctagaaatgtgtctttaaaggcacctgcagtgtcagcatggtattttactggaagtttctctgcgtggcttccaggttaagggccagaatgattctgtaatcatcctaggtttcccagtaaactctatggcttagtacagtactacatttatgagctttttctttctagaaagtaggacttgtccatgaattttcaaaatataggtcaagtatatactttcatgactatacttttcaaatgtactttattataatgcatatggtaaaatctccttgatgtgtttatggtacaagtagctgttattcaggaagacaataatatggcatttatttatttgagacagagtttcactcttgttgcccaggctggagtgtagtggcgtgatctcggctcactacaacctccgcctcccaggttcaagggatcctcctgcctcagcctcccaagtagctgggattacaggcacccgctaccacacccggctaattttttgtgtttttgtagagacagggttttaccgtgttggccaggcttgtctcgatctcctgacctcaggtgatccacctgcctcggcctcccaaagtggtgggattataggcgtgagccactgcacccaaccaatatagcttttagatcgtaccacagggctacattagagcctgcactaggactctgggttctcggtccacatttaaagtgatattgctttggcagtgtgttgagagccagatgttgggaggtgataaagctgatttccatctggctataatcttggctttgcactaggaggataaacattacatctgtatccgtatttaaaattttgaatgctgcagaagaatggaacatgtataaatgtagttataagtcaatttctaatttctcctgacgatgaatatctctagcagaaagctgtggtttctttaaggttaaatgaaacctttacttttcagtgtttttctgtttttccttgtgaaaaaaaaatcactgtagtaacttcagtagtatttcatagtattttgtagtattcattaggagaaaactcatttctttcactgttgttcctgagactatcaagttgctcttaaagccactttatgtgcttttcaatctatgtggttttatgtcctgacttacactgaaggcttttcagaggtaaatctacagcactgacacctcatcttcctgaaatgcaactgcttctgatatggtgccaaaaaataactggattacattatactgtgagatggctgttgctaaaagaaagggggaaatcttagctgccatattcaacgtaaatatttcttccttttgaatatagacgtttaaaacactttaacctacttaacattctggattagcatacttttttatgaacttttgagggtcatgttaactgatagtttcctaatgaaaaatatttttggtatagaaagaagttccatgaacagatggctcctcagtaccctgctacctttctggaaatggctgatatacatcatgacatcaggacattgtcaaactttacataaaagtgttacatgaaataaattgttaaaagacaattttttttttttgagacggagtttcgctcttgttgcccaggctaaagtgaaatggtgcgatctcggctcactgcaacctccgccttctgagttcaagcgattctcctgcctcagcctcctgagtagctggaattacaggcatgcgccaccatgcctggctaattttgtatttttagtagagacgggatttctccatgttggtcaggctggtctcaaactcccaacctcaggtgatctgcccgcctcggcctcccaaagtgctgggattacaggcgtgagccaccagcctaaaagatacattttaatgtacagaaggaggatctataaaggtgattttgaggagtagtgtcaagtccccaagccttggtaattttttctttaaaatatattttatgcagttctttctattgtagttataaaccttatttcacttcattatcttaattttatcattcttaacctctccaggtttagtccaacagatttatctctcatgttttcctcctgttctaaagctgtcaaattcagcattgtttctaaaactcaaatctgattatccttcatggagaagaacagcatttgggccagatcttactagactctggagtttgaattgagaacctttcatttgtctacctgttcactttttcatgcagcatttgttgatcatccacactgtgctaggtgctgtcacgttgcaggttaactgactttgcttttaggagttcacagtactattagggaagatagctatctaaatataattgtattataatgagacaaatgttaggatagagacatacattggagataagagacataagttggagatttgtgaaggttgcaccaagttatggctgacaagtactgctgtatgtctaacacagggcttctctgggtaattttttgttgtaaggtttgtcctatgcattgtagaatatttagcagcatccgtggcctttatctgctagatgctagtagaacgtagaaccctttactcaagttgtgacaatgaaaagtgtctcaagccgggcacagtggctcacgcctgtaatcccaacactttgggaggccgaggcgggtggatcacaaggtcaagagtttgagaccagcccggccaatatggtgaaaccccatgtctactaaaaatacaaaaaaattagccgggtgtggtgacgcatgcctgtaatcccagctactcgggaggctgaggcaggagaattgcttgaacccgggaggcggaagttgcagtaagccgagatcacgccactgtactccagcccgggcgacagagcgagacgccgtctcaaaaaaaaaaaaaagggtctcaagacattgccaatgtcccctcgtgcaaaattgccccccagtgagaatcacagtgacctattctaggtcttcattctgtctggtatgaatagataatggaactaagcattaatatagagtcctatatggacagcataatttcattaaaggatttctgattctcaatctagtgtttagtagtctgctttatgtcttgactcagtttgtgcagaaagaggttttatgtgattaaatttttaaagagtttacttgtattttaagttcacatttctaggtttttctttcttatatttagggtctcagtacaggtgtcaaccttttagaagcgaccttgttcttcctttccttccgagagctcgagcagagaggactgtgatgagacaggataacagaggtaagggtggcagagagtgctggggcacacagtacacatcgtaccacctaactcaaaaaacaaagcaggcttgcattaagcttgatcagtgccagctgtgctgtactggaatcaggaattccccacggccctgtttaacagcggaactaattaattcagcgcatgcatttaggtcagaaattacttttccagacttgaggtcaatatttgctgattatgcatagtctgtggtgtcttgtgattaggggacatgtttcttatttttaaaaaggctggacttgcactccaagttgctgtagttttatgtaagcaaaactcttcaaaaaaagctacagacatcaattttgtgtgtatgtttaaaaatagataaggtatattttgcttaaaggcagtaaggctataaatttgagccatagcttctctgtcagtattccacaatatctcttttaacagtttggagaaaagctgtaatgccagaagatacagtcaccaactctagtttaaaaagtaacagatcaaaataatttagagatacagcaaacactgaacatttgtagaacatagaaacaatgtacgtgacctttggtcttgaggctatggctcaccaaacaggaaatgccattccctcctttccctgtggttctggatgccaactttacctgttcccttttgccctagatactgtggatgatactgttagtagcgaatcgcttcagtctttgttctcagaatgggacaatccagtatttgcccgttatccagaggtgggtctgtagcagtttttctttgccttttttttttcttcttcttcttcttattttttaaattttgagatggagttttgctcctgttgcccagactgaaatgcaatggcatgatctcggctcacgtaaccttcgcttcccaggttcaagcaattctcctgcctcagtctctcgagcagctgggattacaggcacctgccaccacgcccagcgaattttgtatttttagtagagatggggtttctccatattggtcaggctggtctctaactcccaacctcaggtgatctgcccgcctcagcctcccaaagtcctgggattacaggtgtgagccatcacgcccagcctttctttgcctgttattttaaactttgagtttcaagatgggtacagtggcatgcacttatagtctcagctactcaggaggctgaggtgggaggatcacttgaggccagaagttcaaggctatatagtgtgctgattgcacctgtgactagccactgcacactatagcctgggcaacacagtgagactccatctcttaaaaaataagtaaattagttaaaaataaaatttgaattttatttaagctgggtatgggcatgcaagactatattaatttgtaattatgattggaaactgggcatatttccaaattatgtatttggaaattactgtttaatgtagaggggagaaataaaatttatagcatttgggaactcaggcattttggattaaacatgtataatcaatgtgagaacagtgaatgtgtttaccactctcagaaaccctgacttgtagctttggcacagtattcagggtggtgataatgaaattgttatcattagataaagccacacatcttctactggaggaacagttcctcattggccccgcatggatgttctctcctcagtgtattttcacagaatgtactgtgcatgttataaacagggtgtataatagatgagcatttgtttaccagttctttcctcaagatatcatttgaggacttgatcatggaacatagacaaattgttgttgtgaaacaattttttttgttttgtcagtaattttgtttataagcaaaaatttttatgtaagactcattattcataaattcttttgaatttttttttttttttttttttttttttttttttttttgtgacagagtcttgctgtgtcgcccaggctgaagtgcagtggcgtgatctcagctcactgcaagctccgcctcccgggttcacaccattctcctgcctcagtctcccaagtagctgggactaaaggcgcctgccgccacgcccagctaattttttgtattttttagtagagatggggtttcaccatgttagccaggatggtctcgatctcctgacctcgtgatctgcccgcctcagcctcccaaagtgctgagattacaggtgtgagccaccacgcccggccgattcttttgaatttctataaattccctgaattaaacccacctctagtaggctaaataaaaatgaatgcttttaaagcactctgatatctttggtaaaacaattctgacacaaaaattaaaatttcaattatattttgctgagtctttctaggttgctgttgatgtaagcagtggccaggctgagagcttagcagttaaaattcacaacatcttgtatccctatcgtttcaccaaaggaatgattcattcaatgcaggtaaaagattaacttcaaaatctcataaatatatatatatatatatatggcctaactcttctaaaatttgatttatttaatgatatagaccaccttggtcaaggcacgtgtgtgtgtgtgtgtgtgtgtgtgttcttactagaacttttatcatcagaagaaaaagcaagggattaattataattacaaagaaagaaatatctttagtagtgtaagtaggtttggagggaatgaattatggattcaggctgacagtttcaaggattctcaaggttctcctgcagaagattatatattgactttatatttggcaataatttataaatcaaagtcctttagtgaccttgtccttaagtgtgcaacagtgcccttttagaaattaccttctattgtgtgagcctacacaggtttgggaaagcccatattgagaagtcatttcacaaaagggaccctttgtctgatctgcttttctattttgccttgtgtttaccaccatggctgtcttattccctttgttttcagtacggaaacaaattaggaggctaacaaatttgggtaaactcctaacctggcattgacctggtaccagagcaggcaagcagttgatccagaaatagaccctggggcagtggtataggctcgggggtattggagagcctcaagtacctagacagagaggaaccaccaaggtctaaagccaccagtggcttttaacttacttctttaatagactagcagccgggcgcgctggctcacgcctgtaatcccagcactttgggaggccgaggtgggtggatcatgaggtcaggagttcgagaccatcctggctaacacggtgaaaccccgtctctactaaaaatacaaaaaattagctgggcgtggtggcgggcacctgtactcccagctactcgggaggctgaggcaggagaatggcatggaggcaggagaatggcatgaacccaggaggcagagcttgcagtgagccgagatcacaccattgcactccagcctgggtgacaaagtgagactccgtctcaaaaaaaaaaaaattaaaaataaataaaaataaaaatagactagtttctccataatcgttttccttgctttcatataaattttaaaaatttatttcagcctgtatgttagcaatctctggtcacattacctattctcaagagtcactctgttgggaacatctcaggccttctctaaagtattgctagcacaccactctgagacgtgggagtctgtcttcccctgtcgcctccctccccttacatcttctgatcaactccacctgcccattctttcatccttcctagtgactttttctggttcatcagaaccttacccagtctcaaagaaaggagtgtgataaggcaaacaactctaaataaaatacagttctgtatctttctatgcaaataagcctttgttaatttttatttagtgttgtaccacttatttgaatgtctgacaggttctccagcaagtagataacaagtttattgcctgtttgatgagcactaagactgaagagaatggcgaggcaggtaagaatggagtttagcctgaatgactaaccagctggtcttcttgtaacctttttttaatgattatttttggtatataatatagtttcaatgatttggatggattagggaaagccaatctaaaactaagaatattatgaaggctgggtgcggtggctcacacctgtaatcccaacactttgggaggtgaggcaggtggatggcttgaggccaggagttcaggaccagcctgagcaacatggcaaaaccccgtctctactaaaaatacaaaaattagctgggcatggtggtgtgcacctgtagtcccagctactcaggaggctaaggcacaagaatcgcttgaacttgggaggcagaggatgtagtgagccgagattgcgctattacactccagcctgggcgacagacatttagttttatgttcatacacatacatatactcaggatgcacattaaactatcaagagtatttactttgggagtgaaaatgagggtgtgcaaaggagatatttcaacttttactctttttgtcttttttttttcctttttgtggagaacggggtctcgctatattgcccaggtaggtcttgaactcctgggcttaagctatccttccacctctgcctccctaacagctgggattacaggtgtaagccaccacgcccagcccatcttttattcttttaaatattttctattgtttgactttttaataatattttcatgttttccctttataataatagaaagtgtatataatgaactctgctaggtttgtcaatatttacacagaatctcttggtgacctgctctaatgaaacaataatagtttgtaaatatattaactcattcaacaagtattaattgagtgcccattgtatgccagggactgtaccaggccctagggatacaataatgagaaaagatatatatgcaagagaaaaaaataattacacaaacataaaattttagttctagcccctgtaatggagaaagagatacaagatgctctaagaacctgtattgggagatttgatttcatcagggagttcagggaagtgcttcttggtaaaatgaggtctgaatatgaatatgagttaactaagtaaagaaaggagggaacaaccatgcaatttgtgatttattctcctcagtgagtggaaacagggcaaggggaactggagatgaggctagagaagtaggtaggagtcagatcttaaatgccagctacaagctttgctttgtcccaatactgttggaaaccattgaaagcttttttttttcattttttatcatttgtattttgatgttgtttttggggtggtacatgtcacatcacatttgcattttaaaaagattgctctggttgcagtgtggagaatggagtaggagtaggggtggagtcccagttaactgtagattgactgttaaaagaatattgcaatatctgagacatggttagatgggaccagggtggactagagagcagtgaatgtattggaaagatatttaggagatagagtcagcagggcttggtgatggattggatatggggaaagtatgtaaaagatgacttctggtgttctggcctccatagctgagttgatgatgttgcaggacccgtgttgcaggcagagcagagaggatgaaaatcatgagttcagtctttgaaatgctccagaagagatgtcaaggtggccaggcacggtggctcacgcctgtaatcccagcactttgggaggccgaggtgggtggatcacctgaggtcaggagttgagaccagcctggccaacatgctgaaacgctgtctctactaaaaatacaaaaattagctggacatggtggcagatgcctgtaatcccagctactcgggaggctgaggcagagaattgctttaacccgggaggcggaggttgcagtgcgccaagatcgcaccactgcactccagcctgggtgacagagcgaaactctgtcaaaaaaaaaaaataaaaagatgtcaagaatgtggttggatattacaagtctggcctagacaagtgttctgacatggagatacaaatttgagccatcagatgcagaaaagtgatcactgaaaccctggatataaatgttatcacctagaaaaaagaagagtgaggagaggtcttgaatctagaataattctagcacttaagagctcggtagaagaggatgaaccagcaaaagagactgtgaaggaacagctagagaaataggaagaaaacagaagaatgttatgttggaaaaccaggatgtcatgccaaacgctgccaagacattaagtaagatgaggatcatctgattttgtgacagtagagattagggattttagcaagtgagagctgtttcagagaatagacaggacgagatgctgatggtgctaatggagactgcaaggagatactcagaaatgtgcccatgacacggaagagggactacagagggtgagggtgacagaggaccttttttttttaatgggagaaacttgagcacatttgcaagggatgcctgatgggataaagtccctgaaaaggcctgagtggctgagccctgagcagcagtggagggctggctccagcttgatagtacctgcaggcaagtgctaaagttttagagcatttattctctatgtatttcaaaatattccctttaccttgtttagtaaatgtcatagcagatcaaaggcaaattaacctaaagttctgtcagaattatcatgaatatagaatttgtgaagatcaaattcctatagttttactatttctagaaaagtaatagttttttgttgttgttgtttttgagacgaagtttcactcttgttgcccaggctggagtgcaatggtgcaatctcagctcactgcaacctccgcctcctgggttcaagcggttcaccagcctcagccttccaagtagctggaattacaggcacccgccacccacgcccagctaattttgtatttttagtagagacggggtttctccatgttggccaggctggtctcgaactcctgatctcaggtgatccgcccgccttggcctcccaaagtgctgggattacaggcatgagccaacccgcctggccaattttttttttaagttttcattatctggaattctttgttgtttttgagatcagaatctctactaatgatactcaagatgggtgtaactacaaaatctgcagatgttgaaagaagcaaaatggatctgttgaaatttctctttttttctttacttttttttttttttttttttttttgagatggagtcttgctctgtcgcccaggtgggattgcagtggtgcaatctcggctcactgcagtctccccttcccgagttcaaggaattcttctgcctcagcctcccaagtagctgggactacaggcacctgccaccacgcccggctaattcttgtatttttagtagagacagggtttcaccatgttggtcagctgatcttgaattcctgacctcaagtgatctgccctcctcagcctcccaaagtgttgggattacaggcatgagccacaggcccagccagaatctgtgttttaataagatccccagggggtatgtgatatgaacgtttgagaagcccaagtctaaggcaggataaacatggcccgaggggaatctgggcatcacctctttctgtacagccagggagatgggaatggtttttacattttttaatggttgggaaaaaaaaagaagactatttcttgacacattaaaattatatgaaattagtatttcagtgtccataaataaagttttattggaacacagctacgatattcacatattgtctatggctgctttggctcaaaaagaattgttgagtaggcatgacagaaatcgtgtggcccaaaaagcctaaaatatttatgatctggcccttcagaaaacgttctccggcttgtgatctaaagtgcactggaagtacattctttgtgggtttccaagtagcttgtacaccaaggttagctgattataacaatgtgttgtttaacgatcctttatcatattaaagttgaattaataaggcaaaatcagtatttaaacataagaattatatattcaagcttcaaacttgaggaaatgccactttgactttttttttttttttaagatggagtctcactctgtcaccaggctggagtgcagtggtgcaatctcggctcactgcaacctacacctcctgggttcaagcgattctcctgcctcagcctcccaagtagctggaactacaggcgcgtgccaccacacccagctaatttttgtatttttagtagagacagggtttcaccatgttggccaggatgatctcgatttcttgacctcatgatccgcccgcctcagcctcccagtgtgctgggattacaggtgtgagacactgcacccagccctgactatgttttctaaatgagatgctggtgaactaaagagtttcttagtttaccttttgtttcctaaaaaatgaaattatggggaaaataataaaacttataggataaaaattagtaatactggtaatctctggagagagaaactagaaggggtgggggcaagagtataaaggagactttattaaattcccttttgtgcctttcagaattggatctgggattcaaacatatgggataagtttgctatcattttccccataatttcatgttttaggaaataaaagatacaattgttactcctcagaatgttttgtcttatgctgttgttagatagtttgaattaagtcttctctgtcctcaacacacatgatggttgtcgtcttgctctgagaatcaaagttcacaatccttgctcatctaggtgggaacctgctcgtgctggtggatcagcacgctgcccatgagcgtatacgtctggagcagcttatcattggtaaggatctgtttgcagccagaaaaaatttgagactcccagcagaatcagtacacctcaaagagcttttctaactgcaactgttgtgagaaagcacactttgtactgtatgttcaaaaattaaactaaagtcctgcagtttggcctgtgttataattgaaagaatgtggtagttcactaattgaaagatgtgaacttatttatgtggtcagaggcatatttgccagatgttattaacaacccagaagtacgcaaggataggctgcttactctgacatccagcacaaagctctgcccctccatatgcccggtgatcttggcatgccttcccacactccatcaggcagagaccagtggcagctcagaaggcccagtatgctgttttgattttaaaatttagtttgcttttgaatatgcagtataatcaaatagatccaattctgaaaggcacaaaagggaatataataaagtctcctttctatccttgtccccacccctcctagtttctctccccagagacaaccaatatctctggtttttaaatctatctttccaaagcaatatatgctttttaaatgtttttttttgctacccttttcctcatcatgaggcagtgtgttcaccaagtggtaaaataccaggaaagtctttactcctgtggccaatgagtaatgtcaaagagttaggcaaggacctaaggagtgcttcatggactagaatggcaatgatattactactgttttcacttttccttataaaatgacggcctaagagttgggaaagatatagtaaaaacagtgttagaaaaacttacctctacaggccctgcaccatttgagaatagtactaattctctccagagactgggagaccctgctcaaggaaagggaagccttctggagccataagactgtgtggtcaacccacatatgttcctggtaatccacattattcacctctgtcatcaaaacaacatttattaactacaggaacattggcttgttcatctgaatgtaagatgcaagtcttatatttcttattttgaaaaatactaccaaaattgttaataggctgaatatttattagtttgactttaaaaatggaaatccaaaatctaaaactgaacattaaacattctgctttgcattagaatgattatctcaaggccgtgctttatttttatctgaatctagaagacttcccttcctactcttaacccattcatctttctgccaatagattcctacgagaagcaacaggcacaaggctctggtcggaaaaaattactgtcttctactctaattcctccgctagagataacagtgacagaggaacaaaggagactcttatggtcagtaccaccatgagaatgtgatgttgatggtatcaattctcacaataattctgtgaggaataagcataactattgttccatttctcagatgagaccaagagaggttacaagacttgtctaaggtcatagcagttattaagtagtggagcaggcactcaaaggcaggtcgtctgactccacaggctgtttgtttccttttttaaaatatatttttttctgcatccaatcatccattaaaatatttattttgtgagacatggtctcactctgttgtccaggctggagtgcagtggcacaatctctgctcactgcaacctccaccttccaggctcaagcagtcctcccacttcagcctcccaagtacctggaactacaggtgagcaccaccatgctggactaatttttgtaattttttggtagagatgggttttcgccatgttacccaggctggtctgaactcctaggctcaagcgatcctcccactttggcctcccaaagtgctgggattacaggcgtgagccactggacccagcctattctttccactgtatcccagctgaagagtataggatagagtttccctgataattttttccagcagttggcttagaacactcttctcatttcttggaacagtctgtgtttatgccatgctttgtgaaagcaaagtttctgcagtaattggtcccattctgctttgctttggtgcattctagactcttagttttcattatcgtaatcataatgggaagaaagtaaaacattgggatgtaaggaaggggcgaatcatatagtgagtcacaagataggatatttttcctcttctaggcagcacaaattattgaaaatgaaaaagaaatttctcccaatatgtttcaggtttgggaatatgatactgccagtaaatctttttttccctatgacataatttatattagaggcagatctatttacttacatcccgttagtcaggacttctcaattccttgggctgttaattacctccctgctttaatgctgattcaaatcactctcagaccttttcttcatgccagactcccttaagtgccagcagccagaagttagcagttcctcaatgaagaaaacacacttagaaacaagacttagacacagattgattcccaatggaaaagagaaaaacaataaaggttactgtaattcaaaaaggaaatttgataataaaaaatcccaaacacccacacataagtgtgagaaaaacaatacggttgttaagccctgtggcagcttttgaaaaactattaagtagtatttggaaccagtagtgaagtgcaaatgaagtagcactctttttttttttaacatttgaggttatctctttaggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggtaagacacagctgcagatgttaaggaaattgctgagtgatggtaacctcatattttgtctgtagattctctgaattcatcttttcttcaacaagtattcatggtatttacctgctgtgtgccaggagctagaaattcagagatgagttagctcaaaataaggaagaagggcatttaaagaattatagtcagtgaactttggctagtagaggtatgtgttttgctttcttcccagtgataaaggtaatgaaaactaagagtctagaatgcaccaagatagtttttcagaagtgttatggaaacacagaatgacttgtgtgcctggggaggtgaagtcaatgaaaatgtcacagaaaagctgttttcttaagaaaagtttttacttttgagagaccaggtctcactctgttgcccaagctggagtgcagtggtgcaatcatagctcactgtagccttgatctcctgggcacaagcaatcttcctgcctcagcctcccaagtaactcggactacagacacgcaccaccatgcctggctaattttttccttttttttttttgtagagatgggggcctcactatgttgcccaggctggtcctgaacttctggcctcaagcaatccccttgcattggcttcccaaacccccggcactacaggcatgagccactgcacacagccagaaaagtcttacagaatagtgggaaactaggctgggcaaggtggctcacacctgtaatgccagcactttgggaggccgtggtgggtggttcacctgaggtcgggagttcgagaccagcctgacaagcatggaaaaaccccatctctactaaaaatagaaaattagccgggcgtggtggtgcatgcctataatcccagctactcaggaggctgaggcaggagaatggcttgaacctgggaggcggaggttgcattgagccaagattgcaccattgtactccagcctgggcaacaagagtgaaactctgtctcaaaaaaaaaaagaaaaaaagaatagtgggaaagtgctgagtacagaagaggggagaagggcattctagacagaggaatacatatcagagacttgagatacatcctatgtttagggaactatcaatagatatggctcaaattaagatctacagttgatccttggataacttgggtctgaactgcacaggtacacttaaatgcagattttctttcacctctgccattcctgagacagcaagaccaacctttcctcttcttcctcctccttagcctattcaatgtgaaaatgatgagggtgaagacctttatgatgattcatttccacttaatgaataataaatatattttctgtttcttatgattttcttaacattttctttttctttctttctttctttctttttttttttttttttgcgatgcccaggctggagtgcaatggcacaatctcggctcactgcaacctccacctcccgggttaaagcgattctcctacctcagcctcccaagtagctgggattacaggcgcacaccaccatgccccggctaatttttgtatttttagtagagatggggtctcaccatgttggccaagctggtattgaactcctgacctcaaatgatccacctgccttggcctcccaaagtgctgggattacaggcatgagccactacgcctggccaacattttcttttctctagcttacttaattgtaagaatacagtgtgtaatatatacaacacacaaaatatgtgttaatcaactgtttatattattggtaatgcttctgatcaacgttaggctattggtagttaagatttggggaaatcaggccaggtgcagtggctcacgcctgtaatcccagcattttgggaggccaaggcgggcggatcatttgaggtctggagttcaagaccagcctggccaacatgatgagaccccgtctctactaaaaattaaaaaattagccaggcatgatggtatgtgcctgtaatcccagctacttgggaggctgaggcatgagaattgcttgaacccggaaggtggaggttgcagtgatccaagatcactgcactgcactccagcctgagtgacacagtaagactccgtctcaaaaaaaaaaaaaaaaaaattggggggaaatcagaagttatacttggatctttgactggatgggagttggctagatgggttgtcaaggtcaaatcataaaataatttagcatattctactaagtagtttgcattttatcctataggcagccagtgaaaacttttaagcaggagagtaaggtccattttagattgcattccaaatatgattactttacatatatgttttggtaaaggtttggaaagctactgctgggctgtggcattggaggtattagagagaactattactttttattttgattacttatatgtttctttttttatagcaaatatcatttattttgtctttattgtctttttcctctcctttcctgttttctattatagttttctgtatttctctttttttttttgctctactcgtttagaagttatatattccatttatatccttttagagattagccttaacttttagcatgcatacttatcaaagtttaaaagtaattcacttctctatcctcttcctaactgtaccaaaatcttacaaactgttcatctcccatcaccctcctcccatcttccatgttgctgtctagtactttaattccaccttgtttttaattccctggtggtcatttattttatagtcaatctttatttagattaaaaaaagtgttcaccagagtctttgttcaccattgcctcttgcatcctacttattctgtgttcttttgggttttttgtttttttttttttttttttttttttactgaagtaaatctcttacaagatcttttatccacaaacagatcttgagacaaaaaatacaaaaatataaaaataaatagaagttattttagtaagagtccgtgggccaggcatggtggctcatgcctgtaatcccagcactttgggaggccaaggcgggcagatcacctgaggtcaggagttttgagaccagcctggccaacgtggtgaaaccctgtctctaccaaaaatacaaaaattagctgggcatggtggcaggtacttgtaattccagctactcgggaggctgaggcaggagaatcacttgaacccgggaggcagaagttgcaatgagctgagatcacgccattgcaccccagcctgggtgacaagagtgaaactctgtctcaaaaaaaaaaaagtccgtgaatgataagctgtcttttaaagtatctttattttgtcttcatacttgcatgattatctagctaaaaacagaatttcacattgccagttatcccccccgcattttgaaaatatttcactacttttgactttctattttattttattttatttcattttttgagacagagtctcactctgttacccaggctggagtgcaatgggatgatctcagctcactgcaacctccgcctcccaggttcaagcgattctcctgcctaagcctacaaagtagctgggattacaggtgcccaccaccacacccagctaatttttgtatctttagcagagatggggtttcaccatgttggccaggctggtctcaaactcctgacctcaggtgatctgcctgccgtggcctcccaaagtgctgggattacaggtgtgagccactgcacccagcctgactttctgttttagccattgaagtccttagtcaatccaattattactctgtaggtaatctgattttccctctggttgcttttacgatggttcactttgtctttggtgttctgcaatttccctatgatgtatctttgtatggatttattttcatttccttctggagattcactatgcttcttcagtttggaaagtatgcagtcattatcacctcaaacgtttctttcccattctctctcttgtctcttggaaattttgtcagatatctactgggccttatctttctactctgcatgcctcttcaactctcttccatatttcccattgctttctctctgtgatacattctgtgaaatctcctcacttatcttccagtgaactaaagtatctcttcatcttctgtttaattatgtgtttagcttatccactgagttttttatttcagtgactaaattttttatttcaatggctatattttttatttccagaagttgtgtttttttccccaaatctcactcttccttttttatggtgtcctgcttttttcatgattgttccttctcctttatcactagctttcttgatttggagcacaggcaaatccacacccacctcatctagaagtctgaagtgctttagtaatatctaaaatagtaaaatctaaaattagaggatagatgtagtagataaattgggggatggatttatgtgggaagatttgagtcagggagagcagctgacgggttattgcagtggttaaggtaagagaagatgaggattggactgggtcagtagcagagggagtagagaggagtgacatatttgagacagaatttgggaggcagaagcaagaggacttggtgagcaatcaaacgtgaaaggaataaaggagaaaacaaaagcaacagtgattctgagggttgtagcatggatggctggaaggatggtggtgccattgacagagaagggacacagatgaggaggaacaaacctgcctaggagttccatcgtgaaggtgggtttagacacagtgaatgtgcctgcaggtggaatgcccagtggataggcacacttaaaagatctggtacttggaaaataaatctgggctgtacatatctatctgagagttaacagtatatatatattgatagtatcagaagctggagaagggccttgaggaagtgaggttgtccagggagaatatggagagtgaaaaggaagagagaaaagagtggagcctgtggaacatcagcatccagggtgcatatgctttggaaaaggtctggaaagctctgctgaaaagaggaaattctaaggatggctgaaaatacttggttagagagggaggaggaaaaccaggaaaaagcaatattgccaaaactaaggaaagttttaagcaaggagggaatggtcaataacggctatgaagtagagcctgaaacgctggacttgactgtcatgaggacattagttgtcttgtggaatcatttcctggggatgaggtggggcagaagataagagtgcagtgagtcaggagtgcgtgaagcaggaggaagtgaagctaagtagacaactctttcaggaactttggctacacacagaagaagagagatggggtgagagctaaaggttagaagtggttgggaagtgtggggtgggattcaaggctgaggaaaggtgtttgtttgctttaagacaaaaaagacgtaagcaggtttgcaggccaagggggaaacattcaagaggaagagcagctgtcagtcagctcttgggtcatcttggctttgccctttccagaatcgcctttggatcagacagatccaaagatttgctctgcttccagcaaagctctttcctccccacagacatgctttctctaagacccctgctccaaattgtcctaaatccaaaagataggatctgttagagtcttttattgtaattcaatccctaatatgtaaccagaaaattataagaaaaacttttcctgaaggaacttaaaagactactgttaaggagtttgcttcaaatggaaacaaacctctggtttcataaaatcttgattatcctatgtcaggctgatcaggagagactttgtgtgattctggaagaagctggaacagttttggtgttttgaggaggtagctatttgaatcctagcagttgaaagatcattaatacatccttctataaagctctatcttctagcctggtgaggaggtggaggctgcagtgagctgagatcgcgccatggcactccagcctgggcaacaacgagactccgtctcaaaaaattaaaaataataaataaatacggccaggtgcagtggctcacaactgtaatcccagcactttgggaggccgaggcaggcggatcatctgaggtcgggagttcgagaccagcctgaccaacatggagaaaccctgtctctactaaagatacaaaattagccaggcgtggtggtgcatgattgtaatcccagctactcaggaggctgaggcaggagaatcgcttgaacccagaaggcagaggttgcggtgagccaagatcgtgccattgcactccagcctgggcaacaagagtgaaactccatctcaaaataagtaactaactaactaaataaataaataaaaaataaaataaaaatattaaattatccagcattaaacagaccattggaatataaaatggactgagatgagacccatcaccccttcactaagcttacaaacagatgttttaccatcccagatgtacaaacacaagaatgtttgctctccatccacactaagctttgtcagtggattgagtcttatgagaccatctttctgtttaggtttgtttgggaaaacatgtgatttttaaattatatgtaatatagtatctactacctagctcttgataactgtgctcatttataggcatggcagactagagtatagatgaaggagggaagagaatttcctgagtctggttttaaaagaaaaggtaccatgttgtaatcttaggagcagatttacacatagccttttccaggagtaaagaaatgattttcttataaagaaatcattaaatgtgcaacaggtttttttctttttacctccagaggttaaacaaattggtagcatgaaatagtgtctgctttaaatttctttaagcttcttttgtaaatattaatatccacagggatataactattgaaaaggttaccccagggacagagacatgcaagggaggagaaatttctcaacaaagggcctcagaaaataaactttctgacctgaagggaattgtccccaaaaagcccgtgggaactaaagtgactgtttacttatgtttatgatatttaagcaagtgttatactgagcagtggttgtgttgatggttgttgtgtatttattctcagtttgtgtgtaatattacgcttgttctggctaagattacacacacaaacagacagccttttagtgagaagccttcctgatgttttgaattggttgaatcatcaaggctactctcaccagctacataacctcattagttgagaagctatctctggaggaagtctcagtagctaaatatattctgtgttcaataagagttctattcagttgcttggttttttcatattcaaagtgccttacaacaaataaatttgtacccaagtgctgtattgctggaactctttctttcaggaggcatgatttaaagaagaaaattgagatattttgtaaactatcaaagggcaagtaaaacataaccgtagattaaagccgattttccttttgctttgcaggaatttatccgagaacaactggaggtaagcttttcctttattttggggtttcacacagaagcaccacacataaaaggcttcgttgttccattttcttttcctgttaataacgtgtttatgcattagctactccagaccaccggaggcatccaagggacattgccactgactgtccagaaggtgttggcatcccaagcctgccatggtaagcccttcaacatagcagtgatcaaacacctctgcatgcagagccctggcagggctgccgggattacgaaagaggcagagggtacatttactacttgactcttggagaatacaatttagatcaagaaactgaatatacccttttaaaaatcacttttacaaaaacaaaatcccaacacaaaaatttgactatagtgctgcctgacctatatgagtggaggaataactcctagaggagatgcattttgagatgaattttgaatgagctggggaacatgggttcatagcatggaaaggggaattcactatagggagagtaaacagcctgtgcagagaggcagaacagaaacaagttagttatatgagaagcagcaaagagtatcaagaaactaggcaggtaagagaacagaaacctagaaggtcacagcaaaacctttggatttgatacagaaggcattagaattagcaagcgttctttttttatctttccaactttcattttaggttcagggggtacatgtgcactttgtaacatgggtgagttgcatgtcgcaggggtttggtgtacagattattttgtcacccaggtaatgagcatagtacccaataggtagttctgatcctcacccacctcccaccctccaccctcaagtaggcccaggtgtctgttaccccttctttgtttctatgtgtattcaatgtttggctcccacttttaagtaagaacatgcagtatttggttttctaattcacttaggatgatggcctctagctctatgtttttgcaaaggatgtgatctcgttcttttttatggcgacatagtattccatgatgtatatgtaccacattttctttatccaatccaccattgatgagcattgaggttgattccatgtctttgctattgtaaatagtgctgcagtgagcataacacatgcatgtgtctttatggtagaatgatttctgtttctttgggcatattcccagtaataggattactgggttgaatggtagttttgctttaagttctttaagaaatctctaaactgttttccacagtggctgaactaatttatatttcccaccagcagtgtataagtgttctgttttctttgcagcctcaccagcatctgttattttttaactttttaataccagccattctgactggtgtgagatggtatgtcactgtgattttgatttgcatttctctaatgattagtgacattgaacattttttatatgcttgttggccatgtgtatgtcttcttttgagaagtgtgtgttcatgtcctttgcccattttttaatagggttttttggtttttgcttgttaatttatttaagttccttatagattctggatattagttccttatatagattctggatattagacctctgttggatgcagtttgcaaatattttctcccattctgtaagttgtccgtctattctgttgatagtttcttttgctgtggagaagctctttagtttaattaagtctcacttgtcaattttcgttttattgcagttgcttttagagtctttaccaggaaatctttgccaaggcctacgtccagaatggtatttctgaggttttcttctagggtttttgtaaaaagatggaatgcgcccaggcgcggttgcttacgcctgtaatcccagcactttgggagaccaaggcggatggatcacctgaggtcaggagttcgagaccagcctggccaacatggtgaaaccccatctctactaaaaacataaaaattagccaggcgtggtggcgggcacctgtaatcccagctactcaggaggctgaggcaggagaatcacttgaaaccaggaggtagaggttgcagtgagccaatatcacgccactgcactccagcctgggtgacagagtgagactccatctcaaaataataataataataataataataatgaagatggaatgcttcatgaatttgcatgtcatccttgtgcacggaccatgctaatcttctccgtatcactccaattttattatatgtgctgccaaagcgaacaccattgagggttcttgagcagggtaatatgatacaatatagaaaatggggagctgggtgaggccctgtgaggaaggtgcctgcttctccttcaccttccgccataattgtaagttttctgaggcctccccagccatgcagaactgtgagtcatttaaatggtctttcctttataaatgacccagtcttggtcatttcttcatggcagtgtgagaacagactcatactcctctatcaccaaatgtcatcattgccaccttcaaaatgtatcttcggtccgtctgattcagtctgtctggctcctccctcatttttgccactgttgagctctcttacttagttcttcacatccactctggctccctttcaagctgctcttctctcagcacccagaggaatctttttgaaacatccctccaagcatgttgttcttctaactaaaatgtgtcaatgatgacccattgctcttgggatagaaatgtgattttttactgtggcccacaagggtcttcgtgatttggcccctgcctgcctctccagtgtcacgtcatatcactctccaccttgttctttacatcccagcctgcttttttggtcttctgcttcctgtgtgctaaacatttgtcagcgtcggggcctctgcactggccttctcctctacctgaaacacttttctctccttcttcaattagccacgtctttcttaacctaaagtctcagcttgaatactactttgccaggaaagccttccttaagctcctaaactgggtttggtcttcctattatatattcatatcctgtattttatagcacctatatttatcatttaaattattgtataattatctgcttcatgtttgtctcccctattagaccataagcgccatgaggatggaaattatctgtctcactaactgcctgacaaagctcccaatacaaagtatatacttaataaatatttgttgactgggtaaattgtgcataaaggcaggttataacaatatgagagtttagattaggaagattattatggaaattagaaaaaaagaagcaaataaaatgaacattgtaaggaaacaatcagagattgctattggacgatccatggagaaagataaccccaacttcacaaacccataaagagtaggcaaaaatactgctcttgcctcttggagaaaaactctgaaagccagatcctaacaagttaaggaatgcctcctacagagattagaaatacaaatactccgtaagaaaaagctgagagacagaaggtcagtcctgaagccttagtttcatccatggtcataagcactaatttatttccctctttttttttttttttttttttttgagaacggagtctcgctttgttgcccaggctggagtgcagtggcgtgatctcggctcactgcaacccccgcctcctgggttcaagtgattcttctgcctcagcctcccaagtagctgggactataggcgcgtgccaccacacccggctaatttttgtatttttagtagaggcgggatttcaccatattggccaggctggtcttgaactcctgacctcatgatctgcccgcctcagcctcccaaagtgctgggattacaggtgtgagacaccatgcccggcctataagcaccaatttcaagcaggattaaagcttcattaaagaagcctaagaaacatgttactttttccagatatttggcagtgacccaaggtcagcattggtttcccactatatacactataaccttcttgtttctgtctttcatttaggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacaggtacattaatgactaacaggagcaggagggagcaaagtttatcttctctttcttttctggcttttactatgcaactgtaatctgtcttaacctttccaaaataggagagttttgcaaaatctgcattggaagtttcacataaagcctcacccatttcattttccagctcaaatccaaaatggaacttagactgaactgtcaggtcacctacataatggctttgtattttaaaacttaacacatgtacagacttatgtaccctgaatatctattgcctgctggctctaggtttcataatatgcagttctttctgaagctactgaaagttggtagaagcacagcaaattcactgttggcaatatagagcctcaacttccagtttcttgatagtacctgctggaaacggtgatctgtgactgtagctggccatccccaaggatcttgagttatggtttgaggatcatcagacagggacccaagcttggggatctctacattatgctttggccctaattacccagcaacctgcaaactacaatgtggataatgcagaaaaggcacagaatggcttaaatgaagaacttctgtccttgttataatcttcagtgaaggagaacatggagaacataacaggaatgtccctgttgctgctttccaaaatctttccttttttttttgttttttgagacggagttttgctgttgttgcgcaggctggagtgcaatggtgcgatcttggctcaccgcaacctctgcctcccaggttcaagcaattctcctgcctcagcctcccgagtagctgggattacaggcatgcgccaccacgcccggctaattctgtatttttagtagtcagcgtttctccatgttggtcaggctggtctcgaactcccgacctcaggtgaactgtccaccttggcctcccaaagtgctgggattataggcatgagccactgcgccctgcccaaaatcttttcttttgctaacctttccctgctaagggatataaaatcttttcttgcatggagttttcaggtactaatgttgtctgactcaactagctgattttacttcattaaaacctctttgtttcacaaagaaaaatatgaagaaagtttttctccattgctgagagctgggaatctagacttaaagttctgagtccccttggatccttaaaacaatctgtaatctctattgaatccagaagttagaaatctaaacagattataacagccagactttggaaatatttgtatgctacctacattttcaattttttttttttgagacggagtctcactctgtcgcccaggctggagtgcagtggcatgatcttggctcaccacaacctccgcctcccaggttcaatcaattctcctgcctcagcctcctgagtagctgggattataggcatgcgccaccacacccggctaatttttttttgtatttttagtagagacagggtttcaccgtattggccaggctggtctcaaactcctgaccttgtgatccgcctgccttggcctcccagagtgctgggattacaggtgtgagtcacctcgcccagcctgtatgctacctaccttttcatattgctaattgaagttattctttcttcccatagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattca

SEQ ID NO: 13474 - DNA, 33731 bp, Human; identical to SEQ ID NO: 13473

SEQ ID NO: 13475 - DNA, 24954 bp, Human
gtggtttgactaaagctcacaatctgtgagaatgtggggagagaatcagaacataatcagaggcctgattatcaggtgcctggccaagttgaggagtttgtactttatcctacaagggagataaactttatctcccttgctttatccgaccaggagaagcaatgaaagactttaatcagaggagtgacaggattaggtttgcatttcagaaggatttcttttttttctttactttctttttttttttttttttgagacgaagtctcactctgttgctcaggctggagtgcagtggtgcaatcttggctcactgcaacctccatctcctgggttcaagcaattctcttgcctcagcctcccgagtagctgggattacaggcattcactaccacacccagctaatttctgtatttttagtagagatggggtttcaccatgttggccaggctggtcttgaactcctgatctcaagtgatccacccacctcatcctcccaaagtgatgggattacaggcgtgagctaccacaccaggctcagaaggatctttgacacagatataaaggatgatgggctagagaaagcgagagcggaggcttagaactgcttagggagcttttcaaataattcaggtgaaagctactgaggagttaattgtgggtagcagcagggcagagctgttttctctatttctagttaggactttggcccatccttccagaatttcagtggcagtgctttcagggttcaggtgagtgaaggcactgtaaaggtcctgatggaatttgaggccagcctgggcaacatagtgagaccccgtctcaatttatattaaaacataaattaattagaaaaataaaaaataaaggtcctgagggccaggcaaaatgcctcagataaagaaatcatcatgaacggcaccaagtggttcattcattcattcatacatttatgtgttactaattcagccagaggtttaaagcacatctttttcattaggaaggtgagccttaaaggtgaatactcaaggggcctgaatacttaaggaggggaaggggatgctatatgctttcacttcaagtcagcgggaagaatggcacactcaaagtggggaggtcagcctggcatggtggcacctgtagtcccagctactccagaggctgaggcagagggatcgcttgagcccagagtgtcgaggctccagtgaactatgaccttgtttcttaaaaaaacagctgggagtttatattctagggatagggtgacaaacgaacaacttccaaaatgcacaagatgtatggggaacaattagtttggctggaatttgcgttggggggagatcagaagctgttgagaaataaggctatagttggtgaagatatccgactcgtaaaaaggcaatgggatttagaaattcctgggattctgtttctttgactcggggttaggaagacagggaagtaacaagtgcctttttttttttttttaatagttaagggacctgagactgggggtggggggcaatgtcatctgccccaggccacacaagtgtaagatcaggcatgcatgtctgccaaggtttcagttcaatgtccgtgcccctcttttgctctcttcccaaggtacagaggcggaacggcgcggtgccctcgggtcccaagagagaagggcgccaagctcagagccagttctgtggaagggtaggggaaggcctgaccccgggggcaatgtggtggcgggacagtcgtatacaccttcaggagaaccacctcaggctgacaggcagtgcggagggccccaagagcgccttagggttgcctgctccagagagcgggactcctgcgctgcagccgggatactgggcgccgccgtgcgcccaccccctgccagtggttcgctccgaacacccctcgtcgggcggcgggtactgcggcccgccccacttccggttgttgtccggccctatatccggtgtccgcccgccctcggctcctccgccgtgatgctgtcccgatcccgctgtgtgtctcgggcgttcagccgctcgctctccgccttccagaaggtacggtctggccgagccggggccccgacgggtgaggagtctgttggcgggcagagaggcggcctggaaggcaggggcgcggcgcgccggccgggccgggcaccaagggcactgggacgcggaggccgcgcgggctgggcggcccggggccgtggttgccctcgggaccgttttgcggagcccagcggccccctgccttctccaggcagcctgcggggaacgtttcctgctgtaccccaccctccgcgcgggagctggggagccgcgcccgtccagatacttgactcagagttagggaggaggcgcggcggagtcctccggcgggattcggcgcccgtctcgtcttgctctgttaaaatcagtgggtattaatgagtcccgttgggaagttgagatagtttggcaggcccagcgtgttgattgggtctgccagcacggtgtgttgcatttaccttcggagttacgagattcacctgtcaccaccactgggacagctttgagcgtgtacttaaaagaaaaagctgggtttttttttcatcttgggtgacgtcgataatgtcttctttctcaacaggggaactgccctctagggagacgttccctgcctggtaagttctgcccttaccgtcacctaaaatgctctcctcctgggcagagcagtatgtgaggaactcgggggtgcctgtgtttctcataatatttaaagacagtttggttcagagagtagtgagacgcaatgctacataatcacgagctatcgcttattcatttagctcgtagttgagtttctactgtgttaggcactgtgctagacgctagggatacaggagtggatacagaagtgtacagttcttgccctcgtggagctcctaggctagttggatagtgtcagttgctaaacaagccaacaaaggcaaatttttgtaactgctgagaaggaaacgagggtggacagaagagccctttttgaggaggtgacttaaaagttatggccatggccgggcgcggtggctgacgcctgtaatcccagcactctgggaggctgaggcgggcggatcacgaggtcaggagatcgagaccatcctggttaacacggtgaaaccccatctctactaaaaaatacaaaaaattagccgggcgtggtggcaggcgcctgtagtcccagctcctcgggaggctgaggcacgagaatggcgtgaagccgggaggcggagcttgcagtgagccgagttcgcgccactgcactccagcctgggcgacagagcgagactccatctcaaaaaaaaaaaaaaaaaaaagttatggctagcagaatgtgacggagctaacccagtgaagcccaggagaaagagaatggcattcacaaagaccctgaggaagaaaagaggttggcagaacttaagagctggaaaaaaggtgatttggccggagtattttggttaagggagagagtggcaagagatagaagatggtatagagactgaaggagtttagattttatcctagcagttaaaaagaaaaaagtgtcatccatagctttttttctgttatatgcctagcctaagtatttgttgaatgagttgaccttgttgtgggctttctttgtgccaagcatttatatgagtgctttctgtgaattttttagttaatcatctcaaaacagtaaaaagtattttctctattttacaaatgcataacccaagacaagagagcttaaaagccttggccatggtcacccacccagctgttgataagccaggtctacctgacccatcctgaactcttaacccaccatgttctcatttactcatggactcaacagatcatttattgagtgcttactatatgccagccactgttctaggtaacaggggtatagatagactctagcctcgagattttatgggctagctggagagagagagcaaatatacatttatgctccgacaagggcataaattttggttactacgagagaggaattaaagggtgtgatgagagggtgggatgatgtagaccagcttgggaaggttgggaatgtcagtaaaggcttccctgaagaagtgacatttaactgagacctgaatataaaagagccaagaaaatgtattccaggcaaagggaattgcttgtgcaaaggttttcagacaggaaaggacttgaccagtgatagacatgggaagaagcctgtctggcaggaaagatagagtgggctggacggtacaggatcgcgtaaagtgtggactttatcctgagagttacgagaacataaagcccctagcacaatgtcggcttgtagtggactctcaataacaaacatgtttttcaagtgggaaccctgaacaatgtcagtaaacattttctccacttcataggtgggcaggacaatggaaagagccttgcacttggggatttgcatttgggctcagggattcaccttgggctagtcgcttaacctccaaaagtcctacttatatgaaatgggaataatggcagatggtcgttccacttcagagagttgtgagactgtaaaatcaaaatgaggtcattatgggaaagctttttataaaccctaaagcactgtacaaatgaaatttgctgtaggatgaactctgaattggactccaggttcccaaaatcagtgtgagccgccatctattctagttcaaaaacatactatgcttagaatttgcactgcatagtcattggctgctggacataaaggtgactggcttacctatcttgggatgcttgtgaggaggtgggcataagagagggctagctctcatttggtgtgtcctgagcccatggttcagaaagagttgttaatctgaaagaaaaaagacataagaaagaattcagaagaggcagctgtagttactagtcatcagttggggaaatgcagttaactatgataaggacagctggtgggcagaaagggtctctcaccttgttgagagtgaccagggtggaagacttcagaaaggcatgggaagtcaataaactgaaagatggggacatgattttctcagctctaggacaaactggagaccccgagcctaaagtagccaagtctttgctactaggattcaggtgataagatttccaacccaatcttttcaaacccagaccaaacatcctccttgcttctcaaattgggttatgtatagtcacaggataagccatcccatgtctttctcaagcttcagttgtatttgaagacttggcgagtagagacattttattatgaaaacatacaggaataatgaaaagttctggctttttaaggtagatgagattatataatcactttgggctgtgccatcaaattttttctctttcctccccagccaaacacatacccactcgatctcacatacccatttgctctctgccactaaggctactttggaaaagtttgagaagcaggactctatgataaagattatatccgttgccgttgatcctgctctgtctcagggttgggggtgagcagaccttttccattcccagcatgtatcctttgtgagataagagttgttggttaagagttattttgtttcttgcaggggtctccttatgccagggaccaggttaccctaacagcaggaaggttgtgtaagtatcactggggagtacagatatgtggccacgggttatttatttaaagacataaagttctaaatttgaccatctgatttcttcactggcctccagacctagaaattgaggtgattatgttgagtccctagactaacctcaatgttcacttttcccatgtgatgttccttgagcatcagctccgtgtcaggttttggactgggagtgtgcccactctccacaggtgtttggattataatgaaagttaagttggaatcctctttttatgggatatagaagggtgctcctagatattctgtttggatgtaagtgcagctgaaaggctcgaggttacatttattgtggagattgagagcatcctctcagtagcatagttactcatttttaaaaacagtaaaagcataaaactggttgagtcctgggactgactgactagtttggagggaatgctgttattgcataatgcagagtttggagaaaggctacccatgtgtgtttcagattaacttctgcgtatgaatgttgcttaaatgctgctttgcattccaagtgtttttgtggtggtgctaagagaatgctctctagtaacctgttcagcagctgtcaggctgcttactctacagggagaatcctcaaagtgaagaggtcagcggatgagcttcttacttactctacatcacaatgagggtttttgttgttgttgttttgagacaggatcttgctctgccactttggctggagtgcggtagcctgatcttggctcactgcatcctcagcctcctgggctcaagagatcctttcacctcagcctcctgagtagctgagactacaggcacatgccaccatgcccggttgttttttgtattttttgtagagatggggttgttttgccatgatacctgggctggtgtcaaactcctgggctcaagcaatccatccacttgccttagcctcccaaagtggaggatacaggcgtgagctatggtgcctggctgattttttaaaatttgagtaaatgttgcactcagtactagaaatatgaatcccggtgttattttggagggcagtttgatagtcataagtctttgaagtgtgtgtaccttttctttttttctttttttcaagatggagtcttgctctgtcacccaggctggagtgcagtggcgcgatctcggctcactgcagcctctgcctctcgggttccagcaattctcctgcctcagcctcctgggtagctgggattacaggcgcacgctaccacacctggctgatttttgtattagtagagacggggtttcatcttgttggccaggctggtctctgaaactcctgacatcaggtgatccgcccgactcagcctcccaaagtgctgggattacaagcatgagccactgcccggcctgtgtgttccttttcatctagcaattccatctctaggaatctatactgaagaactcctggtatatttatctcagatttaatatctgataatataaatattatcagatttatcttaaaatggcaaagagcaagggattggctaaactatagcatgttcacatgttcacactatgaaaagtgggaaaaagcaggttacaaaataatttcattttctactgtgtggtatgatcccattgtaagtattctttttgctatttctaatattctgtagtgaacatctagttatttagagattcaaaatgtattactcatctgcaatcaaatgaaaattggggcaatcatgactctctacaataaatacactaaatatttgaaagtaaataatgaagaaaaagtaaactttgtgtgggatcaccccaatcatgtcaccctaatccagtatctttgtgtgtgttgtgccttttttgtgaataaggtacccactttatttaataaatcttttattgtaaaacaatttttggttttatgtttttactaatagtattatatttacatgattaaaaattcaaaaagtaaaaagggtgtccatgagaagacttttttatccttgtcctctagccccccgaatgcctcttgggtagtggtggccaccactccgggttcctggatgacttgcagagcagcctctgcacttgcatgttacctgttagttcttgcctataggcatgtactttacaaggttacaaactatatgtagaacaatttgtattcttgtagtttttaaatatcttcattttttcttggttatacatagaccttatagttattttgacattataaaagtaaaaatacctaaagacaacttaaatctcttttacttttctattataaaaatgcttgttgtggaatattcagacaatcctgaagtgtaaaaagtgaaagtccccatccaaatcattctcccaaattgtgtaagtgtgcaacacataaccagagataccatatatgtctacatctctcacccctcagaggtaaccactgttaatggctttgtgcatacagggtgagctgattctccagtttatattatttactgtaaaggccatatcagtaaacgccttggtctttgaggttcgttttgaatgaatccagaatgtgttgatgtgctgttttctagcaagagaaccgagtaggagataccatatggggtttgtgtgtggtttttttgtttttgggttttttttttttttttttggcataacaccttgttttacttccgagttaaccttgttaatcttgctgccttatctgatctaaatctgttatcttgagggcagaaattccattataccttgcacaatggcttgtaccctgggcaggccgtaaatctatctcggatttagttaaggaagagacctggctggacatggtgactcactcctgtaatcccagcactttgggtaggatctttgagacccgtctgggcaatgaaatccatagtctacaaaaagtaatttaaaaaaattatctgggtggcatgtgcctgtagtcccagctacccgggaggcagaggtgggaggatcccttaaatccaggagtttgaggttacagtgaactattatcatgctactgcactctagcctgggtgacagagcaagactcttatctcttaaaaaacaaaaaaccaaatcaagaagctaagtcatttcggtctgcaaaggaccaaggtgcttatttttttattgaaagagccaaatgtaagtctgttttgtgagagttggcattgcattgcagcacaggggcctgagcatacttggggagctcaccatttaaggtacctgggtcgttaggctctactccagacctgctgagtcagaatccctgggggagaggcctagacaagtgaactttgaaaaagttcctccccaagtgacactgatggacacccctggtcaagagtcactgtttaaggggaaggtgacccatggggccttaactagactaaaatgtgagtggttcgcctgttaaaaggagttaacgtgtgtttcttttgtagcattaacaacagtgtcttcagtgttcgctttttcagaactacagctgtatgcagtaagtacctgctttcttgggaatggaattttatgggaagagcaacaattgattgagtttaattaaagaaaaatattaaaaaggaaaaatgaactacttatgattttcttttttgcatttttcctagaggatgacttggttacagtcaaaaccccagcgtttgcagaatctgtcacagagggagatgtcaggtgggagaaaggtaagatttagtttcctattttttttttttttttttttgagacagagtcttgctctgttcccagcctggagtgcagtggtatgatctcggctcactgcagcctctgcctcccaggttcaagtgattctcctgcctcagcctcccgaatagctgggattacaggtgcccaccaccatgcctggctaagttttttgtatttttagtagagacagggtttcaccatgttggtcaggctggtctcaaactcctgacctcaggtgatctgcccacctcagcctgccacaaagtgttgggattacaggcctgagccactgcgtgagccactgcgcctggctcctctcacttcttaagtttaagtgctatctaaaattctcccctcccctcaggatagttgtagaatttatagctctgccgttttctttacatatgtactttctgctggccctgtaggaaagggttcttataacatacctgccaaaatgggttttgtggctactggaggctccccgctaacaggtagccttgtagcctttgattgtcttttcagctgttggagacacagttgcagaagatgaagtggtttgtgagattgaaactgacaaggtaggcttatcttatattcgtaccagcttttcatgggcttcccttagttaacctaatgaaagaaacagggacttaaccattgtttagagataatttttaactagctctaacttcagttgtaaaattattggatttgttcaatttaaaaaaaaaacaactttttacatttaactttttttttttttttttttttttgagacagacttgctctgttgcccaggctggagtgcaatggcctgatctcagctcactgcaacctccacctcctgggttcaagcgattctcctgcctcagcctccctagtatctgggcttacaggcgcatgccacaacgccgggctaatttttgtattttttgtagagacaggtgttgccaggctggtctcaaactcttgacctcaggtgatctgcccgccttggcctcccaaagtgttgggattagaggcatgagccaccgcacctgacctgcatttaactttaaattgtttgctgtgtgtgtactatgtacttcatttagtagctttagtcttgtagtgtgtggtgagggggtggggagggtaaataagctgtttccactttttcctgtatcacttggaaacatattaactgaatattgcctgaatgtttctgagaaaggacagaaagtgaatcttcacagtagcgatgacttgttatcacccttgctctgaaattatggccttagatgtttgtgtgcaaggccttatatattgtgttgcaactcttgttactcactggagatacgctgttgttgttgttgttttgagacgtttcgctctatcacccaggctggagtgcagtggcacgatatcggctccacctgccaggttcaagcgattctcgtgcctcagcctcccaagtagctgggattacatttttgtagtttttagtagagatggggtttcaccatgttggccaggctggtcttgaactcctgacctcaagtgatccgcctgccttggcatcccaatatgctgggactacaggcatgagccactgtgcctggcttcattggagattctatacagctaattttctaatgctggataaacatttggacttcctccatctgtcttcctcttccagacatctgtgcaggttccatcaccagcaaatggcgtgattgaagctcttttggtacctgatgggggaaaagtcgaaggaggcactccacttttcacactcaggaaaactggtggtaaagaagttctcctggtggtcaaggtctccagtgttccctcttgggattgggactgagcataatgtgctaattccccgatatgtcaaagactcttgtcattccagctgcccttagttgagggaataaggggtaaatttatatatagtgtgaacttcaaatgtcaaattctaaaagaaaagtgtattttttaaaaaataaaccttatactctgttctttccatgggtgtttcttagcaggagctgagaaactggaccttttcttatagatatacagattgagcatacctaatctgaaaattcaaaatctgaaatgctccaaaactgaaaatccaaaatctgaaatgcttcaaaactttttgagcactgacagaatgctcaaaggaaatgctcattgtcttttatggggaattcagtgttgtttcttttcacatctgttctctcatatctctaggaagggttggtatttcttttgggaagaaatgagaaacgaatttgtactggacctgataggattagagattaataactttatctgactcttagttaaattttataaccactaaaaagtctatttctttttcctaagcgagaatcgtacccgtagaccaacgagtcacagaagtctatttctttttcactgttacactaataaggcagatagaccgcatgattgaggttagtcaggcaagaccagaagctcagagtagaaaacatgtatggtagaaggctgggaaataaggtagtcctcctgttgcagaagtttgtcttagcactaaccctggatataatgtccagatgggtgaaaaacagaaacaaacatttcatttaaagttgtgagattattacttggccacttcagtgatttatgagtcatcctggatgaagtgctttcttaagcctaagtcaaccctcgatgactattttattttttgagatggagtttcactctgtcgccaggctggagtgcagtggcctgatcttgattcactacaacctccgcctccggagttcaagtgattctcctgcctcagcctgccgagtagctgggactatgggcacatgccaccacgcccagctaatttttgtatttttggtagggacgggctttcaccatgttggccaggatggttttgatctgttgaccttgtgatccgcctgccttggcctcccaaggggagtaatcccttggcctgtaatcctgggattacaggcgtgagcaactgcacccagcctattttttaatagtattcttgcatatataatgttaaaatagaggatgaagagtatcagtaattagaaatatgtttatgtatgcatttcaatattttaaattgcctaggtgtttttttttttccttggaagtttacattttcttgggcttgataggtgctttgaaagtacttgctgaatttattcagtggaaacctgtgaaattgggaagggagctaagttgagccagttatctgatggacatttagggaccctgaggactagagaatagtgccttatgtcattgtgtgtgtgtctcatagtgctttgcatattgctgatacccagtagacattcgttacttgattggagctagagtttttgccactaaattttgcttggttgcttctcatttcagacagtgccagtggcatatacttttcttgtttttcagctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctggtaggcttccaactcccacatgtcatgtgggagaacatctcgtctaatatgttccttcaaagggtaaactctagactgatgatggttctgaacaggccaggttggctgctttgtagaaagaattctagactttgtatccaaaggcctgctttgcatctcagctttctgttactagctgtgtgtctttaggctagtcacttaatttatctgaacagattgttcatctgtgaagttggagtgatactaatatacctcagaatatcttgaagattaagtaacagtacatatgaaagcactggcacaaactcagcagatgtttctttccttgtctgatgcagctttatcctcttttcattttcagtgtctgcagtaaaacccactgttgccccaccactagctgagccaggagctggcaaaggtctgcgttcagaacatcgggtaagcctctgaggaccactttcaggaaagaggcagggggcagtgttgagattagtggagtatgggtgtggtgatgcctacctttgaatgcctggcagctcattccctcaaccttgataaagggagtttaggatataacttcttcatagtcacataaccatcaaatgataggactagaacctgaggtcttctgaacacttgttcagtggttttcctactatattatgctaccagtgaaagccttgggtaagttaaatatttgtaggggtggtagcttagtaactcacccccgtcctcccacgatgtcacacgcttcagagaggtggtttagtgagctctattcctatacttctgggatacttagctgtagctaagggataatactcagtagcaatagctgtcaggtgcagacataaagcctcaaggaagtatggtcaggattgtggttcctctgcctgagaatacttcctaaaaatatgatagcctcgaaagtttgttgctcatgaggttctgttccacaaatagctattcttatgcaaatctttatcaacagaaagtgccctttttcttatgattcttatgttggctagactacactacactacattcttttataaatgggttttggtttttaaatcactgtttctgagccttcattcttggtcaagctttaggcacatctgagtgagtagttttggcctgtgtttgcatgtttttgcttggaggagaaagggccaccacaggaaagggaagcctggagctcgtgtacttagatactgtagtccttggccatctactcgtggcaagccgtgttctttctgactacacggggaatgcttgacccagagagatcagattgtcaatgcttgttccactcttactttcaggagaaaatgaacaggatgcggcagcgcattgctcagcgtctgaaggaggcccagaatacatgtgcaatgctgacaacttttaatgagattgacatgaggtagtgtctctagtccctcttatcccctaggcccctttttcttagagaacacgaacttgccccactccttatctagtgctgattctaaaactaacttgtcagggaagaggtatttgtttattgttttttgtttgtttgtttttgtttttgttttttgagatggagtctcgctgtctcccaggctggagtgcagtggcatgatctcggctcactgcaagctccgcctcccgggttcacgccattctcctgcctcagcctccagagtagctgggaatacaggcgccccccaccacgcctggctaattttttgtatttttttagtggagacggggtttcaccgtgttagccaggatggtctcgatctcctgacctcgtgatctgcccttctcggcctcccaaagtgctgggattacaggcgtgagccaccgcgcctggcctgtttattgttaactttcacagagtgagccgctggcttcttctctaattggctttcctaatactatgcctgcctcctccatgaccttaaccttagccttggctaggtgtagtggctcacacctgtaatcctggcactttgggaggccgaggcaggcggattgcttgagtccaggagttcaagaccagctgggtaacaaggcgaaaccccacctctacaaaaaatacaaaaattagccaggtgtggtggtgcacatctgtagccccagctacttggggggctgagatgggaggattgtttgaccccgtcacttacatattttcctaagtgattcagaatcgagtggatgaaaaggcaaagataggctgggcttgtctttcattttacccagctctgacagtgaaatggaaaacaagttgtgtttttaaataaccttagaatgttaaccaaaggtactaattcactaggtatgcccatttctgtagtgagctaattgttgacttacctgttttcttcaagatttcaatgtgttcaagtatcagcactgtcaggaagagaaatttgacaaacgtgttttgagtgcgtactgtatacagagtactgtactgtggaattcagtggggatagacgctgggcaccatggctcgtgcctataatcccagagctttgggagggtgaggaaggaggatcgcttgagcttaggagttggaaaccagcctgggcaacatagcaagactgtctctacataaaatttaaaaattagccaagtgagggctgggtgcggtggcttgcgcttgtaatcgcaacactttgggaggctgaggtgggtggatcacatgaggccaggagttcgagaccagcctggccaacgtggtgaaactctgcctctactaaaaatacaaaaattacccaggcatggtggcgtatgcctgtaatcccagctactcggaaggctgaggcacaagaattgcttgaacccaggaggaggttgcagtggctgatatcgcgccactgcactccagcctgggcaacagagcgagattgtgtctcaaaaaaaaaattatgtatggtggcatggacctatagtctcagctacttgggaggctcaagtgatcttcctgcctcagcctcccaaatggctgggaccactacaggcatgtgccaccaggcttggccaatttttttagtttttgtagagacaaggtctcgctgtgttgcctaggctggtctcctgaacgtctagggtcaagccatcctcctgctttggtctcccactgggattacaggcatgagccaccattcctggccaaaaaagaatttttaaacaggtcttcaagagtgactagcattttgtcagccttgtggagaaaggtcattccagatgatgttaacagtgtagaccatgagatgggaaagtagaagacacatttgagaaattgtcaaaaatcatttctgttgtgaggattttgtatagcaaagaatggtaaagaaggttggatccttatttcagaatgttttgaatgccagggtaggagtttatatttaattcaggaagcaagtcaagtctcaggtcatctctttctttctttttgtgcctgagggtttagtctgcgaatctacttttcattaagagaaatttgcttttctttgggaaagggtttgaaaaatagggagaagggagtgttttcttgataggtgcgctgtggcattgttcagagtagggctctgtgacctgttttactagatgtcatccattctgttgggaaactttccgaagagactggatgacattcaagccaaagatttctctcttgttcataggatgtaggggaaggaccttgactaatgaatcacaaaggctgcagcttatgtttcagtgcattagggccaaattgtacacaaattgaattggactttgaaattctacccagtttcttaagacaaaacatgtaaatatttgtggccctgaaagatgcagttggcccaacagctttgattggaaaggaagcgtaataagctggatctcctttcagcagctaatcaaggtgtcacttaacaatggcctgcggtccttgctgcagcctaatttggtttagatcgagtgccctttgggtcttgtgctgatcagctaacccataagggacctttctgagaccttctcccttcctctattgtcccagcctttgcctccaagggcagagctctgaaatagaagctacttaatgaccagacaataacatttgggcaggtttgagagcagagatgtttatcacatctctttccctcttctgcagctcttgtgtcttgggaaccagtaatgtctttagggtggtaatcctagcactaaataaggttagaatcaggaaaacaagcattttaaacccaatcagtcccccttggaaaaacttcctttttcaaaaacaaaagatctgaagggggctgttaaaattgtaccacatcttacctttcatgctaatgtcgaattaggccattagagggagaaagggagaactgagcatttggccctgagataaagttaaattcaattttcatcgtagaactgcattactgcattccgataaatactgaggtttatgcagcaaagtgatgggaaagccatttctcactaactctgcaatgtgtcattgaaaaaaaaccagtcccaaaagaataaaggctgctcatgttgtaaaggcttttcagaaggcttgctgcttaatctgaagggaaccagcctaaaccacaagtggccacttttctaaataccaaggaaatcacagccattaaactaatcttagggcaagaactatgtcttaattagctttgtatcttggtacctggccctgaccctcacatgtagtaaggtgttagtacctgtttggaagaataagtggatggaactgccaaccctggaaagatgaagaacggatatgactttccgtgggcctgaaagaacactgggttatacccttccctgcagagtcatgactgctttttcccgcatggagcctcatgtacccatgagctgtttattttagtctccactaatcaagagataggaggaatatcacacgggagttatactcagatttggtggggttttttttttttttttgtattctaacaagaaataaaaagaatattgcttattttgtagattttgtttatactttaaaaaattttttttcaggatggatagctcagttattcagggcaaggatgttggtgtgctgtgtgatctcttgttcatatgatgtgtcactgaaatctgtgacttctagaccatgaaggagccctgtaaagagatcaacccaccttaaagacagattgggcctgattcctgtagatttctttgtaaaagaacagagttactgtgttaacctcaggtagactatttcaaaacttgaactaaggtaatggtccagagtgagggaaaagctctcacctaattgtgtatatggattgagaaacctgtgtgaaagtcaaaatgcaggctttgtggtcagtttgttttgtaatattttcacagtaacatccaggagatgagggctcggcacaaagaggcttttttgaagaaacataacctcaaactaggcttcatgtcggcatttgtgaaggcctcagcctttgccttgcaggaacagcctgttgtaaatgcaggtgagttgcttgtggctggaattggagaggtcctgggaggtaggtgtatgagcacagacctgctcccacatgcagaggatcaacagaccaaggctttttatttgctacctatagaaatatcagtatcttccccagggatttcttggttcaccttcctgaagcagcatcatgattactttctacccgccagctgggcagaacagtttctcttcccagtgtacagctcggcagctgctcaggcagcaggcagttctgggatagcccagctctccaggctgtctcctgtcaaggtggaagcacgtgttctggcttcctcccctcccccagctccacaggccctgttaccttggggcctgacttccacagttggtgtaggctcctggctgacctttgatcttaggtcgatgggcctcactgggagcttcggcttggcctctcatggacctggtgcttattttctttcctttttacttacctacgtcattgtagtgttgacctaacaagcactttgttttcctgttgacacacttctctgttccttgggagattggagaggggtcagtgctacttttgccatcctcagcagtgtcaggggccctaaaggtctagaagtagaagccctagtccctcctgttgagtggtgctctagggaggtagaaggccatctttgttttgcccaaatgtatacctcttctttttcccattcttctcatgcctccctgactggctctcatctttttcagtggcccccttctgcttgcccacacatgtaggcggctctcaaaagttctcgtggcctctttttcacattacatgcttcctctggatgtcttatctaacaatacaacatggactttctgcggaaatgattcccaagcctttattttcccattagttgctaggtgtacattttcagatgctggtttgccatctcttgaggtagcatatttcaaagccagatcaccccgcttactcttggatctcccctcttcctcttgttgagagttggaagcagagaatgggtagtatctctatatcccttttcctttgctaatttgcccttttttggaacatttgttaaccctagtcattctctgctaaaggagggcttgactagagctacttaacgagagtttagtgcatacctatcctatggaagccagtgtgttgagcccttcttagggctgccaaagaaatggatgctcctatgcccaggctcagtcagggacttgggagatactatacttgggatgggagtaagtggaatgccagctgccatgcataatgcagtggtgttcatggtggttggtcagcccacactgtatcaagctctgcagatttttactctgttaatgcacatattacctcattagtcttggccttcctggggagttgtatgtaacatgtattttctctctcatagtgattgacgacacaaccaaagaggtggtgtatagggattatattgacatcagtgttgcagtggccaccccacgggtatgttggggcaggaggtggggaatgttggtcttagaccctcaccttatctgtgtgaaggagatcacacaagagaaatcatttctttaattctgtatttttagaagggagttagtaaaagtaaccttttttttcttttaaaccatgccgcattcttttaacactttctgttaatcacactgagtaatgaaggtattctagggagggcataccatgggttgaatcaagggagttgttaactataaaaggtactattaatttgcaactgaaaacagcttttcacccccttcagggtctggtggttccagtcatcaggaatgtggaagctatgaattttgcagatattgaacggaccatcactgaactgggagagaaggtaaagtagaaagatgtatacaagctgctaagcaggcgagggaagagagccttcagaaggctgggctcactagcaagcagtgctcatggaaagtcaagtgcatagcccctgagaaaagcagttgcccatgagagctaagtattttatatatctggtggagtttaccatgctctggtaactgaaatctcatcagatgagacctgctagaaaagatcatctttgaagtcttcaactgtatgaaattgtgccttttctctggtggagcactggtcatagacaccttagccgaacaactgtcacacggaagctagcgcttgtgccatcgatctcgatacaagctttctggacttcctttgcttttttgtttttagaggcagggtctcgctgtgttgcccaggctggagtagagtggtagagtcatagcttactgcagccttgcactcctgggctcaagcgattctcctgcctcagcctcccaagtagctgggactacaggtgtgcaccaccatgcctggctaattcttaagttttttatacagatgggggtctcactatgttgcccaggttggccttgaactcctggcctcaagcagtcctcctgcctcggcctcccaaagcgctgggattatggactgactttaggtgaaggaaactgggttggcttaatatttcaattatgaaatctgtttttaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtaggaaccgtcacttctaaggtcctagtggctaggtctcgatgaaagggaaatccaactaaatgctaattgtaaaacattaactataatttcaggcctaagttccatttcttagtttctaatagctaaggcactgattatcaaattgtggtctggatcagcatcatctgggaccttattagaaatgcatattcttagaccccatcccagacttaaagaagaagtgcagatgatcctgatgcatattcaagtttgagaaccactgagctgaggaggcttgtttgcttctatggagtgggggatatagttggaaacgtggtcccttgcccctgggaaacagatgacaattatgcatgtcagtctgtgagctgccaagttgtatgataaagcttgtaaatttcccgggagttcagagaattaagtattaaaaggggcttgagctggcccttagaagatacgttggtatcaaaaaagctttctgggaactcctgtgtttagaatccttttgggttactgactcctgtgtgaaaccacagtctgtagatcttcctggaaaatgcccatacacccaactacacatacaattccagaatttgtagaccctggcttaattttttttttttttttaaattctaaccccagagagaagcaagtacaggcagccagaactgaagggaaaactttccttgtaggcagcagatgcgttagagggcagagtatgtttttaaaaaataaaaggcagttgtgagaagacagttttcttggcaaactttgtttctgagtggggaagctttgcactgagggtaagtcctggtctttgaaatactgtaaatatgcagaggcaacatcaataggaaaggctctggaattaggaactttcttatgggctgtgctaaatctccttcagcgaggctggctgtggcttgctggagacaaacctatttacctttcctctctgtaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctcccctctctgcacctgtctcatagcctcgaatatcttaattccttaggcttaagagagagagccttaatggatgctcattcatattcctgcctttcttccatcagctctctgcaaagatgattttgcttttccctagtgctggtatactatagagaaacccctggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagtaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccaccatggcccgaactagcgtttcaggttaactttggaatacccttgactgagacgaggggtccatacagatggttggggggcttaggatgttttttgttttgtttccataaagcatcatagtctcttagtgccccaccttccttgagcctgtcaagccatactctagaatagagaatttggggtcaccatctttgtgaagccctttcaaaacaccagtagacttgcattttttgtgtgggcttacattatttcagtgatggatttgggaggagtgggggcatctcatttcatttggatttgatagccttgtggaccaagatgctcaaggtcaatacacatgaacaggtgagggttgatgacctaggagcagtggtcagtgagcgtgagtgtacagggtgggtagctaacctagactgcaggtggcaggtgtgatggagtccaggcttaaacacagccttgtctt

SEQ ID NO: 13476 - DNA, 36720 bp, Human
cggggtttcactattttggtcacgctggtctcgaactcttgacctggtgatccacccacctcagcctcccaaattgctgggattacaggcgtgagccactgcgcccagccagttgcaataccattttcataaaactcaaaaccaaccacaactaaaaaatataccgtttaaatatacatacatatgtgataaaatatatacatgagaaagagaaacaaaattcaaggtagttatttatttattttttgagattcggtctcactccgtagcccaggatggagtgcagtggcacgatctcggctcaccactgcaacctctgtctcctgtaaccaccatctcccaggctcaaatgatcctcccacctcagcctcccgagtagctgggactacaggtgtgcaccaccatgcccggctaattttcaccatgtttcccaggctggtctccaactcttgtgcttaagcaatcctcttgcttttgtctcccaaagtgttgggatttcaggcgtgagccaccgtgcccaaccagtagctgtgattaaagtagggtacagtcaaaggaataggtcagaggaggaaatcgcagattgatgtgaaggcgttggtaatgttctggttcctacacaggtgaaaggtgtacaggtgtttaactgctatgctttttatctcacacatcgcataaatttttctgtgacataaaatattacataacatttaaaaaacaggtcaagagggcagggtgcagtggctcacgtctgtaatcccaacactttgggaggccgaggggagcggatcacctgaggttagcagttcgagaccagcctggccaacatggtgaaaccctgtctctactaaaaatacaaacaaaacaaaacaaaacaaaatccggttggagtggtgcatgcctgtaatcccagctactcgggaggctgaggcaggagaatcgcttgaactcgggaggcggaagttgcagtgaaccgagaccgcgccactgaactccggcctgggcaacaagagcgaaactccgtctcaaaacaaaaaacaaacaaatccaaacaaacaaacaaacaaacaaaaacaggtcaaggatcagaaaagtaaagtgagttgacactccatttacacacagaaagcccaatgtttttctattatatcaggatacctcttctaaagaatgatagcttacctttcaatcagagaaatgatctaaagttcaaaatgttactccatagctagctcctggaggaaggaagctaggtggcagcgtgtacacaaaaaggcaattcatccaaataataatataacaagaatataacaagtaggtattttctgctaagtgctatgtagcacaggggtgaatgcgtggcagggcaggaggagggctgtttacaagagggtatgaaatgcagctcttcttttcaagagtggttgcagaatgccagggctacaaagagagggccgcacattaagcatcgtattatgtgggtacagagtattagggttctcgatgaccagaaggagaatgagtgcagtttgtttcctagcaagccttctttagcttctcttcccaagtgggagtggggttggggttgggactgttctttcctagctcaaaagttcacttatgtcacactagggtcagtttaaaggagagtgctagtaagggtaaagtcaagttacataacctagcggaaaatgaagacctaaaaccgctcgtgagcaaacacaacactttagacgtaaacctcttccaaagaagggtggatctcagcactctgggtgaaagcaatctcagccagtaaaacatcagaacgctttcacgcacgcgcagtaagcacacgaccggtggcaagagcccggataaaggcggagctaaaggtgccggataatgcatcacggagcgcgtgtgcgcacgccgtagggggcgggccgttcgggcttggtttcctgggcgaccaccgctggctagtccgttagaggcgtgcgggcttcggaggcgtgcgggcttcgggtgccatggggactcctcccggcctgcagaccgactgcgaggcgctgctcagccgcttccaggagacggacagtgtacgcttcgaggacttcacggagctctggagaaacatgaagttcgggactatcttctggtgggtgtttcttgtccaccacccgcctctccctgcccgcaggtggtgtagaaagttgcctccttcccggcgatattgcacttgtgaagggctgagaagagcggcagtcaccgaaggttgcctccatgactcctggaccttcccctgtgctcaggcaacgcgctttccctgctctatttcattgtgccctgatggttgttgcggcctcctcccaaatatgcgtctctgcctggcctcccttctaaactcctctctcccatctccaccctgagccaggccactatcatttgcccttccccagtcttgttctaggacctgatgtttaaaaacacacaagcaaagacaaaacccttcaagattgaattaatttttcctccaacaaccaaagttgtctttttttttttttttttttttttttttgagacggagtctccttttgtcgcccaggctggagtgcaatggcgcgttcgcggctcagtgcaacccttcgcctctcaggttcaagtgattctcttgcctcaacctccggagtagctgggattacaggtgcccggcaccacgcccggttaattttttgtatttttagtagagacggggttttactatgttggccagactggcctcgaactcctgatctcgtgacccgcccgcctcggcctcccaaagcgctaggattacaggagtgagccaccgcgcccggcccaaaagttgtttttcaaaagtgcaaatttgattatgtcactccccgacttattactctgtagtggtgcccattgcctttgggataacgcttgaattctctgacttgccaagaccattcctcactggcctttgcctatctctccagcttcgcctgccagtcccctccatgcactcactttcttgctccagcagctgctttttttttttttttttttctttgggccctctacaggcttttcctaatcctggagtttccaccgcaactctcttgttttgtccaccttattcttcactcagggttaagctcaaatgacatcctcgggggaagtcttttttgctcttctagactgagtacgctgttcatgttttttccccgcatagcaccctgtttttattttatgtcaccgctttccacattttgttgtaatggtatagttgaaaaggcagtgtgggattgttaagggcataggttatggaacccaattggctgcatttgattgcagggtccgctatgacttggggcaagttacttgagtttccatatctgtaaaatagaggcaatgataaacctcatagtagttgtgaagattaaatgagctgatatatcagaaatacattctaagtgctcaataaatgttcattattattatttttttttcttgagacatagtcttgctctgtcacccaggctggagtgtaatggtgcgatctcctatcactgcaacctccacctcccgggttcaagagattctcctgcctcagcctcccgagtagctgggactacggcttgtgccaccaagcctggctaatttttgtatttttagtagagacgggatttcaccatgttggccaggctggtcaaatgttcattattactaccgttttaaaattttcctttgactagactgacctctgtgaggacagtgactggatgaatctatttttattaccatagtacatataatattaaaaaggcgaaataactgattttctgaatgagttaaaccttatgattaaaactttttctgaacaaaatgtaaaaactcattttctctctgtcagtgtaagcaaattacctttgtagttttttaaattgcaaggaatggaggatgaagagctgtttgttgtacagttaataaaaggagagagacttttttttttaaatggctactacatgccatttatttatagctttatttattgcgtaagacagttataaaaagcaggtataattatccttgttttatagatgaggaaattaaggcttaaagaggttaagtaatttctccaccattacaaagatagtggattgtagagcagatgttggaaactatgtatctgcctgtttctaaaatccgttaatattccactgtaccacttcttggggggaaaaatgcatttaaggaaaaagctaaaaatgtaacatttacattttctagtagggagaacctaaaatgataaaagaagcaggaatcactagagtggtggattttcttgagaaattactttggttaccgtaactagagtaggcattttgtattcttttcctatatttattatttgaagacccaaaatgtcctcctactacccccttcccttccacccctgcattgtaatcagatataatagagcccgtgtttatggctgcagggcaaatgtctttattgtttgttgctggttttaaagtaaaagttctacatatttatatttgtatagcgtattagtcactcgcatcaacactttgagacatttattttagctaatgttttatttaaaatctggcattttttatctactaatttcaggtcttacatagaaacctataatatgcacaaatgtggcttcattgttttatccaaagtggtaagaagactgttacattgacttttttaaggccttgttttttaaaattttttgttaacttagcacagcagaacagtttcagatagtttattcattatgctgtttatatccacagaaaatatatgtgaacctcgaaaatttgagacacgtctcagttaatttagaaaggttattttgccaaggttgaggacgcacccgtgacacagcctcaggaagtcgtgttgacatgcgcccaaggtggtcagggcacagcttggttttgtacatttagggagacatgagacatcaatcaatatatgcaagaagtacgttggttcgttctggaaaggcgggacaacttgaagcaaaggcaggaagactggaagtggggagggagctttcaggtcacagattggtgatacacaaatgcttgcgttcttttgagtttctgattagcttttccaaaggaggcaaatcagatatgcatctatctcagtgagccgagaagtcactttgaatagaatgggagaggtttgccctaagcagtttccagcttgagttttccttagtgatcttgggtgcccaagatactttcctttcatgtacatttcctatgttatttcattgattgattgccaacaaagccttgttgctctcttggatgtttggacaaagcttttggttgtatgctggagtatgctcttctcccttcctcctcctttcttctgatgagcttgcagtgctctggacaattaggagtgcgggttactttgtgctgtttctctatctttttcgcctcggcttcgcaaggacagaggagatttagtgcaaatccctgagagtattggagaaaatgttcgttaggtaaaaagtaaagtagaggttctgcttcaaagagtttcctccccatctaattaagactaaatagtaacttatcttagaagcaaaatttattcaaagacctatgctaacattcttaaatatctgctagctgtaataaagaaatcagtgtattttatgttcttagctcccacaatttagcctaaatatttgccctggcgtgcttatactggtccaagcaagcattaagtcatagcctgttcttcttccttatttaaaagtgtttttacctttctcagcattccacaagttacttcaagttctaagttgctagtcaatgaagacagatacagaatgtgaagtcccgttccagccaatagaaaccggacacagcagtaaagtagatgtgtcaagttataaatgaccctgtctcctttgttcagtgtagcaaaactgctggcgactgtacccttttgtgcagaaagtaaaaaaatggccttgctgaagaaataaaatttacgttcaagtgatacttctttatagcaccaaagaacaagcatttttggcaattgtatattaaaatgcacatagttctgtaacataaccatgattattttaacattatgggttttaaatatttaaccaatagtaatttgaaaccccttccttcttgctcttcaatttggcaagtaaagttgatgcttttggaagctgcgtcatgtttacctagtagttgcctttgccttggtgtaaaattatctctttgtgcttgaatcatgaaagaatcaggtatggaatcctcatcaaattataactaccgtttaaacaagtatatacttttggcttttgttcattacttattcacttaatgagtcgtaatatattttctctctgtttattagtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaaggtaatacttagtgagttatttttccttagcagaaatgtaaaacaagtaccatgtttttataataaatattatatgattaaatatgatttaaataaaatgccagtattttaaaattataatatgtttgtgaaaaaatatttacatttagtacaacttttttttcttcctggttgcagatcagagttgccctgaaggattgggatgaagttttaaaatttcagcaagatttagtaaatgcacagcattttgatgcagcttatatttttaggaagctacgactagacagagcatttcactttacagcaatgcccaaattggtatgttgcctaaaataatttggttttttcaaaatgagcaattatactttattgtccataaaacctctcaatctccagaaaatggaataagtattgatagtgttcaagacttttagctttttttttttttagacagagtcttgctctgtcgcccaggctggagtgcagtggcaccatctcggctgactgcaacctccgcctcccgggttcgagggattttcctgcctcagccttctgagtagctgggactacaggcatgcgccaccacaccaagctaatttttgtatttttagtagagacaaggtttcaccatgttgtccaggatggtcttgatctcttgacctcgtgatccactcaccttggcctaccaaagtgttgggattacaggcgtgagccactgcgcccggcctggcttgtaactttttttgtgtgtgtgtgcctttttgatacagagtcttgccctgtcgcccaggctggagtacagtggtgctatctcagctcactgcaacctccgcctccagggttcaggcaattctcctgtctcagtctcctgagtagctgggactacaggcgccctccaccacgcctagctaatttttgtatttttagtagagatggggtttcaccatattggtcaggctggtcttgaactcctgacctcaggtgatccacccgcctcagcctcccaaagtgctgctcacctcaggtgagccaccatgcccggccttgtagcttttttaaaataggagaaggtattttctaattactacttttttttctgcaagcaaaaatttagcctttgctttttaaatgcagtgtatctgggtgccacatattaagcgaactgttttgagaacaaattagatttggcatctgcatttgctcatgtctcaaacatcagaggaggttactgaaagacgtacaaaattgttaaaaattctttggtgaaaagttgaaacttctaatagcatttgtttttttttaatctagtggtaattgagacactaggttgaagagcactagttctggttctgccattagctggcaaattatgtaatttctgtcttatctgaatttgtaggcatgtggcatggcatgtgagaggatacttcacaagtctaacagtctttggaacgtggatatttaacagatgtacccttacagctggttttgttttatctgtgtttacttatagacaatttttagtgctggcttatatttcaatacttttaacaatactgtttaaaagatactcatttaaaaagacacgtattatcacatagctgtcatataggatgaagaaaaaaattcaccgagctgaagttacagaagaatttaaggacccaagtgatcgtgtgatgaaacttatcacttctgatgtattagaggtaaattttcttttatgctcttgaaaatttttaaaaattgttttattgccaactacatattgaggttataccttcatctactggatactgatttttctaatgattttaaccactctaggatgctatttctctagagtatcagacataaaatagcctaaatatatcaaggcttacaaatcttgaaatagcgtgagaaaaaaagatgtagaagactggacctggactgaagatgtgtggattctgttactaaaactattgtttgtatttgactttagttaggtcataaaacaagagtttaaagtgactttacttacttttttaaaaaaacaatatacatgaccaggcatggtggctcacacctgtaatctcagcactttgggaggccgaggtgggtggatcacgaagtcaggagtttgagactagcctggccaatatggtgaaatcccgtctctactaaaaatacaaaagttagctgggcatggtggcgcacgtctgtggtcccagctactggggaggctgaggctggagaatcacaaaccccagaggtagaggttgcagtgagctgagatcgcaccgctgcactccagcctgggcaacagagcaagattccgttttgaaaaacaaaaaaaccaatgtgcatttatttcctgaggttttttttttttttttttttctcacacggagtcttgctctgtcacccaggctggagtgcagtggtgcaatctcagctcattgtaacctccgcctcccaggttcaagcaattctcctgcctcagcctcccgagtagctgggaccacaggcgtgtgccaccatgcccggctgattttttgtatttttggtagaaacagggttttgccgtgttagccaggatggtctcgatctcctgacctggtgatctgcccacctccgtctcccaaagtgctgggattacaggcgtgagccactgcacccagcctacttcctgagttttaacatttattttaaaacctaccattgaaaacagtgagtctattttgataatatattttcgtattttgtttgagtgtacagtattgggaaaaatcttatgcatggataagtagtgttacaaatctttttaagcatgagtagaaaagcattgctttgaggttgaaacaaaatctcagtacagggttacagtattccaaatcaatgatatttcaaaagaacatatagagaggagacgagagggtaaggggacactttggtcgtgcttttaaattttctttaagcctaaatgtctccctcattactattaggattataatattttatttcattcggttgttctgcaaattgaaatgaggtgatgcctaaatagtgctgagtgtggtatattacacacagtatatacccttaataaatgttaattccctttttctccagccctactcagtcttttcttgtattacaattgaaagacagggatcagatcttagatttactcaaatgtttgtttagatgcccccatgttctttttttttttttttttcttgtccctgacacaggatcttcctctgtcacccaggctggaatgtagtggcacgatcttggcttgcagcaacctctgcctcctagtttcaagtgattcttgtgtctcaacccactgagtagctgggattacagttgtgcaccaccatgcccaactaattttttctatttttaatagaggtgaggtttcactgtgttgaccaggttggtcttgaactcctggcctcaagcgatctgcctgcattggcctcctaaagtggtgagtttacaggtgtgagccactgtgcccggtcgcccccacgttgcaataacatcagcctgtcaggttgtttgtaattcaggtagcaaattgatttttgggagcactctgggtctgttctgtaaagtaactttatttttgagcaaggatccttaatctctggcctggagatggtccatgtccctctcccccaccacattgtatgaaaaattgatgtcatacatatggatcctttttttttgagatagattctctcactctgtagcccaagttggagtgcagtggcgcaattttggctcactgcaacctgcaacctctgcctccagggctcaagtgatactcatgcctcagcctctcgagtagctgggactacaggtacgcaccaccacactcggctaattttttgtattttagtagagatggggtttcaccatgttgcccagggtggtctcaaactcctgagctcaggcgatccgcccgcctcagcctcccaaagtactgcaattacagacatgagccaccccacccagctcatatggatacatttttagggtgaggtactgtaattatcctcagattctcaaaggtgttcatgtcccccaaaaaggttaagaattactgtattacaaggaactgaatattcctcaatatctgaagacatagtataatgcaggaactctgggaaaatattttgtgtagattgttttacttctacaacatttctgcaaaataagtgtttttaaacatttttaattattatttttaaaaataggggtttttatccgtgatttaaagttgaggaaactgagttacagagactaggttaggaagtaatggagctaagcttcatactcagttttgtatggctgtggtgcctgtttgttggacagcaaaggactggtctgaggtgggactggggttagaaatttgtcattcaacaaacaaatgaagtgtaacaagaactaggatttttttttccctctagcagcttagtgagaaagaggtaggagagagtttatgtagaaaactaaataagataaaagtactttgtgtaatagaaggaatttgtattttgtctttttggcagaggggagtcgtaaagttttagagattggagagacataatgtttatgtttggagttgaggtaaggagctagttagagggaatggttgtatataggagaggtagcgagcaaggttcctgctatggaggaggtgggtgtgtctgcgattgagagtccatggagggagtagccttgagcagaaggcatactttttcctttgaaacttgaggaaagaaggtgagaatggatttttataaatctttgtgtagaggagaaatagaaggcaaacagacctgattgcctgaactttaagagagcatcatggggatcagggaactgagagttgaaaatgtttggaatagcggttgtggagaatggaagaaagatttcgggataccagaaagttgagaaatgctgatgtgaatcatgaagagagaggcataggacattttcaaacagcaagacattattcttatcaatattctaatgaaaaaagatgatctgaacccagttggttacaatttctttttttttaatttttgagacaggatcttgcttcatcaccgtggctggagcgcagtggggtgatcgtagctcactgcaccctcagtctcctgggcttaagtgatcctcccacctcagcctcctgagtagctaggccctcaccaccatgctggctaatttttttttccgagacggtgtcttgctctgtgtcccaggctggagtgcagtggtatgatcttggctcactgcaactgccacccgggttcaagcgattctcctgccttagcctcctgaatacctgggattacaggcacgtgccaccacgctgggctaatctttgtatttttagcagaggcagggtttcggcatcttggccaggctggtcttgaactcctgaccttgtgatccacccaccttggcctcccaaagtgctgggattataggcgtgaatcactacgcctggcccatgctggctaattttaaaacatttcttgtagagacaaggtcttgctatgttgcccaggcaggtcttgaactcctgagcttgggtgatcttcctaccttggcctcccacagtgctgggattataggcatgagccaccatggttgtccggttttaatttttctgactgttgaccaatttggtggtagaatgtaaatattttttcaacatatctttttcaacatgctttttcattctaagctcttttaagttggggttgatgaacaaaggtctactcttttagagtgaatagagaagagtatcagaagggtcaagctatgaaatgcctatacctggaagcttttaggaatggaatagtctgtgaagttatcctggctctgtcggatctctggcttgtgacataattgctttgagagccttgtcccttgatacttctgctggctctatatcttttgtcctagcatagcctgtaatccattctcactgataattcttaaatttaatacttttaaattttccttctactgcctgcaactgctattaagtcttcatttcagaagatctgaattctggtcatgattctgccacttgttctagttttgtggttaagaggcataataaaatgaaaagagaacaggatactgaatcaaaacatttgacttctaattctagcccgctgctatgtaagtaggaccttgagcaaattatttcatttctgtttcttcatttatacagttataataatggacatcgtgtgctgagtactcaccatatacctggaactatgctagatgttttatgtatgttatctcactaattatcatagtaaccctgcagagaaggtggtatttccttagtttttttttttttttttttttttgagatggagtctccctctgtcgcccaggctggagtgcgatcttggctcactgcaagctctgcttcctgggttcatgccattctcctgcctcggcctgctgagtagatgggaccacaggcgcctgccaccatgcccagctaattttttgtatttttttagtagagacaaggtttcaccgtgttagtcaggatggtcttgatctcctgacctcatgatccgcccgcctcggcctcccaaagtgctgggattgcaggcgcgggccaccatgcctggccttttttttttttttattttttaaggcagagtttcccttttattgcccaggctggaatgcagtggcacgatctcggctcactgcagcctccacctccccacctcccaggttcaagcgattctccttcctccgcctcccgagtagctcggacaacaggcacccgccaccatgcctggctaattttttgtatttttagtagaaatggggtttcaccatgttggccagggtggtctcgaactcctgacctcaggtgatccgcctacctcggccttccaaagtgctgggattacaggcatgagccatcgtgcacggcccccagttttaaaaataaggaaactgaggtttagagaagttaagtagtttgtataaggtgaggcacaataaggtacagacactatgtttgaatgtccaagtctataaggctccaaagtccatgcactgtcttttatttcttatttaattttcttcttcttttttttttttttttttaaaggtgggggtcttgctgtgttgcctgagttggccttgaattcctgggctcaagccatcctcatgcctcaggcttctgagtagctgggactacaggtgcacactactgtgcctggcttctttaatcttctatagtgctttacattctactgaatactttcacctgtataagcttgtttaatacttaacaatggtgggtttgttcattttgtacaaatgcgaaacatgaacatgattcttaggttgagggacttccccgttgtcatccattgagcaaatgacagagctcagactcaaaaattagatctgactggtggtctttctctatcacatgaagtaaaaataatgagagtatagccaatgtaaactgtaaagagttaggggctctccatgtctggacactgttctcccattgcagatcctgcatatatgagcactcactcaccactattgatcagtttctcattttttttttttttttttttttttttttttgagaggcagagtttcactcttgttgcgcaggctggagtgcaatggtgcgatcctggcttaccgcaacctctgcctcccaggttccagtgattctcctgcctcagcctcccgagtagctgggattacaagcatgtgccaccacacccggctaactttgtatttttagtagagacggggtttctccatgttggtctggctggtctcgaactccagacctcaggtgatctgcccaccttggcctccaagagtgctgggattacaggagtcagccactgtgcctggcctagtttctcatttcttgaacaggtgttgattctaccaaaatctggaaatgaattgagtggtctgagttagggatgactcagatgttgcaatgtccatctgtgatggaagtgtcagtagttctctcttgatcttagagccaagtccctatgccaggttttcttaagtccactctgtggtatgctgtctttttccttaccccacagatctgcccatttggctggagatttttggaggaagaagatctaataaataatgccacaaatggtgtcataaatcaccctctatttctttcttttttttttttcttgagatggagtcttgctctgttacccctgctggagtgcggtggtggttcaatcttggctcactgcaacctccgcctcccgggttcaagcaattctcctacctcagcctcccaggtagctgggattacaggcgcccacccccatacccggctaatttttgtatttttagtagagacggggtttcaccatgttggccagtctggtcttgaactcctgatctggtgattctcccaccttggcctcccaaagtgctgggattataggtgtgagccaccacacctggcctaccctctatatctttaatcctgaatgttatcgctgaagcaatggggaagcttatgggaacaggcacatacgttttgggatttctgtggcaggttggatgagagtcgttacataggaatttccagcagagcataaaggactatgtaaatattcttgatgtgacaatatgatataaaaatatcttagttatcagtagtgatatttaatgatatgtcatgctacaaataattgtgatattctagaatggaattttatgttaactgatttgtctttccccaatgtcttccccataagtgtatcttatatcttagttaatgtttgttgaggtaagtcagtaaatccatacctctggaatccacacctctatgttaatgaagttgtactattttgcttacatgattatgttatttttaatatactatagcatgttattacctatcaactggaagtcactttggaaggtgactattttgtgttggttttgccttttagtttctcctcaaaaagtgaagaaataaaggactcatctttttgcttttaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaaggtatgcaatcacttgtttggtgcctcaccattgtattttacacgaatgtttatccgtggatgataatgttgggaggcagcctagttttagaggctgtaatcctgtggagctaagatttatagggcttggcttttctagttccacttttgccacttattaggtatgtgatgttatttaacctgataaatggagtatatatgtattttcttttttttttggtagaagagtaaataatcttgttatacctcagatttattacagactttataatttggcattttttaggggttgcacactcagtctttgggctaaatcctgcacacagatgtgttttgtttggcatagtgttgattctaacactgtttaaaatttttgagttaattaccaaatttaagtatttgtgaacttcacctaaaattctagacatacaacttctcttaaaattcagaaggtctggtaacactgattccactttgctgcatgacagcagacagtgggacctgagtgggggcttttcctactgtgatagggcaggtgtttctctgtttacacattgtctacctggtatggtttatctttttgcaagtctcatcaacacagatcttcaacttagtttatttaaccaaaagtattgatgctagagctacccatatttcacattagccttttccagctagagaaactttttttaccctggaaacctaaaggctagccttgtgaaatttacttttgaaactattactccatcttattttagtaaatctaggaaaaaaaatttttttaaagtaagcaatttctgattacttactatgtgtcttgataatgtgttggtgttttcacaaatgccacacagatactgttatctatatattgtccttcagaaagatttcttgctactttttcactttctgttatataaaggaagctggctcaaaacttaattttagaaaagataaacaaggaaactgataagatgatagtctcgggaagaagaaaataactttattcctctgcatttattttaatgagagatagcaagttctagaatgtttggatactttaagtcctacaaataggttacacaaatgacttaggcatttaatgtaaaaatttgttagtattctttatgtatatgtatatagacagggtcttcttgctctgtcaccctggctggaatgcagtggcatgactgcagctcactgcagcctcaacctcccaggcttaagtgatccacccacctcagccttcagtgtaactgggtttgcagacacgtgccaccatgcccaactaattttttttgttttttgtagagacagggtcttgctatgttgccagggatagaaccagtttagttttaattttttttttttttttagagatggggtcttgctatgttgcccaggctggtttggaactcctggcctcaagcgatcctcccacctcagcctcccaaagtattaggattacaggattagccaccatgcatagctagtatgctcttttaatagataaactctcttcaaagagcattactccaagctctgaaaacctgaaggaaaggagaataagcccattttcttactaccacataaagactaccacatgagttaggaggatttaagcattttgttgatgaattgtagaacattttgatgtaatctgatgtaatcttaatgttaggtggtatataatgtgaatgatcttttagtttttcatttattaaaaatgatttctcaccattctaaaattgatttgcagttaattgaattgtaaatttgtatgtgtgtatgtgtgtatgtatcttttttgctcttttagaatccatccttaaagtcaaaaactaatgatggagaagaaaaaatggaaggaaattcacaagaaacggaggtcagaaaactttgcaattcatattatgtgtggctgtgattctgtatactgagcattgtgacccatggtcagtattataagacatataagagaaaattctgaatcatgcttctgtgaaaaggtagtttgttctttactggaagccttgtggaggccacatcaggtgtagattgggagagaggatgataataattttccgcagggaaaggaaagcttgactatggaaagtgccctcagttcgtagaggatcaggatcaggcttttgtaatatatcttttctcacttgtcagcctttcaaccagtgtagagcccaagctattatactatatactgcttcctgcctccagagttttcatccatcttagtggatgagacaaggagccatctttgagtataggcagatgaggagggaatggcagttcagggctctgcctgatcacccaggctttcattcatactgtcctccttgaatcctgaatgaaaatgatctctaactatggggatggtgttatggcacctgctacatctgtgagagaatatgatgtatgtttatgtgtgtgtactcaatgtatacccaatgtatgttagtttcttttaccctacattgtgtctgaaatcttatttctgataataaatacttgggtattcagtttttcacctaatgtttgtgtgttttaacttttttttccttcttattttacatccagagatgtgaaagggcagaatcattagcgaaaataaaatcaaaggccttttcagttgtcatacaggtaagttattctttaataaggtaatttggaaattgactgctttttaaattatatttcaatttttcatcaaagtagtaatacatgtacttagttttaaaagtcaaataatgctagagagattatatagcacaacagtccccttctctgccacttcccacccttgtattcctaaccttcagagacagcatctttcacttcttctcttttagcagtttcttctaatatttacctggaattttgatgccatttcctttattgtcttccagcttctagtattcctgattttggaaggttttaggttttgctttgtccctggagttctgaaatttcatttaatacatataatgtaacttggtgtacatcttttttgtttattgcccttggcactcatggtgacctcctttcaatctgatatccttcagttctgaagaagtttctgtattgtttctttgatacaaatattctttcctgcatcttttctcttcttcagcttttcttatttttctcttctatttccagtctctgtctcattttctgttttcagggagatttcttaggcttttatcttctgaaccattatattgatttaaaaaaatttcccctgatattttttcattaccagtaattttttttgttctctgaatgtttgttttatttttttaaatgtatttttctttttcacaggatgcaataactttttctctttaaggatattaactacagtttttttttgatggttcctcccatttcctttgagttcttttttttctatttgtttgaactctttcactttgttggttttttttttttttttttgagacagagttttgctcttgttgcccaggctggagtgcaatggtgcaattttggctcactgcaacctccgcttcccaggttcaagtgattctcctgcctcagcctctcgagtagctgggattacaggcatgcatcaccacgcatggctaattttgtatttttagtagagttgggggtttctccatgttcaccaggctggtcttgaactcccgatctcaggtgatccacctgccttggcctcccaaagtgctgggattacaggcgtgagccagtgcacctggcccattttgttggctttttaaaaatgattgaagatcctcagatgtcttttcatatttaagggtagtcaagaggagatcaggagcttatctaacctctagatttctttgtcttggagctagttatttagagagcaatctttcactcccttgtctaggggaggagggtgggaaataagcccagctgccaatgttttgggagcctacagagagaatcagccacgaggctcaccattccttatgcaggtttcactcagcccctctattttcaataagaggcctcatctccttcctcacctacaccagtttcctttgagcccacatcctttctcgtttagcctcttcagagagcaggccttctgttttgtacaggagatcagttgcctagctctgaggttgaggaatgagacactattctctatagattttcaatgcacctgcctgttttttcagtcccacctcagccttccaaagtgctaggattacagatgtgagccactgtgcccagccctttgcccgttttttaacggggtggttttttgtttgttgaattaattttcttatagattatgaatattagacctttatcgaatgcaaagtttgtgactattttctctcattctgtagggttgtctgtttactctgttgtttcttttgttgtacagaagctctgtagtttaattaggtctcacttttcaatttttgttgtcaactttgtcaaccatcaggtggtcgtaggtgtgtggctttatttctgagttctctgtcctgttccattggtctatgtgtctgtttttgtaccagtaccattctgttttggttactgtagtgtgtctgtggtttctgcatccatggattgaaccaattgtggattgaaaatatttgaaaaaaaaaatgcatctgtaccaaatatgtgtggacttttttccttgccattattccttgaataatatgacaatcatttacatagtattaggtattataagtaatctagagatgattgaaagtatatgggaggaagtgcataggttatatgcaaatactacacaattttatatcaggaatttgagcttctctggattttggtatacgaaggaagtcctggaactaatcctccatggatactgagagacagctatacgtggttgctttttaagaattgttggccgggtgcggtggctcatgcctgtaatcccagcactttgggaggccgaggtgggcggatcatgaggtcaggagatcgaaaccatcctggctaacacggtgaaacgctatctctactaaaaatacaaaaaattagccgggcgtggtggtgggcgccagtagtcccagctactcgggaggctaaggcaggagaatggcgtgaaccccgggaggtagaggttgcagcgagctgaggtcgtgccactgcactccagcctgggtgacaaagcaagactccatctccaaaaaaaaaaaaaaaaaaaggacagaaaaaagaattgttaatacctgtattgcatatacagcattaactgaaaattctttgcttaagcaagtaagggaattcacctactgatgtaacaaaacaaatccttagccaggattggctaaagatatctgtgtcgcagacaaagctatcattaagactggccctccattttcactgccgtcaagtgctgttttcctgacagctccagccttgcatgttcccagctttagcttccaaggcaagaaagaatttttccttcttaatagttagacaattccaaaatagcatttcattagccatgatacataccacataccccgcctgcttgcctccccactcccaacaaattaccctggccatggggatgttaaactcattgtggccagatctgggccacatggccaaacctggagccaagcgtgaagtacttctacttggaatgcgtggtagtgcctaagggaaataaatttattagaagatgcctctacacctttgttgcctaaccatgccagataatagaacaacttcattttaagcccatgtgagtagatgatgatgacagctgcaggaaacttcatgttataaaaataagagactatttacatgacacaggtagttatagtaagccagccaggggtaatagtaaagtactttatgacagatatttctgtaaatctttcctcatctttgattgtacattttgtcttcctctcaattttatcatttggattcattttataatttattggttaattggattgtaactcttaaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggtaactttttaaagtcttactaagattcaacaaaggagaatgggttttatttacaactttgcctcatgtttatttccttgttaagaaggattagatacttgtttgagaacatttttgtgagatttaatattaaaaataaattctgttagattcttggaatcttattgcttgaaagggatcctaggaatcatatcaaatgtatcgttttatagatgatgaaattttggcctggccgggtgctatggctcatgcctgtaatcccagcactttgagaggcctaggtgggcggatcacttgaggtcaggagttcaagtccagcctggccaacatggtgaaaccctgtttctactaaaaatataaaagtcgggcatggtagcgcatgcctgtaatcccagctacttgggaggctgaggcacgagaattgcttgaacctggaaggcagaggttgcagtgagctgagatcatgtcacttcactccagcataggtgacagagcaagactctcaaaacaaacaaacaaaaaaagaaatttaggcctatacagattaaataacttgtctaaagtgatatatcaattaatagctagatagttatgaaatcagtctagaattttccagtgcattttttttttttttttttttttgagagggagttttgctgttgttgcccaggccggagtgcaatggcacgatcttggctcactgcaacctccgcctcccaggtccaagcaattctcctgcctcagcctcctgagtagctgggactacaggcacctgccaccatacccagctaatttttttttgtatttttttttagtagagatggggtttcaccatgttggccaggccggtcttggactcctgacctcaggtgatccacctgccttggcttcccaaagtgctgagattacaggtatgagccaccgcacgcggcctccagtgcatattttagtagtaatttttgtgtgcgaatcaaacttatttgtagaatgagatataaataatgcattctataaaccatgtttctttttagctgtattaagatgtcctttttctttgacacggtgtatctgtaaaattacctttcttcttaaggaaattactttcgtatatatttcaatagtttggtttggttttttttttttttttttttttcttgagacaaagtcttgctgtgttgcccaggctgaagtgcagtggcgcgatctcggctcactgcaacctctgcctcccgggttcaagtgattctcctgtctgagcctcccaagtagctgggactacaggcgcccaccaccatgcctgggtaatttgtttttgtatttttagtagagacggggtttcactatgttggccaggctggtcttgaactcctgacttcgtgattcgcccgccttgacctcccaaagtgctgggattacgggcgtgagccaccgcacctggcaatagtttggttttttaaaaattgtctgaataatgtatatgcaccctacataaatttggaatttgattaacaggtttacttaaggtgagaaaaaaaggagcgttagaaacagtaaatatttaatgactaataatgaaattcactctcaactactgcaggtatatatgaagataagttaacagccttttagcattttttcccctatattgaagcagtggagggagaactgaagttaaatacctttaatatgtcccagatatgattaagtcgtgtaacagtagcttgaagtgcactgagaattcagaggagataccatatttgttaagtatgatcaagaaatagttcaaaaggagatttttctacttcctttcacaatgctaaaggatattgtgaagaaaattgttagactaaactcacttatgagtattactgaaaaaatcctaagtcacatgtatcaaaaataatcctagacacaaaaataccttgactgagtacacttatttcaggatgcattcagaatctattaatatgatttaccacatcaataggttaaaggggaaaatgtgaatttattttaatagttaccaaagaagacatttgataatatccaccatccattcttgatttaaaaaaaaaaaatcctctagatcaaggagtcagcaaacagtttctgtaaagggccaggtagtaaatagtttaggttttgtgagccgtgtttctgtcacaactactcagctctaccatcgtaatgtgaaagtagctatagataataccaacacacactagtgtggttgtagtccagtaaaactgtataaaagcaggtggttggtcacatttggtccaggggccatagtttgttaactcctgccctaggtaaaatagaagattatttctttaatctttaaagtgtgtgtgtgcacttgtgtattagattacaaagtgcctcatgttcaatggtaatatgcaagaagtatcacagttttatttaacgttgctcttaaagagctagtcagtgtaattagataagagagtgaagggagatatgacatcagaaagagagactagaaaattatcatgatatgtgaatgattttatgcctaaaaaaattctaaagagaatttgctgaaaaataattaagaacaaaaatttagggaggtaagggtgaccactgtaaaccttacaaagattaaaaggtgaccaaggcaaaattataaataattttatgccagtaagttaggtagcttaaataaaatgaataaatttattaagagacacaagtttccaggccgggcgcggtggcccatgcttgtaatcacagcactttgggaggctgaggcaggtgggtcacctgaggttgggagttcaagaccagcctggccaacatggagaaaccccgtctctactgaaaatacaaaactagctgggcttggtggcacatgcatgtaatcccagctacttgggagactgaggcagaattgcttgaacccgggaggcggaggttgcggtgagccaagatcgcgccaagatggagcctttgcgctccaacctgggcaacaagagcgaaattctgtctcaaaaaaaaaagagagagacacaagtttccaaaactgatggaggaaatctgaatagtctaatgtctactgagaccccagaatatctgagacaggtctcagttgatttagaaagtttattttgcctgggttaaggatgtgcctgtgatacaacctcaggaagtcctgagacatgtgcccagtgtggtcgggatacagtttgcttttatacattttagggagacatgacacatcatcaatatgtgtaagtcgtacattggtttggtctggtaaggcaacaagtgggggcttccaggttagaagtaggtaagacaaaaagttggattttttgagtctttgatggccttccacctaatacaaataatacgcaatttactctggctcaatgaatctgcattttcacataagcaataggggagaggaagcaatcagatatgcatttgtcttaggtgagcctcagagggatcactttgaatagaatgggaggctggtttgccctaagcagttccagcttgacttttccctttagcttagtgattttggggtccgaagatttattttcctctcacactgctaaagaaattaaattcccaggcttctctggaaattttagcaaacatttaagaaaggagtgatctagattctttcagaaaatgcaagagggaacactttgcagcttactgacattgcaagaaagaactaaagaccaatatcccttatcttatccaaaaaaaaattcaaaatggattatggacctaaatttgaaacctaaattataaaacttgtgaaaaaatatgtaggagaaaaatgtttgtgttcttgggttgggcaagatttttaaatacatgacacaataacacgagcaaatcatgaaacaaaaaaaaactgataaattggcattctcaaagttacaatttttgtcttcaaaagacactgttaagaagatgagaagataagccacagactgggagaaaatttttgcaaactactacgctgataaaggtcttgtatccaaaatagtaatatttaaagaagtctaactcaataaatatacagcccacccaatgaagaaatggctaaaacatttcaccaaagaaaagatatggatggcaaataatcatatgaaaagatgctctgcatctttagttactagagaaatgtaaattaaaaccacagtgacactccactaaaccctgaatggcaacaacaaaaagaccccacaaagcaaaacaaaaattgtgatgaaaaaagctgttgaggatttggaacaagtggaacctgcatacttttctggtgtgaatccagaatgatgtggttactttagaaaacctgtagtttttaaaaggtaaacgtgtacttaccatccgacccagaaatactattccttggtatttactcaagagaaatgaacacttaatgttcacacagaaatgtgtatgcaaaagtttatgtggctttattcataattgcaagaactgcaaacagcctaaaaatccttccactgctgattggataaactgtggcatatccatgcaatgaaatacaacccagcaataaaagagctatcatacatctaacaacatagatgaatctgaattcagtgtgctctgtgaaagaagacagacacaaaaggctatatactctgtgattctatttatatgacattctggaagaggcaaatctgtagggacagaaaacatatatttggttgctacggacttaggggtaggggaaggtattaaatgcccagtggcacagagaaacttttggggtgatggaaatctatattttcgttgcagtggtagattgcacagccgtgcatttgtccaaacttctctgtatagcaaaaatgggtgaattttattgtatgttaataatacttcaataaacctgactgatggccaaacacgaacaaaaagagaggacataaggaaaagattgtttagtttgattatatttcaaaaattaacttctggtagattaaaatgtttttttttttttaaagaaaatgttcagctgaattaaatttaaaggagtttaattgagcagtgaacatttccagtatcgcacagcccctagaatcacggcagattcagagactccagtgcagccacgtggtggaagatgtatagccaataaaaaggaaatgaggtacagaaatcggaagtgaggtacagaacagctggattggttacagctcggcatttgccttatttgaacacagtttgaagactcagcagtgtatgaatggttgaagtactgccgctgggattggccaagtctcagctattgttaaggcacatactcctaaatttggttttcagtcttgtctacctattaagctagattgcagttggtccacaaggactcaaatatagaagtacggagtccttctcaggccatatttagttcactttaacataagtaccaaagatagttaggtttagaaaccctcacaagcactttttattaattgccttcatataggcacagcaacgtgatgagctggccaagctgctttcttgaagacctgaaaaaaaaattttttaatgtggttggggaacaaaggaggaacaagaacaaaataggaaaagaaagaagttaaatgaaattaactttcatcttgaatgtgtgacagttataatttatgatcaccaatcataattagttgctgaaaacaactgttttgtaaattctgaaactaactgaaggacaggctctatagtacatctgagatttgttaatgaattttctcagggtgttagggaggatttacccatgagaaagaataaagtattataaaatgtgatctgaattcagatctccatcatggcttaactaatccagctaaggtattgtaaatactctgaagcagaagtagttacctgaataataaagacccaaatgcttactttgtagtttctcattaatcaaacgttcatttccatacagtggaaaggtgtttttgattttacagtttttcaaacagaggagccttcagttccataaaaggcaaaagatcttacaaatccatttgcacatatgatactattaaaatttctaattgtaaaagagcttttataaatgaataagaaaagggccaccacccagtagaaaaatagcttaggacatgaacaggcaataacaaatgcaggcagacagtcagtgcatataggaaataattgaatttcatttataattaaagatatataaattaaaacatgatttttatattatttgataaagattaaagataatacccattgataatgaaagtgtgaggaaataaaatctcagtttaagtgggagagtaaattggcacattcttttcatagagcaatttagaatcaggtcaaaattttaaatgtacatgctttttagaattgctaggaatttattctgtacaaatcataaatataaaaggaaattcattgcaggattatttgaaatggcaaactgtaaacaactcaaatgtataatgggtaaataaaattattgtcagtccatacaaaggaatactttgcagttactaaaaagctagggaggctgggcacggtggctgacgcctgtagtcccagcactttgggaggccgaggcaggcagatcacaaggtcaggagttcaaaaccagcctggccaatatggtgaaaccccacctctactgaaaatacaaaaattagctgggtgtggtggcgggtgcctgtagtcccagctacttgggagtctgaggcaggagaatcacttgaacccaggagacggaggttgcagtgagccaagatagcgccaccgctcttcagcctgggtgacagagcaagactccatctcaaaaaaaaaaaaaaaaggctagggaaagctctgtattatgaaagtatatccaaaatatatcgactaaaaataaaacacaacattatctatacatttcatagtgaaaaggctttttaaaaaagtatgatctcgtttctattaataaaaaaatatacatacatacacacatgaacataatatatagcactgaagaaatctagatgtgtatgaagtattaccagtggttaattttcaaggatagtataatgagaaactacccataaatgtctgtaacgtttggattttgtataaccaagtgttactttagtaatcagtagaaatccaaagacctttttacaaataaggtaaacataatttcatagactcagacaagtagaggggctggtgtgaaaaaggcaaagtagctgggaagtatagagtgaggggtccatttaggctggattgtaaaggggatatgttggggagttaaatgttaaaagtgctggaaaaatatgttgaggattgtattgtgaccaggccttaaatgtggaatcaagaagtttacacttcaattggtaggcagagggggagtcagctgaaacttttgagcaagaaagtggcatgcccaaagttttccttgaagaaaatcagtctgggagtagaatggtaggtagctgggaacaaactgaaaataggaacactaagtagagggctgttgcggtagttcagatttaggagtaacgagcgtgtgccacatggttgtaggaattagagaagcaaggctaacagacataagagcaaatacggagactagtggagaggggtgagacaagaatgcttaatgtctgagcacctgggaggatatttgtgtccttgctggagaaatacaatgacacaataaagatttcattggggggagaattcgctccagtccgccttgccagactgatttctgtaataattgcttggtgtattaatgggtgctcagtatattgatggaatttacttaagcttatgttatttaagctttaattatgtgctcaccattcctcgaatataacatgcatgttgacaggacatcagtaataccagtgctatgatggatgaagatgatagcaactactatttattaacacttttttttgagatggagtgttgctctgtcacccaggctggagtgcagtggcacgatctcggctcactgcaacctccacctcctgggttcaagcgattcttctgcctcagcctccccactagctgtgattacaggcgctcgccaccacgcctggctgatttttgtatttttagtagagacggagtcttaaccatgttggccaggttggtctcgaactcctgacgttaaataatccacccacctcagcctcctaaagtgctgagattacaggcgcaagccaccgcacccggctatgtaacactttttatctgaccaactttttctcacatgtccaagaccttctagataatacatagcagaactgagactggaacgagtctgtctgaatccaagcctgattctttaactgtcatactgtgctacctcccaggtcactggaggtgtggatctggagctcagattagacatacacttaagtaaatttgttgttagttgcattctagctgcctgactagtaatcatttgtttggataatcagtagtggtctattactgatcattgcaccccacacatttagctttgagcatagtaaaactgcccacctgagaccttctagggagttagttttatggataattgaggttaatgattacaatgttgaaatttacttttttgttccctcccgagatggagtcttgctctgtcgcccagagctggagtgcagtggcgcgatctcggctcactgcaacctccgcctcctgggttcaagcaattctcctgcctcagtctcccgggtagctgggattacaggcacccaccaccatgcccagctaatttttgtatttttagtagaagcagggtttcaccatgttggccagactggtctcgaactcctgaccttgtgatccacccacctcagcctcctaaagtgctgggattacaggcatgagccaccacccccagccaaaatttactttttaaaaatttaattattttttgctatctttctcaaatatattgcattctcttttatatgtttccttttttctacatttatcatttttgtaattataaatacattaaagtcaaatatattttatgctcttattttctggaacactgtatccttaacataatttaattttctcctgacaagtcatggtcaccatcatgaggattatgttactgggttttataatgtaatgattctatcaagaaataggccgggcacggtggctcacgcctgtaatcccagcagtttgggaggttgaggcaggtggatcacttgaggtcaggagtttgaaaccagcctggccagcatggtggaacccccatctctactacaaatacagaaattagctgagcgtgatggcattcacctgtagtcccagctactcaggaggctgaggcatgagaatcatttaagcctgggaggcggaggttgcagtgagctgggattacgccactgtactccagcctgggctacagagagactctgtctcaaaaaaaaaaatagcttaagtgtgcggcagtttatattaaatggcttcatgccacaatgctttgttcttatgtctttttaaaaaaagaaaatagtgtttctgttacacttattgtagtgaacatctttctgttctcagtgtgcaggctcaggaggcagaggcaggagaattgcttgaacccaggaggcagaggttgcaatgagccaagatcgcgccactgcactgcagcctgggtgacagagtgagactccattaaaaaagaaaaaaaaaaaaaagcaagatataacatatcaaatgataaaagtgttggggcaaagaaaaacagcataaaaaatagtcactgtttatgggggttgcttttgggacatggaaattgtgtgctaaatggtacttgatatgacaatggtatctgataaatttggttgggatacttcttcaggtaacagaaggttgatgtagagaacctctagtgtttttgaaaatggaaagtcaatcgcaaattatgactagaggaatatatcttgtagagcatatgtggtgagaaaagaaagtatgttcacatccaaaagtaaggctgttaaactcaaaaattacatttgtaattaatttaataaagttgaagtaacatatgtgattattctttgatggctgcagatataacccctgtcatgtgtggtaaagattaaatatggtatttgtgtttggctaattttgtttattccttttttctctgttttctctagtggaagaactagagactattttcaaagtataaatacaaatatgttagtatttgaaaaaatataggtattctagaatgcgtatttctgttaccattacagtttcagtttttacatgtctaatttttatgctgtaataatgacagtttttgtaaaatgttttctcaaagattataatattctttgctttcatataaaatcattttctaaatatttctaggcaatgtgcagaatatacacaaggaagataaacctttaagtctgagtatgcctgtaattacagaagaagaagagaatgaaagtttgagtggaacaggtacagataaaatttggtcaaactagtcaagtaaactaacttatactcgtagagcatcaaggtttagaacccttgaggaacatgacagtttgctgtgtgttcttgtgatcctttcatctttgacccattggagaatttcagtattagtcatatcattaatgacatctcaaagtcagggataatacaataaatgaatggtatggatacccattaggtatcctatcagtttcatctttgtagagatgtctctgtcagacctctgacctgctttcatctggacagtgttccagtacttctaatcctgactgctgctctcttccaggaatttgttttctttatttttttttcatgagacagggtcttgctgggttgcccaggctggagtgcggtgacttgatcacagtgacttactacagcttcgacctccccggctcaggctatcctcccctcccgcctcagcctcttgagtcactgggactgaaggcacatgccaccatgcctggctaatttttgtattttttgtagagacagggtctcactgtgttgcctaggctggtctcaaactcctgggctcaagtgatccacttgcctcagccttccaaagtactgggattacaggcatgagccaccgtgcctggcctaggaatttgttttcatcttaatttgttttttttacttgtcttttctctttttctttttctgccatttcccttttgtttttcactggtggggaatatttttttttcttttctttttttcttttttttttttttgagacagagtcttgctctgtcacccaggctggagtgcaatggcgtgatctcagctcactgcaaacaccatctcccaggttcacgcgattctcctgcctcagcctcccaagtagctgggattacaggcactcaccatcatgcccggctcatttttgtatttttgtagagatggggtttcaccgtgttgggcaggctggtcttgaactcctgaccttaagtgatccgcttgccttggcttcccaaagtgctgggattacaggtgggagccactgcacccggccggaatatttctttttgccacatcttttgtaattttcatgtttttgtgttttctattactttctttgcttttaatgatcagtaaactttaggttcgtgctgtttctagatggacaattattcgagtgttggttctggcatctcctgtggtagccagaatgatgtgtggtactggtgttttgggttacatttctaggtttaattgaaatgaaattgaaatcttagtcattttcttcttcttagtactggcctaaatacctttgagatctagtaccctgggttcatataattatagggagggtgtacccatatgaaacaacttcacagtaacttattattaattaggatttagaatgactaagggccactatctcaatagattgatattgcaataggattgagatcttactaccttaatggaggtagtattttttgttgttatgtgttttttttgtttgtttgtttgttttgagatggagtctcgctctgtcgtccaggctggagtgcagtggcacgatcttggctcactgcaacctccacctcctgggttcaagcaattctcctgcttcagcctcctgagtagctggtactatagacatgtaccaccacgcccggctaattttttgtatttattttagtagagatggggtttcaccatgttagccaggatggtctcgatcccctgacctcatgattcgcccaccttagcctcccagagtgctgggattataggcgtgagccactgcacctggccgatagtatgttttaaactgctgtatcattttgaagaaaaaattcttgaatatgtcaggtttaagatttttttgttgtgtctttgctgtgagggcattcttattgtgttgtaccagttagacgtctatgtagttgaaatgtgtattatcaattaggtattatcatgtaagtgtcagttgttttttttgtttgttttttttttgtttttagatctgactgacttttaaactttatgtctttagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgttttccagcatggtattattaagggatttaaagtttgggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctcaaaaaaaaaaaaaagtttgggttgaagatcaaattcgtgatatctctatatctaatctttaaaaatcagaatgctaatgctgacgcaaataaaattttcatttattagcattcatgcagtcacaattgtttcctttgattcctttgacttcaaatatatttggtcatagagggggcagttttcataatgtagacattaggtggagcatcttggatttaaacattctagggttggggtgtagatccattattggccccacttgatatactaggttgtttgccagaacttgtctgactgttaaaagtttatagacattgtacagctaacacactgagttgccctctcttttttcataactgtacttataaaatacatgctattgtttcacttgtacctcaagatggttagtgccctgcccccattcacaaagttagtaagtcatgcttctgagttataaacacagggctcagtcttataatttcagtttttttaaataagccaacacgtggaaatccagaaagatacttttttaactataagcagtaaaactccacttcaaaatggcttaaacgagaaggaaaatttattaaaatcaggtgagttccaacaaaggctggctctggcttatatagtacatcagttccgtgatggcttcatatacctaggtttccgttttttccttttttttttttttttttttttttttttttgagacggttttgctctgtcacccaggctggagagcagtgatgtgatcctggttcactgcagcctcaatctcctgagatcaagctatcttgccacctcagcctcttgagtagctgagtctacaggtgtgtgaccacatg

SEQ ID NO: 13477 - DNA, 232024 bp, Human
ttacgggtcaggcctccttgcactcatgtgaaatcgttgagaacctactcaattagaaagttctgaacagggccttagaggagtgggggctagaaagatgaacctggggccaggcacgggggctcatgcctgtaatcttaacactttaggaggcaggggctggaagatcacttgaacctgggagctggaggttatggtgagccatgatcacaccgctgtattccagcctggatgacaaagcaaaacccagtctctaaaacataaaagaaagaaaggagggaaggaagaaagaaaggaatgaaagcaagccgaatctgctccgagggaaccagtatagcaagacagaatgtaatcaagtatcttaagagtggcctaggcttggctgggtgctgtggctcacgcctgtaatctcagcactttgggaggccgaggcaggcgaatcacttgaggtcgggagtttgagaccagcctgaccaacatggagaaaccctgtctctactaaaaatacaaaattagccgggcgtggtggcgcatgcctgtaattccagctactcgggaggctggggcaggtgaatcgctcgaacctgggaggcggaggttgcggtgagccgagatggcgccattgcactccagcctgggcaacaaaagcgaaactccgtctcaacaacaacaacaacaacaacaacaacaacaaaaagtggcctaggctttttggggaacaaattggttgtggctggccctcagggagcaagctttgcggcatagcagcgtaggctaaaaggtcctccccggagacaaaatctgcagggaccacggggtgggaagcatcagaaggctgcccactctgactgcaaatacaacaagctggagtgttcctagaagaggcaatttcttccgcgtgtgtgttggggacagcctgtgtgtgtgaacattttctgcccttgccgcgcagggctgggtggaccaggaaccacccgcagaggaagagacttattacctcttggccatgtctgtctccagaagaaccgacctttcctgctctatgtgcaacaagacacaccttccgaggaaggaggcgaacaggatttccatcattactactgccctattaaaacacacacatacacacaactgtgtaattagcctctgcaggaaaggcgcacaaacaggatgcgttcgagctgaccccgggatgagccatccctgtaaatattaggaaaaagaacctccccgccgtgcccccgcctccggccagggcctcttggggatggccctgcagggtcaccagcccaccggggaggttgggagagagggggcgggcgactcctcgccgcgcgggttcctggctggagcgccctcctctgcgtcctcccaaccttccatcgctccccaggtcagtctaccacgcctcaggtgtttgctcgggctgggccacgaaccctttcctttttggcctgcgcccggggtggcccctaacccgcagcgcacggccagacccagcgctacaaggagggcgcgcagggcggcgcaagcgggcactggcctcccgggggcttgcgcggggatccacccaccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggagaagcaagaggaggcgggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctgcctttccccagggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtgagtagcggtgaccccttccctttgtgtccacccaacccccgttccccttatgtttttcaaaactcacccgggtcccgctttcccatcgctttgtggctgagggaattccctccagactttggtcttcgtccaggtggccgcggcactggtgacgcgaccgcggtgggtgtgtgcaggcgcaggtgtgtctccaggaagccggcctggacacgatcccctttcaggacagcggcttggcctaacgggaagtcgggcaggggtccagggcggtcaccctttccgcccagtctttgggtaaggagctccaactttcagcacgcgagtgataggtaggaaaggcagggaaggagtgatacaaaagggacttgatttgggtaaagtgcttcaagcgctacttaggagaaagccgtacattctcgcgagtattattcataatgtttatggatacatgttggttcagccgctcagacgtgcacacgtgtttcggcttgcacatcccagaggtacatgagctacactggcagggaaatgagcgcctgggtctgcacgttggcagttttattatttagcatttttccaaggagatgagatttacatatacttgcaggtaacttagtcagtccgaggtgggagtcctgcagtgtgggtttctgctgctatgggtctgagaagaggctgtaaggactcctcaggaggttgttaactgtcttccctccccccatcaccagcctgtgttcctgggtattgacgtgtagctacccgcagctctccccttgcctctgcttttcacatagttcccatgaggcataatttctgctgtaaatcaattaaaacttctagagcgctctacacggtgctaacatgcttttactgcctaatcctcacactgtctttgtgatgcaggtgtcatcgttcccactttgagatgatggaatgataattataataaagtagtctggtttggcaaagtggagtacgccatttgaagactctcaggagtttaatagtttaagttctggagggagtcagttttgaacccaatatcagtattgaaaatgtttgaaatttacaagtggtgaaatcagatggatggtgatgaaggctcatttaggtatttattttatactttgtggaattagtaattttaccgtatattttctaaaattaaagatggcttgtggagctattcctttcttttaaatagaagtacaaaaaccataatgactaaccttaatcgtcaaattatattgagttaatttcccttcagcctaatttactttgtggtacttagaagtggggactagagaggaattgctaaaatacagttagatatttacatttatcctgtgaatttctggaaatgaaatagaagtgagtgtaggcatccagatggaattgttgagttctattagtgtctgattaggagttaggtcgggcaaagctctagaggaactaggttctgaattatggtggtgcagattggccagtggccatgagaagcatctcttcctggagatagcctagactcgtccttctcaaccataatcttcccacttgaatcacccagggacctttaaaaaatccccacttttaaagattctagataggaatctctggctgtgggaccccatcatccgtacttttaggctcaccaggtgattccagtatgcagtcgaggtggagaacctgcagcctacatgaagaccaaaagatgaggacttcttggtgtcataagtgtaggaagatccacgttatctgactaggtggcatgtacagagctgcttattgttccactggatgaatattcaatgtaaatcagatatcgatatttataatggtctgaaataattacacttagatgtttaatataacccactggtggtgttttggaaaacgttgagtggttggtagggagggtcagcatttaaatgaccttgaaaccagcagtttttcatgcgtttgcatgcatcagaaggcagatttttttgttgttgttttttttaaaaaggttttgggtatttcagaactgtaaggatatggaacataggttgggcagagtgttgtttcttttctttttaaagaaaatcttgttaaaaaaatttggaaatatatggaatgcatgcttttttaaaaaagtatcctttataggttcaaaaatgctttaaaaaaatagagatggggtcttgctaccttgttgaccaggctggtcttgaacttgtggcctcaagccatcctcccacttcaacctcccaaagtgctgggattacaggtgtgagccactgcatctggcccaaaggtgcttttgaagttcaggattaaagaaatacttatttatctttagtattttaaattgacatgtagtttattcagagagttaaatgtggaataattgaatttactccataataaatttatggttgcaagtggaactacagattactgacttaaaaaaaaactattgaagttgcaggttcaaaaaacccccaaaacctagtgacttagtttttgctagatccagagaagctcttagctgtaggttatggatgagaggattcaatatggttaagatctcaattcttcccaaagtattcaataggttcagtataatctcagtcaaaatctaagtttgttgtagaaattgacagactgactttaaaatttatatggaaatgtaaagtactgagaccagtctaagaatagttttgaaaaagaacaagttgggggacttagagtatctgatttcaaggctaactgtaacatgaccgtaatcaagataatgtggtattggaataaagagagtcatacagatcagtggaatgaatagaagagagtctaggaatagatccacacatatatgacccactgatttctgataaagctgccaagaaggcaactcagtgggggaaatgatagtcttttcaactaatggtgcttgaacaactggatagccacatacagtaatatgagccttgacacttacctcacatcctacaaagacattaattcaaaatggattatagacctaaatgtaagagtttaactgtgaaacttctataagaaaacaaaattgtagtgaccttgggttcagcaaaaaatttttagatagcgtacaaaaggcaccaactataaaaaaatcagtaagttggactttatcaaaatgaaaaactattgcttcccagagaatgtttaagaaaataaaaacccaagccacaaatgggggaaaataactgcaacacgtaaatgaaagatgtgtaacatgaatatataaaagaactctaacagcacaataataatgagaaaaatacctaatttaaaatccaacaaatgacttgtaacttgtcaaatatttcaataggcactcaccttcatgccaaatagcacattaaaagatgctcaaaatcatgagtcattaaggaaatgcaaattaaaaccaaaatgagatctcagtatgttcccactagaaaggttaaaattaataagactgaccataccaagtgttggtgaggaagtggagcacctggaactctcatatgctatggtgaggaatgtaaaatggtaaatcatgttggaaaatagtttggcagtttcttaaactatcaaacatatgcctactatataacttactgtttagtatttactaaaagaaatgaaatcattcatacaaaagcttgtccacgagtgttcatagcatctttatttgtaataacccccaaagtggaaacaactcaaatgtcaacagatgaatgtttaaacaattgtggtttatccatacaatggaatattactcagcaataaaaaagatgaactattacacatgtaacaacaggaatgaatctcagaataattatgctgagtgaaagaaactagacaaaaaagtacggtttcatttatgcaaaattctagaaatgaaaaggagtctatagtgacaggaagcagatcagtgggtgcctaaaaatggagagtggaggtaagggaggtggattacaaaggaggcagaaacttttaggggagatgaatatttgtgttattctgattgtggcaatgatttcacagttatatacatatgtcaaagcttattaaatagttcactttaagtatgtgcatgttactatatgacaattatacctgaataaagctgtggggaaaaaaaccaatcagcgcttatccatattttactgaaggtgttaagtaagatgctagtaaatgacagaatttcagctgagccaagtctgactcttgaaaactacatttcctctttagtgcagaaaatatttatgagaatgggagcgtagaaaaaatgaaatcacaataaaacaaattagtttctgatttttggacacggtctcattttctaaattatcactgtcagttttttttctgctgcttctagaacatgtttattttgcataatttctctggcttccaaaatctgaagaattgcctctgtttaaactctattttcttctttcgtgtacttgctcttgatttgctgaccttctaaatggggaccagcatctaatgcttaatgcagagtgctggggacatggggaggcaggaggagctggaggctgcgtcatggaaagaccttggcgccccctcaggaaggaaggactggcttggcaggatcccaggctgttttcctggttcagccctcccgaagacattgtgttctctgcagccctggagggcctctttctctcaatttctcagtgaggtacctgttttgtaatcagtcctgtcaggtgaagcagccatgttactactggacaatcatggattatcttttcccttccttcctggatccaggtgtctgaatttataccaccaaaattcttccagattttctatctagtggttcattctcttttgtactttgtagtgccgttgtttattctcatgattgatttttttctgagccaattggaaggaatgtctaacactgactgatcaacccacagtgtttaagaggaaaaatatattttagaatcttgagggagttttatttcagtgtatgtgaattgtattggctatgtagcgtcttcattttcattgtaagaagaattttgctacagtgggaccggctgcttctcatcacaaacaggttgtggctcagatattttcccctttggagagcattttcctggtcatattattatcttgttgtctttcgttgcactcattgctctctgagatcattttgttaatgaatttgcttattatactttcctcctttagattacaaatggcttgagagcagggacccacctctcttattcactgtcctaaccctgggacaatgtctcatatgtagtaaacattaaatatttgttaaatgaaattttatgtgattgggggacaagtaaagtgtaagtactttgggagcatctttccatctttctaaaagaaagaaatgaaaatagttgaggagttactggatgaacagtattcctctgttaaatcaatcaatgacataccaatatgtgcttgaaagactgggcctgggccgggcgcggtggctcacgcctgtaatcccagcactttgggaggccgaggtgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcggtccgcagtccggcctgggcaacagagcgagactccgtctcaaaaaaaaaaaaaaaaaaaaaaaagaaagactgggcctgactgctatattctttgaatatggtaatggattgaaaaccttgtgtatggaaaattccctgctcttacgtcattttaaaagactatgattttaaaacttgtaatacgttataacgtttttcacttataattttcacgcccaaaatgttaaagtcagggcagaagcaagacatcagcatttaaaaggttgtgcctcagccttggagaggaatgaggttggtgggtggaacgtgaatcattttatcttatgcaactcttagtgaagttttggtatctagtaagtgttaagaatggtgattagtggtgatggtaaaagtgtggtgcatttttatgagaagagtagcatttgcgtagaataatagaggtgcctgggatttttggtagtccttttttatttaataaagcaactggggccgcgtgctatggcttgcgtctgtaatcccagcactttgggaggccaaggcaataggatcccttgggcccaggagtttgagaccagcctaagtaaaatagtgagaccccatctccacaaaaaaataaaattagccaggcatggtagcacatgcctctagtcccagctacttgggaagctgaggtgggaggatcacttgagcctgggaggttgaggctgcagtgagccatgatcatgtcactgtactctagcttaaatgacagagcaaaaccctgtctcaaaaaaaaaaaaaagctgaaaaaacagtcaactagattgtgttccccttttgtgttgacttcttagctccactttattagaatgtgataaaaatgagacctaagtggaaacaatccctgtccattgttttccactcttatcattactgtatccaaaatagtctttctcaattgccaaaccaatagtcatttctttatttaaaactcctcctctgtggttctccactgctcttagataaactcctgagtcttttttttttttttttttttgagacagaatctctctctgttgcccaggctggagtacagtggcacgatctcggctcacttcaacctccgcctcccaggttcaagcgattctcctgcctcagcctctcagtagctgggattacaggcacacaccaccacgcctggctaatttttatatttttggtagagacagggttttgccatgttggccaggctggtctcaaactcctgacttcaggtgatccgcccgccttagccttccaaagtgctgggatgcaggcatgagtcactgcacccagccaaagtccagagtctttaaaatggtataggatgttctccatgatctgtaccctgtgttcctcttgagccttttctcttacatttccccaaattacaatgagcatctttcagttcctcaaaaggaggaacacttcgctttgctaattcttccttgtgcttcaggtctcattatgggcattaattacccagacaactgtccctgatgtgccagtctgggtttggtcctcctcctagtgttccctcagtatcctgagatctcttttgccgctgtctcctccaacctgaaagaacggacgtatgaatggattggcctctaatggaagcgtgtgacactggtcacagggagttcagggtgtagttgtttgaatgattgactaagattcatccgcttggctcttgtagtagtgactctgacagactattacatgtttctatttgaaatgccaagccctaggtgagcatccagccaccaatgagcatgtactaagtaccaggcattgtgctctatcctgtaaagtcaagtggacaggacacacatgacccattctttcgtagggcttgtaattccaagggggagggagattgggataaaaagcaaacaaaagcaactagggaattacagaagtacttacaggcaggtaagcccctggtttggggaggtggggaacatcttcctggaggaaaaacaaagagctgacttttaaggacccagcctagagagccacagcctgcttcagttaaatgactgtgaacagtctttgctcaaaagaagaaaaggaacttctgacctgataatgtttcccagagggacatcgcagatgcccttttgaaaggtaaatgttcctgacccacagaaatgtttccatctttggaaagtttgggagggaactgtttccatgcttgtgaacagatgacctgcaaaagaacttttgactccacaaaggcagaaagtaggaacactatatttgaaccatcaaataccttaagttttgtatagatcataaaataatcatagatgttgaagcaggatgatcatctaattcagaacaacaacaaaaagcctgatagctcttaggcctgcagacagcctgtaggtctattcatttggcacagatgtttttaacattgaaactgaaggcatttggtgctgtggtgctccagtttgccacagacccctccactccctgttatgaaaccaactctcttgactcattacttgcttggacctgggacattttaaattttgtgacactatagctcaagcctttgttttctgaatgtgggaaccaaagttccagccaaatcattactgttgccctaacaggggtgtccaatcttttggcttccctgggccacgttggaagaagaattgttttgggtcacacataaaatacgctaacactaacgatagctgatgagctcaaaaaaaaaatcctcaaaaaaatctcataatgttttaagaaagtttacgaatctgtgttgggctgcattcaaagctgtcctgagctgcatgcagcctatgggctgtgggttgaacaagcttgccctaactcatgagaagtgtaatatacatacatttaatatgtattaatatctatctaatctatatctacaaaaatacagatatacttacttagatttatttagatatgtaataatttattaatttataaaatgcattagtttagatatatatttacttagatttttacttacataaagatttgtgtcctagtatttcagagaaagctagcttactagtaaatatatggggagttaacttttactgcaaattagtattatattaactatccaatttaaaaagaaagcaaactctgccaggctggtatggtggtgtgcacctgtagtcccgtgtactggggaggctgaggcaggaggattgcttgagcctaggagttcaaggctgcagtgagagctatgatcgagctgctgctcctcagcctgggcaacagagtgagactttgtctcaaaaaaagaaacaacaacaacaacaaaaaaacccctctttttatttcgttatacaactcccagcaataggggaacactgtactttaatgggtgtcaggagaactgggttcaagctgtgaccttaggcaagcgtctgcttatctgggtcccatttccccgttatattgtgagggggctgcactaaacggtctccaaagacttttatatctctaaagcctctgcttccatgtgttaggcaatcacataatttcttcccttttggagtaattggtttggtttaaactgtcaaaatgaattatgtgttatcaaagttagtaactcctaagaattaaattggtccaaatctaaattgcttagagttggagaggatttagctcccatctaagtgacttgtatagcatcgctagtgatgttggtattattttcttggtttagaatcagccttaaggcaatacatttcaagccatgcagttgtatttcttgatttatgctaacgcactccttgttctatgggatggttgtaagttatgtccctgttacggcaagtcagagagagactgagaatcccactgttttgctagaagccattctcactagtttggcaattacagcattattgtcccaaagtatctgtagctaccagtctatgtatccacccagggtgatgacaaatactacaaatcactgtaggacagacattttaattagagggaggaatgagcccaagggtattgactatggtagtgtttaagtgctgtgttaaagaattttatgagacaggaaatttttgttgagaatcatggtcctatctggagatatttatcaagattattatgttagtgtgcttctgtagcaccagtaaattagagcagtatctgtcaaagcacataggacttttgtagtagaaagcccacttaataggaagcttaccagcagtgcttttattatgtactgccttcccaaaagttcctttgattgcgtataagttttacccttgcacgcctttgacctcacagggagataaatgcttaaaagttaccaaagatgtttagtttgtgcttgtggtaaaaaattaagaaatttgccagagcataaaaccatggtcaacatgatccctgtcataattgcattaataagtcatataggccagagtgagcatattctatacctcgtcctgtatttccaatttcagacctagcctctgttctccatgcacttagacaaaaaccgcaaagctgcatatttattcgtaagtcacatctgtcccttgtactagcatagctctgtctctccacctctcgtgtcgcaagcccttaaatatgatacactctttccttacaatggactttggtttttgcgtctgtgatgttggagggctgggccccttgagctctgtggtccttccggtgtcagagttttgtggttctggtaatggttccgttggacaatggaaattctgctcccttctgaaatatattcaggagacttctgatactcagatttgttctgggctctgaaattattttgggaagggcacccaaaagtcatacgtgtattagcctaattccataaacagaatacatttatttatttgcaagctgtgggcctcttagatgctttaatatagattactgttgtttaattatggtacagaagagttgagagcagattccatctaaattagtgcttttgaaactgttgtcgagccctagacccttttagagatgatgagagctatggagctgtttctggaaaaatgcacatatgtgcatattgatgatattctgggaacaatgtcatctgattagtagccctcctaaagcctttcctaaaccttaaggacacaggacctcaggttgagaaacctcagttgaaagggttcaaaaataaggcttttattaattcctaacattcagggtgtggttccagtgttttcctttgtatttgaggacattttcacttcaattaattatagaaaatagttacttagtagaaaacaggagctaggagctataaattttagagaaaaagatgttcttaaaaatgtgttctcacttacggcttctggtgaaatatactagatgatgacccattttaggacctatttggttgtgttatttaggtgttttcaaaagcctctatttttttaaagagtttctttgaggtttgcagtagatgaaaacttaaaaaaacaaaactaggacagtttgagtgaccctggcttggtatcttttgttaatataaacttttcccttgtaaaaagaaataggattcatctttttcatacgctttttcttaaaacattcaccctctttttgagctgcagtgggcattatggtgttctgctgtgttagtctaagacaaaatgatgagattggtgaggcctgcctgatcctcttaccctttgagccccagtctcccatggtctgggtccccgtgacccagcagattttttggtcctctctggaattccagttcactcagtcagcatcttacagacaacccgatgttggtggaaactgagctgaatggagactgtccacagagcagccccctagctaaaggtaaagtgagaatccagctctctagacttcaggccaagattctttcccgactccacctcagtgtgtggtggaggcagcagggtagccatccagtcagtcattcataggtgtttattaagtatctaccttgtgcctgagcctgttctaggtgttacaggtagggcagagaacgcaagacccagcatctcggctctccagcactgccgccctagcacagggaggtggataacaagcaggcaaacgcacgatgaagaaaatgacaaatgctgggtaggtaccaagtagagaatcaaagcagggtgacttgattcagtgtgacaaggtggctgctttatctggagtggtcactgtctgcgaaggacaggtaaagcactgtgcagcagacttgctgcacagagcgggtgacaattcagctgaggcctgactgacaagaagcacacagccctgtgaagattagagaaagagcattccaagcagaggcaacaaaggccctaccgtgagaacaagcttggcaggtggaaaaacagtggagggtggcagaaagagagtcggcttggtgtcagaaagctcggggcattgtcccagatctgttgcttcctaggagtgtgaacgatgagcaagtccctccatctctgatgattagttttttcttttggaaaatggtgctaatgtttgctaccttataggcttggtgtgaagattagatgaactacattaaacatgcccagcacaagataggcactggagaaatgctagctttgggtgctttttaaattaattaattaatttatttaatttttttagatatgggctcgccatgttacccaggctggtcttgaactcctgggctcaggttatcttgcttcagcctcccaaaatgctgggattataggcaagagccaccactcctagcctggttgctttttttattttaatctttaacaaaattatttatttatttattttttgtaatcttggcaggcaaagctttggttgcttttaatttcctgaggaaatgaatatttttgacaagggccttctgaaaagaatcgtactggctgaggatagacacccacagggttgcctcttagaaaagagggtggtggtatgaaagtttcttaggggtggggtagggtatagtcttgttggcgccctcaaatgacatcatagaagcatctagttatctctacccccttcagtaacatgttttctaaagagaggatggggaaaggaaacaaagactctgaagtttattccgtatttttcagtttctgaaaagtgtatttgttttctatggactcataaatattaatggaaagtttcaataatttagatggacaggataattgcattgtagtggtataactgatagggccccaacttgtttttatttgttacaaaactatacatttatggctgagaattaataaacatactaacagtaatcataaaggaaataaaacctcagccattgtaaaaaataaaaataaaaaaaaccacaacccccccatctgccaaaactagatataattgattcttgcttaattctgaaagctcatttactttttggattataattttgtgaactaactctggataattttgcctattttgaatagttttagataatgcctattttggcatctccctgaatatttctgaccatcccttcaacatttatttggtctgtttaaagaagacacattaacatttgcctaagtcacatgaattaggatgcagaatctataattatggactaatgatacacaaatacaggctttgaggagtatttattggacaactaccataattatcagtgcatcatagtgtgatggttgggtgtcagccagattggggttcagctattcattctgcctctcattagcagggataatttaacccctgcaagcctgttctgtcatccacaacacagtacctgcctcacagggttacttcagaacacagtgaggacttatgtaaaccatctacacagggcatgacatatactaccgcagaaaaatgattgttgatgtcactttcattaccaccactctaccctcagcacttcaatatgaagtgatgggcccagcccttttctgaagttaactttgaaagcagtaagatatttatttacatagaattcaagagaagggatttttgagtacaacttcctcactggttttgcttttaatgtaggattctggaatgtaaatcagtaggagatttctagttactggtggaagagaagatggcttccttatcccggaatcacagggattgggggtaaattctgtacataggtcctctctggaagttcttgcaaggaatatgggaaaatgaagctggaattattatagttacaatgttggctaaagttggttcatggaaaccttgaaattaagtttgttggtttgcttattcaatattggacagcagagggtctgagttagtgagaaccaacaaaccagaaataaatcaagttgcaatatttagctgcaaaggacagaaagaggcctttgaaaagctgaagtgagtacttttattgctgtaattaagggaaataatggtaaacaggctctttcaattggcattaaaatatattttccttggttagtttgaatatccaatacaagttggtggatgtgaattgttctgtcatgctttcaaggaggaaaactctagttttaaaagtacgtcattagggccaggtgtggtggctcatgcctgtaattccagcactatggggggctgaggtgggcagattgcttgaggtctggagttcgagaccaacctagccagcatggtgaaactctgtctctactaaaaatacaaaaattagctgggcttggtggtatgcacctgtaattccagctacttgggaggctgaggcatgagaattgcttgaacccaggaggcgaggtggaggttgcagtgagtcgagattgtggactccagcctgggttacgaagtgacagtctgtctcaaaaaaaaaaaaaaaaaaaaaaagtacatcgtttgaatatggatttatagatgtattcaaggacaccaacaattttttttttttttttttgagacagggtctcactgtgtcccccaggctggaatgtagtggtgtgaacatgactcactgcagtctcaacctcctgggctcaagtgatcctcctgcctcagtcttctgagtaactgggaccataggcgtgcgccaccaagctcagctaattttttaatgtagagacagggtcttgccatgttgcttaggctgaacatttgatttggcttgcagaaaatatgaagtactttttttcctatgtggactcaattaaacaaaaaattttattttacagagataggatcttactctgttgcccagtctggagtgcagtggtacatacaatcttaactcactgtaaccttgacctcctgggctcaactgatcctcttgcctcagccacctgagtagctgggactacagtcgtgcaccaccgtggttggctaattagaaaaccttttttcttatagaggtagggtctcactatgttgcccaggctgctctctaattcctgacttcgagtgatgccacccttcatggcctcccaaagtgctgggattacaggcatgagccaccatgccccacctggggactcatttgaaggtgatcatttctacttttatttgtttactggacacttgttctgggacctagatctttcacagttgattttaagtgaaaggtttctgaactgtatatatacaatatttcagaacagtaatttcctttgcttcatagtacggcacaacagtgtttgcacttgatgtttagcgtagccttggttttggttgttcagaagcctttgttagctctttggttgtgccaagaatatattgtttttgagtctccttgccgggcctcctcgccttcttgtcatgcacatcctgtacctgggttgtggttgtattgatttgctggggcgctgctgttgcaaatgtctggagtgaatgagaatgtgtttgtgggtgtctgccctcaccttggccactgatctgctttcagccctgaagtactgccatctgcatgaacattagggacccccagcctcccccaccacttagtaaagtaccctgcacatgtttgggattcaggaaatgtttgtagaaaggaaaaattccttatcattccttaccattctctgtcttgagtctgagtcatgattcaaacacttttgctaaaaggttttcgcttgaaaaattcatattcaggtacagatttacttttttttggtgtgtgtgagtttaagagctgcctcaggagtagtttagagagaatgaatataccagtatggtttttattcccttgattacttaaataagtattaaaggtgtgtgaaaagattagctgaatcctaggttcctcaaacaaaatgttaacttttgtttgggtggtaagagatggatttcaaaatgggaaaaagcgagactgaaaccatcatccagcacacactatgtcaggaatgtattaatgacagcctgcgcttgataagaacaggacaccaacagggggcataaacaagatctaggtacaactgtgaccttgaagtgaccttgagtttaagttgccatttaaactcattttccttaaactgtccttttctggcaaaataagtgactcctgaagttgcctcattagaactccaatatgcatttttctctctgaactgtttctgatgggtgttgactccttctgttgtcatttggtcctataggaccaaacttgtatatgtagaattttattttaaaataggaaaaatcatgattctgaaaaattgtgcctgtcaagatattaaatgactgttcccattaatattattgccattaatattttgaagtcaaattacatagtgacagctctctgcctgaatgatacttacgttaaaaggaagaaactgtctgagagaattggaagagatgataatgaggcctccccaccactttcccttttaagcccctcacctatcacctactcctccatcccctagacttaagtaggttcccttacttttcttctgcttgggccattgtttagaaaggtctgagtcttgggatgagctggcctcctgttcaggcttagccctccacctgctctgcctgggtcccctctgtgttctccctgggccaggccttcccttctgtgttttcatcctctcctgtcctcctgacaccttcatttaattgtaactttttttttttttttccgagacggagtctcactctgtcgcccaggctggagcgcagtggcgcaatctcagctcactgcaagctttgcctcccgggttcacgccattctcctgcctcagcctcccgagtagctgggactacaggcgcccaccaccacgcccggctaattttttgtatttttagtagagacggggtttcaccttgttagccaggatggtctcgatctcctgacctcatgatccacctgcctcggcctcccaaagtgctgggattacaggcgtgagccacccaagcccggccttttttttttttttttttttttttataattaaagttaaggttgcagtgagctgagattgcaccactgtactgcactccagcctgggtctcactctgtcatccaggccagagtgcagtggcgcaatctcagctcactgctaccttaactcctaggctcaagccatcctcttaccccagcctcctgagcagctgggattacaggcatgcgccaccatgcccccagctaattttttaatttttcatagagacagaaaggtcctctaggttgcccaggctggtctccaagtgcggggctcaagcgatcctcttgacttggcctcccaaagtgctgggattataggagtgagccactgtgcctggcgaaaccttcattttaaaaacatacccaaatctttctgagcactcagcctttcagtcctctgttggccttgcccactatccttttgaggtggggcacagtgttttcctttcccttctcagcctcttccctgacagctgtctgcagatgcccttccctgccctgttcatttttcttcccggtgcccatccccaggagactgcgctggcgaagcccaggagtgacagtgtagtcaggtcagttcttctttgtcttgttggctgctaccttcttcagattcattgctcccctgtttctgtgtttttccaatgcttactgatgtgtttttaagtttctttttgtatctttcctcatccctcaacctagtaaatattggtgttccccaggtgggagggggcggggtggggggcgggggtgggtgggaggtggtttgtctttaccttcttttctttgtcatggcgcatggtctcgtcaacttttaagtctcaacaatattgcccatatgccaaggacttccaaagctctgtctcttgtcttcccccctgagcccaactattgcttctggaactggggcaggcttaggacaaaccactttatactccgtctcctttaatcctcacagtagactgtgagagaggaggagtgctgtggcacctgcatttctcacccgaggaaactgtggcttagacaggcccgatatcaggtccagggtcccatgtctgatatgcttgctggacagacctgcttggacatcctttaggcatctccaagtcaacatgtccacaattaaatatcccatctttccccttgacctgctcctcctcccattttcccggtcagaactggtcttgccgttgttcagtcacctggccaccattctagacttttctttctcctttacctctttccccacctcagttgattgccaagtcatgccagattggcttggtaaatactttctgactcaatttcttcttttccccacaattaccacactcgtttgtatcatacatatggattattgtgatggccttggaactggtttccatgaatctagttgtattccctcaaatccatcctccataaactgcctggatgagctgtctaaaactcagccctaacctccctcctgccagaagtcgtttaaaggcttcctgtgccctataaagttcaggctcctggggagggttcccaatcggctggccctgccttccccattccatcttccacctctccttgccttccagtttatgagctaagtactaatggacagactaggttttcttgcctctgctcatgtctaattcaccttatttacaataaatgttggaggaggaaggaagatactcctttgtaatttgtacagaaggacttgtataacattagaaaagatagggttgaataagttacatagaaaaaatatgtcactctccatgtaactacaaagacatccataaacaggcctgagcatgccacatgcacatgtcagcacagttcacagcattcactgagcacttgctgtggccagagaccacagtagatgctgggggtgaaaagctcaaggagctctccctgtagtgagggaggcagcagaaacccacagtttcatcatagggtagttgagtttaggaataggaatgggtacgggatagtaggggattgtgagcctgagtattcagggaggacttcttggaggaggtgatgcacaagttctgtcttcagggaaagtcagtagtaaccaggtcgaaggtagtgtaaattccttttctcctttttcctctttgggatttgtatttttcccatggaattttacctgtacaggtcattttacactggactaacaatgcttaagtgctttttaaaagcaaactgtgccagatttatcccattggtaggaactttcttcatgagttcagaggctttgtcttggttcccgttgtattgccagtgcatggcccctggtaggtgctgagtaaatgttggttgaattggatgccttgaggtgaggcatgagaaagggttctcctcctccccctgaaggtggtgaagatagttgtgacagttgagacttgcatggggctgaccttgtgaggtcctaagcctggtgaccagcctctgcagtgtaactgggctgtctcatgggaagggcagagcctttcctacgtggccaactctgtgttctgaacaggagtgccaaactcatttggaggggaagggagcgcccttttaaagcctcaactactaattaaattcaagcagaagatggtgaaggtggagctaactcatttattagcatataatatgatcaacctaactcatataaatgtagattaccttggtttgtcttttcctggctgcagaaaaggcttggagaggtgccttggattgtgagttagtcagtgagcagctgcttaaagatttgaaaaatcctagaatatgtcatctctgtaggctttatcctttaattaattatggatttttatctgcatatatgtgaagctaatgattgacttggttcggacactgaattgtcggcttaaacctgccattccactgggcttcatcactatgttctatgggtgtgaagcctttgttttttcagagacccatttccaccagcgggtttgcactgtaagtgtttccacaggaactctgccctttgccagtgtcactgttgtggctatgcagcagaacccacagggcggaggtgtttcagccctcactgaaaatgcaacagatcttaacatctcttgctgcaaattttccagtgtgttctggtctaccttggtatcttaaaaccaggctcactgactaccacatgagaaatgacagtggggtgtcttaaatgatctgttgaagaccagcagccaaaaagattgcccttagtgtttctctctaccggctaacattagacaatgccatgtagaagctgctgttagggtttgagaactgtgtcgcctcattctcaagatagccaaggaagtgtcatctctggagaaggcagttctgtctctttcagtttctccatggatccgatattgttctgaaagaggtggttttaccaattcgtctcacacagacttcttgcctttacttttatctgactgctgacagggtgggctggaatataatcgctacttaactggacttgactttcaaggcctgattggcgtttccagtatagcagttgcctgagtcatctagttttggaactgataaatcaaaggactggcttggaggctagtgtcctgtctggagaatgggcttaatgtaacttcagttaagaaattaatgaatctgaaatagttataacccaaggaagagattttcctaaagaatgtccctttagagaaataatgaccagttccctcaaaaaaaaaaaaaaaaaaaaaaggaaaaacagacactagactggatagaaaagacttacatgttgaggctgatgatttctcttatggaactataaaaggactggactctaaggaaatgagggtcttcaacttcattggtgatatttccagttgttctggagctgtgatagaaccaggactagagaatgcagggcacgatgatagatttttttttatgtagcacttttaaacataaaaaatatatatctaatgtgccaatgcaagacctggcctttttgtaatcaagtaatattttgagtaataattgattgcacaacatcctgtgacacactgtgaaagagtaaaattggcttaaaaattttaagtacaaagacatttcagaagagttttgtccataactttgttagactgaaatgaggaattacatttggcaccaggaaatggatctggattatttagaacaaatgttttccaggtttgaatcttctatgtggaagtacagcctgacttctttgccttttccctggtccgggatcctgacagtcagttcttcagctctgtgcctccagaatttcatgtttatgctgcacaaggcctgtattttataatggtggctcttttggacgatgacttcctcgatggtgaaacttccagtaatctccctcatcatactgaaatgatatcagtatatcatcagaacaccatggagcttgtcatttgagggacacagcttgcttgtgtgcttgggaaagaagaggtttagcatggtttcaggtcagtgatgagtccaatgatctctgcaagttcccttagctctgagaattctgatgtcatatgcacttctgccgccagagttgctgcttactggatgcgtaagaagcaaggaaaataaatgtaaaatgcctggcgccactgaggaagtagggtgaggagttaagttagacagtgactggcatttcccagccacactagtacagaagtgtcctgtggtacgaacggaggcaggctggggggttccattgtgtgccaggtgtttccatgaaaataaactgttgagtgccaggtatggcagctgcaaacagggatttggggggcaaaatttaatctttttttgtgatttgttgaatgaagtgcctaatgtgtctcagtaacttacttgagaggaaaagagccacaagcaaggtagtggagagtgctggatggttgccttgtgaccagacctgttcttttaaggcctctggagccagctgtgggacgatcaatccagcagctgcaggtacgcctcgggtgacacttgggtctgtagtcagcggggttgcctgtgactgagagtggcagagtggacccttgcactgatgaatcctgaccctgctgatctttgcttgggtgatggctgtttgtgtgctatttctagaagttcctcccgcctgcctatgtgacctgttttcaccagatccagattgctagccccttaaagcttgaagaaccttaaaggtcatctggaacaaaagatttatttatttttagcccggtggccaccctgaaccccccagttgattgattgaggctagtcttgagcgtgccctgcttcacatgctagttttccagtttctactttgggagaatgaccttatcattaggctggccaagagggcttctttctgttcctgtcacagtactaggctgtatactcattcaccctcagttcccttttctggtatatttcttaacaaattatttccctctttccactatttttaggggtaacaagtctaagatatttacatataaatggctctcccttttcaaacccttttctagcaagcactttctgggaggacagtgtcttaccaggatcttctgtcactgtggtccctttgagggtagaaagaatagattgttgtgaagtcttttgtcagcctcttcatggttataaacgtacttagttttccagactatgtaggttttagacttcaagtgaaaagagtatacgttgttatgcagcaatagaaaacaaaacaactaccacaaaattgtattttttctccatccagaggctttaactttcaacatttgtatatggaggcaaggctgacagccacagcagtaatttcatgatggctgaaatagctgtgaactgtgcattaacttgttccttctctcttaaattctgctgcagtgttggagcagggaaggcgagcagaggagtgatgaatagagtagcaagtgggataatatacaataataggagatacacaataaggattaattaggtgtcaggctaagtatttcatgtgcattaactaatttaatcctcagaataccttcaagatattcagattctcttattatcctcctctttgggaggcaactgaggctcagagaggttaagatacttgccccaaataagtggtgaaggctgggcacggtggcccagcactttgggaggccaaggcaggaggattgcttgagcccaggagtttgagaccagcctggacaacatagcaagaccctgtctctttttttttttttaaagttgtggagctagagtttgagcacctgcatggaaccactaagctgcattacacctgcctcaggtggttgatatgaagaaaaataaaaatttttcagatggactctgggtatttgccttttaaggctatatgccttttaattctgatgtaaagtggtagagaaatgattaaaggtttaagagttgatagggccctgggtagcagggacactttacatgtgttgtgtgtgcatctgcagcagatgacagctccccaaatggacatgcctcccttgttcaagaaagcttgtcagggtggcaccaatttttttttagcaatttaatgaatgaggtatcaaatgatcacataatacaaatttgattgatctccttttggatatatctccccttaaacattgtgctggctacactatccatttctataatacctttgattttatcctctttactcctaacagtgaattcctaggtaaagtcacaactgaatttatcagcacaagcatgctgcatcatgttgtacgttctgcaaacagtaacttgagatagtgtgtcatttcccagttcttaaggctgtggcctacaccaatggtcttattttcccttttgattttttcaaaattaactgttattttgccaataagtttaacatttcattgcagcaattattacgtgtctggggttatgcaacacatgggatgtgcagaaataaaaagatagtttccctgccctcaaggagcttgtcttataggggaaacagatacataaacacttctagggcacacagattttcatgtatgtgtgtactatggtgttaatgcagaattctgtaaaggaataaagcttccatgatcaaagcaagcatgggcaaatgcttcacatctttctgcctgtgttttgcgagcccattctgtttaatgtggacttgatttaaagtcgacctgcagtcctggacttcaaccaaacagccattatagtaatgaacatttaaaggagttatttttccaaagcattatagtttttcacatccatcttttcattccctcattagctaatgatgttgatgtcctcacaagcattgtttaggaatggcttaggaattttaccgtatgtttactttggcttgtctgctgccccttgctttgtaatctgttcaccggtgattcagttgtttctttgagtccctttgaaattgcaagttgacgggtggggactggtggggaaagaaatccagaatagatattcctaaaactgtgaagtgaaaattcaggagagactgtcataactctgcttatttaaggtggtttggtttgtgccaagctaaaggagggaatattgattgaattacttttttaaaatgcaattaatttttatttaattgttttccctggagttgtggggttgaggtattgcagtttaaagcagtttggatgtgctgataatttttttctgattatcttcaagtctccatggacagtgtcactgcaggtctattcatgctttcgttcctcctttacctgccttcatctgctttctctgggcattggtacccatacccaggtgtggtcagttggagtaactcctgccttgctgggcttaactgtggtgtttctgggcctaaggcaattggaacatctgtagtttatttcctaatcccaattttgtggaggtttgtgttctagctttgattcaattactcctaagtagtggcccgtattaagtagaggctgtgtgagacaagacacttaatgtaggccccttggagctgctgggtccttttcatcagaatttggctaatgatgcctctctcttttttacacactaaagcctaatataactagtaatgaacctcattaataatttgtattggcagatgtgaggtgtcacacattaaaactgttttacaccatgagcattgacttcattcggtcagtgagggaggatgcaaccacctttgccaaaataggaaggaagagaagacccagagttttcagggaacggaattaaatagcactttaacaagcttggcggaggcagtggggtgaggagaggaagttaataggcctagggaggagagtatctcactggtttctccaagctgattcttctgggtgccaagagagctgtggaaacccacagaggaatgccccggttcctttccttccttctttctggtaagggtttagatctatttatttgatggtcagccttccagttttatcagcaccggtctctttgtacaacttcccaaatgtacaaactccagacagatgagtacagttggtgttttccggggagggtgttgctccctgtggtctgtcacagccagagagcagggggccagagagaggactgattgcccatatgttccacatgagtcgtcagtggtgcacccagttttaaaatgctctgggggtgtgtggccatgaagtggattttgaatgaatagaaggaaaaagctcgtggatgaaaaccatgagccatttgaaccgtgtgtggtgtctggaaaaacaggtggtctggcaaaactgacaaagtttgcttggggaaacagaagctttgcctccacctctgatgcttgggctgggatgaaataagccacttttctgtttagactgtgtttagatggagggaagcttcttcagttctttattgggtgcagtgaatggcagaacttttattacttgcattcttaattttagttagccatgctgagctgggtttacacccaccttggtatgtaatttctgtgacctgttccgcttccttctctcctgtcacagtcaccaaaagccactatgggtagccatttgttaatatcacctttattaggagtcctccaggctcagttaaggtctccctccatctttccacccccactattttatgccttcgtagccactggcactctgccttgcggcacttgcacatatttataatcagtgagtcaccctcctagactgtaagcaccatgagggcaagatctgcagcccaccagcagcctctgcttccagcacagcacttggcacacaggaagcactctcttagtatttgttgtacttgtcagtgtttgttgcctgaatgacacagaagtgttccctgctggagaagggattcgagttaaatggaatcatccagagaatttgataaaatgatgatggctatccgtttatgctcttaaaagtatgcacttgagacctctaagtagatgtttatttgtttatctctttccagggttcatgtgtttatcttgtttccttttgtatgcattttctgctttgcccctcacatagtaattcttggaagcaagtagatcattgtttccatttcagttgagatcactttaggggcatgtcttggacttgatgacagatcttccactatcttatgctccctacctcacatttattgagtacctactatgtaccaatccttaacatttgttattccagtttatcttccatcagtcctgttgaggtagatattgtgccccattttacagatgaggaaatcaaggttctgagagattagataatttctaggaacatacaaccaataaaagggaaaggaagagtctgagttcaaacccagttctttggtgctaggggtacagctgctgtctgtagggcatgccagatgacacctttttgactcttttggtaggaaatggggaggaatgcttgtcaccttagaaatgctgttcgaggttgctcacacctgtaatcccagaactttgggaggccgaggtgggtggattacaaggtcaggagttcgagaccagcctggccaacatggtgaaaccctgtctctactaaaaatacaaaaattagccgggcatggaagtgtacacctgtaatcccagctactcaggaggctgaggcaggataattgcttgaacctgggaggcggaggctgcagtaagctgagatcatgccactgccctccagcctgggcaacagaacgagactccatctcagaaaataaaaaaaaaagaaatgctggtatgtccaagtctgtgttcactcttatgttcatggttgttttacaaaagctgtatttagcaagcactcaatggcaagttatgccagcactgtgcttggcataacttggatatataggtgaatgaggcagccatacagagaaatatgacaagagtatgttttaaatgccccaaagaaggtttatggaaggtgctacaggaatgtggagctgggaaaataaccatcatttatatagcgctttatatgctgtctcttgcttttatatttgcccccattgtattgtctttctctctcacctttcctccacgtctcctcccctctccggaatttcaggatttggatgcatgtgtacatttaagatttgttctaaatacttgaaagcacgcttgcttgttagttacctgtccaaagcctgttgactgctgggccccagaggaacactagcatgtgcccttgccccgcctgtttctttgtatacaaacagtatacaaaacatagagaagagaactgacagatatttagatctatgggcttttatagaaaataagaattacttttcttctgtaaggtcagtgtttacaccttgtctgcttgctccatactcctctagagactaaaacacctcattgcttctcagaatcatttctgaaactgaggctagaaattacaacagagactctcttctcacctcttcaccagcatcccttgcctcttaaagtcactgaaagaatatcccccctcccccatggaggggtcataacacttttttgtctgtctattccaggaagctcgagtgctttacaacgctttacccagcatccctgggggcaggatcggtgcatgtagatgtttactgtgccaaccccttaaaaggccttctcttagcttagaccctcatctaacccagactaataataaaaagtccccaataactttgctgttatagatcttacagtgctcagagattggccctttaatatccatggttggcaaacatttctgtagagggattgtaggttattttgactctccttgtaagtgccagtttgtcttaagtggcctcaatcaaggaaacaagtagttcggctgcttcctctttatggcatccttttgatgaagcaccacttactttactttgcatattagggtcccaggatacatgggtacatgtatttttaatctatcaatcatttcatataacgttaagtagaactgatttaggaaattgcagaagtttcataaaaagatactctactaaaaagctttaagagagctattgattcccaaaaatagttgattgggccatagcatcaggtgtgctgatgcagaaccacatcgttgtgatttatttctgctgtctttgtgaggggatggaggacacaggcttctggaagaacatgtttataagtcttccttctcccagatggcgcttccagctaaggtcctgcagagttgcattctgccacccttcctggagcctgagagatgggcgaggagtgcaggtggtggtgttaggtggtggcatgtcaaggaggcaggcaggaaaaggcagactgatttttggtagcattagtctttcttctgtccttctctgcttttctttattctgaattttaagatttggatgcatgtgtacatttaagatttgttctaaatacacgaaagcacgcctgcttgttagaaggacatatttgagggaactaagtggtgttcggaggcacagtgacgattcgagagattctggaggacgcatgttgggtgttggtggttttccagttggtatcatagtgtcatattctcttcaattgtaggtttagctctttgggacccaaaaagacaagattagtcaggatagtgacatgcacttggcatgctgtggcttctgttgaggaaaaagtgacccaaatttgaacatccaacttcaattcttagtaattggcaatggctccttgcatctctttctgcttgactataaaactataaaatgctgctattaactttgaaggctgccacttacaaggctaggtgaacagacttttatattaacaactcagactaaccctgggaagcatctgtgctccctaacggagaagttgctttcacgtttttcacggtcaacctgggtggccctcaccatcaggagtgtggaatctcaagagtaacagcacaaaggggtggcaacttgaacccctgggttctagtcccaggtcagctgctaactgctgtatgaactcaaggaagtcatccaatgggatcatcttttgacaaaagaatcaggccattaatcaccaaggtcttttccacctctgaattctgtgatctctactcttgtaggtttcctccctaataatttctgtaggtctgctttttgaactatttcccttatttatcctttccttaaaatcaggtttgttctcattcttctggtcccacccacatccacatggctgttaaagaacacagtgaattgatgcagaaagatgtcccagatataggccgggcgtggtggctcatgcctgtgatcccagcactttgggaggccgaggcagatggatcatttgagggcaggggttcaagaccagcctgaccaatatggtgaaaccctgtctctactaaaaatacaaaaaattagctgggcgtggtggtgtgcacttgtagtcccagctactcgggaagctgagacaggagaattgcttgaacctgggaggtggaagttgtagtgagctgagattgacagagcgagactccatctcaaaagaaagaaagaaagaaagagagagagagagagagagagaaaggaaaggaaagaaagaaagaaagaaagaaagaaagaaagaaagaaagaaagaaagaaagaaagatgtcctagatatattgttgagtgaaaaaatatactaacagagaggcatgcctggtatgacctatttctgaaatgagaatgataatagtatcagtataggcctgcatcgttaatttgaagcagtttaagtcagatgtgtttctgaattcaggattttttcagttttacataggacaatgtattaaatacatttactattaaataacacctccagtgggggctggggtggcatctgtaatcaaaaacattaatacttctgtggcaaaacatggatattcacactaagtggggtaaataaagattacacattgccttatgtcagttcaggtaagattttgacaacaaatgttacaaaatttgtttgggttttgaaactttttgaatattgggattgtagataagagatcgtggtggacctgtatagccaaagtggggaaaaatctggaaaatgaagcatcgagcacttagcaatacttttcttgagtggagaagtagggtggaattatgggggactttcatttcccaagttatattctttactagtaagcatgtataattttataatcagaaaaaatgattaaagatacttatgagatataaagatttacataaagtagctggaaacatttaaccaatctgtagctgtttgagacttatttatattaggacaactaagacttgttttctcaatttttcaaacttttgtaatgtgattatatttcatacacacttaaaattttttgtaggtgatagtattgggaaaaacgaaaaggaatatgtgatcgtaattaaaatgtcagtggataaaaataaggcccttggagtaccctgtgggaaatcaggagccacttcctcctggatgctttatgtagcacattatactgacctattaaataatgagaatcaggctgggcatggtggctcatacctgtaaccccagcactttgggaggctgaggtgggaggatcacatgaggccaggagtttgggaccagcatggacaacatagcaagaccccatcgctacaaaaaaaataaaaatataaattagccaggcatggtggcacatgactgtggtcctagctacatgggacactgagacaggaggactgcttgagcccaggagtttatggttacagtgggctatgattgcaccgctacactccagcaggagcaacagagtgagaccctacctctgaaaaaataataataagaagaatcacatggatgaagcaaatgatgataaccaaaatataatgtatgggagatcactttataaagatgtaaggctatacaataatttaacgtgtttttgaagtaacattgcaattcctaaggggaccaaaatgaatggttggtcttaatgggctttgtctgaaaattgactggaacaattgcttccaaacagaagatacttggaatttcatatatggaatatagatgagatggttggcatttgaccatttaattttatcagtcaatataaaatgatctatattattcttaattttcacacttttccatatttctaatcctaatatactcatttgttgccttttcccacttaattgtataattgcagttcccatgttgcttataatagctgcataatatttcagtcactggtttacataatttaccatcttcttattgctgtttctatttgtgtgtgtgtgtgtgtgtgtgtgtgtgtgttacaaataacacttccgtacctatagctgtttctttttcttttcctttttttccccctatatttaggggttgttttcttagggaatatttttttctgaatgcgtgaggaacttaaagtttattctataagcatttattcagcatctactgtgtacagggccctggagatacagagatgaattttagaacctgtgcacaagctgtctccatttcctggactctcttcctccctctcccttcacctgacgaattctccatttaaatcccactttgccaatgaggcctttatgtattccccagagtattttaggcttttctgtactttttcttctcatttagtcacagttatattgtgtacatctcagaataactaagattacttcatttttgccttcctcattagactattaaacagtaaactctgagaacaggttttatgtctgatttattttccttggtaccctcagtacctgggacattatgtctggcatataccaggcacagaaattcaaatgagtacttgcataaatgaattagatgaacaaatatttgaatatgattcttgccttgagaaatttagattagaactgaaaaatggattcaatggataatttcgatgatgtgtaagtgctttatagaaaatagaaaataaaccttttcctagctattatcttttcctcctttacagtgaatcccttggaagaggattcaattccagcaagtcatttaatgtcttacttttgcccatactctgcagcagaaatgggcttgtcttattttctgctaaaactgttgcttttctatgcaaatcctactttatttctcattgcactgaacaccattatcattcacctttttcacttctttttgacatgttggttatctttgttttttttttcttattattaaaaatcctgtttcttcagcatcccctttttcctggtcttatctgatagctgtacctattctgctgtttatgaccttttaaaaactgttagctccttgagggaagggatagtgtgatcttttggtaggagactttaaaagatccactttcttatattttagtgtatcccttgggtcaaatggaggatttttttttaaaggatgatcatcaaataaatattttaagtaatttgaccaaaatttatcttcttacctttttactaaaaatatacactaaataattttaagggaagattttatagtctcatattcaacatggaaatttcttgattagtattgccctgactttattggttgcttcacgggtggcttctgaattcatttcttggaatgttactattcagggccaactttgttagtattgctacgttgtgatttaattttttgccacttacacattctagccagtctggaagttctccaccaaaacacctgtatagttcagtctgaatttagaagtgtcacttgcaagagaggcagcaacgtcaggcccgtgagactcaagagaagtctctttccatgatagatcttcttatacttggtagaaactggcaagtgactcaccaggggtggaagcctggaaaacagcctgccgaggagggtagtctttctggtaacacatcgccacccctttgaagcatccagagaaccggaagagcaggaactgcctgtcagactgactgagcgcttggcattctttcatggaaagatgacaactcatccagggtgaaagaggaagtggaggggggtggcagggaacaggagggtgaccttacatttccattgttttgcaggctgcctggtcgagtgcagtgggttgtttgggggttgggaggaattggaatcatgtacttctattgttgctgtccaaagtggatgtcctgtgctgtgttgccaaggaggggagcttgtacccattttatccttgtgctccttcgtaatccagatggtttgtgatctgatatttctttcgtgcttagccctggactctatcggttagaatcctagtatcattttaagaactgggattctcctatgccaaatttctgtgaaatctgagagccaacagaccgacatatttttccgggctatctctggctttgacaatggcatattttgagtgtcagttgatttttgtctcagtttattggcttaagtagtaagagtcaagggattgaactgcagcagtagtgttattttgataatttattaagtgttgtcttgggagatcttggggggaaaaagagtttagtttagttctttcttataggaaattttgttttgttttgtttttgagatggagtctccttctgtcacccaggctggagtgtggtggcatgatctcagctcactgcaacctctgcctcccaggttcaaacgattctcctgcctcagcctcccaagtaggtgggatgacaggcacctaccaccacgcctggctaatttttgtatttttagttgagacagggtttcgccatgttggccaggcttgtctcgaactcctgacttcaggtgatctgcccgcctcagcctcccaaagtgctgggattataggcatgagccaccacacctggccttatttagttctttcttactatggctagaaccctcccaagagtaaaataaagacttcagtggacaaccagtggtgagttcactttctagagaatggcaagtcatcggaacactggtcagtactcccaattctatggcatatctgcacatctgccatctttggtcagcaaccctccaggactgccttcttcacacctgtgcgtgaacttccaagctatactgggcaggttggtgctgcccgtttctcccatgctatttaacgattactccatgcagttactgttcttcttaaggcctctccacccgcctcactcttttaacatatgactttgtatctgactttactaagcaacttgaaacttcttagaatgagctcctccatttcctgtcctgatgcctgcaaacttatgtgtagtcacagttatcttcatctggttttctccaggggtatcccatctgctcctgcatcctcctaggccttgctctgttagtcattgtccctccctctctttctaattttcagccacgtttatttactgtctgtttctccctccaatgtgttactgtctctttctccttggctgtcaaatgttctctgcgtttcccatttttgtgcttctcgtacctactaatgacttacctatttgtcaactccagtggacacgctatagtccttatctttctggagcttcttcttgtatttaacccaacatatccactctcttctctagaagagtttttagcttctgcaaccgtccatgcttctgttctcttgctgcctctatgtcttgtatctccttggtgggcttctcttcctttgtccacctgttactgttggagtttagttctgggagtgttgcttttctctcctcatatatactctggccttgggacttcatctgctctctaggttttcactctctgtgtgccagtgattcccatgtctctgccttgcactgcctggtgaccagattctgctggttgtcatgtgagtatctgaaagcctccttaaattttccaggagctgaatgcatgaccatttctcctaaacctccccttcttttctgaatttagagaccatattatatatggtggttaagattagggctctggaatcagatttggatttgaattggggctctgatacttcctggatgtttgagcttgaacaagtcacttaattccctgaccctcagtgtctttctttttaaaatggggataaaaatactatccatctcagaaattcttatgaggtagattgtaatgcatttgtacagtgcctggctcagaataagactggaataaatgttagctgctgctgttctctttcagtttccctcatccacggagacatccaagccagaaacctgggagtcatctctaatgccattttcctttagctccttaatgcctgttttctttagcttccatacatagccagttacccagtgtggctgatttctaatcactgtttacttcttccttctggacatttctgagttttcctttctcttgattcccattaccactacctgtgtgaggcctttatccttactttccaagatgaagccacagcctcctgcctcctttatgttcctgtgatcctccctccagtgtgttaccaggctgcctctctgtgtctaacagggtttccaccctggttgaagccctcttgtgatgctccattatatgcaaatcaaaggccaatctccttagcatggtattcctgggtgtcctcctggcccttggtggcattctagcctcccttttaccacttcctgattccggcttcatccttgagcaacacagtcttgctgtgttccctgtgcaggccctgctctttaggctctttcccacctttgttagcgacactgcttggaatgctcccttccctgcttttgacttagtaactcctcatcctgaggactcagctcagctgtcacctcctccaggaagccttctctgacccttccaggataagttaggtaatcttccatagagtcctgtcattctctgtgcccatgatgcacttaccacgttggatcataatctatttatgtgtctttcctcccagcctcagtcctgaagggcagaaaccatgtgtcattccacctcatatttttgtgcctagctggatgcttgacatgtagtaagtgctcatgaaatgtttgttcattgaataactgaattcaagaaccagtagacctcaggatgaccctggtttcctgtttctgtggaccacaatgctctggggcagtgctgcgtatcagaggttcaagccatggctggagcagccacccctgaagtagacaccctaatatccttcccactgagttcctagttctacatgctggagtgaggctgtcaactctgaagtgtcagagtgtgtctgaaaatgattgctgtgaaaaataaaatatttcacattgcaggcctcatttttaagttatttttcccagagaacattttcatattttagaacttatggtaatgttaacactttctatttgcataagcacttccctgttgggagatactgcaggtgtaagtttttctgaggagtgtcataccaccatggaactattttccatcgatctggagatagggaacttcttgtatactctgagagagaacttctttgagatgtaaactagactgacctactttagaggctgcctgtatcctaattttctgttttaaaagagtgatggctgaacactgaaaagctcgggacattttagaactgtgctgcccaatatggtggccactagccatatgtggctatttaagtttaaattgaattaaaataaaatgaagtggaaaaaattaagttcatcaattatattagccacatgtaactgatgactagtggctacctaccatatatagaacatttctattattgcacattattctactggacaatgctgttttaggatgtagaagtcctgatggataatatcaaagccaccttaccacagacagagttttacagagctgtgaagtaattcttactgggaacaccagatacttacttaccattttatatagcgtatgtggcattctctcatcttatcattagagcatgcctgtatctttagcgacaatagcattcaaacaccaaatgttatattgtctgtctggaaatgttttcttatacaactcaaaggggaagagaggaatatgtcgtgagtaaatggaattatttttctctgcaccacatcattataaaaactcgaagaggttgggtgcagtggctcacgcccatgatcccagcactttgggaggccaaggcaggtggatcacttgaggtcaggagatcaagaccagcctggccaacatggtgaaatgctgtctctactaaaaatataaaaattagacgggcatggtggtgggcgcctgtaatcccagctactcgggaggctgagccatgagaatcatttgaacatgggaggcggaggttgcagggagccgaagtcgcgccactgcactccagcctgggtgtcagagtgagactccatctcaaaaaaaaagaaaaaagaaaaaagaaaaactcgaagaggctaaaacgtatcctggaactaaatatttacatttcttaaagccatgtgtgttttctttggatgaaaggataacaaatgatttgtatcgttggataatataaaaacacttcaaaaagttaaaattgaaagaaaggcaggatcttctacttttctttattttcctccccagttacccaacccacttggcttccaggagcctgagaagttgaagaagtaaacagaggtttagttcagctgttaaccatgctaggaagttctagctatctggtaataccatggaactcaccagaatctttcatcatggaccagctgctttttacacttggataccagtaccctagatggtgggagagactggaaggatcgttcaggtcaggggtgatggacttctgcagtccctctcacatacactgttcaagttacctacagtagctacgcacggaaagtagggtgtgagtcattccatgattgacaaccccagtggaccacaggtgactcccacctgggtggcttcgggaactcagttcagaggctgcagcaggtgggatattttttggattatggagagctgtttgatttcacatcagtgggttcttccctcaaccttgttcagatcagtgcctgagtaagttctaatatattaaccttttctgagagaagagatgtgaggatgagggtggagggtgtgaatcttgttttttcaccatcctgttactcttctgcatgcggtgtccccttactgaggaacagaatagaggagctgtaagttggggtatagtgtggcaaggtttgtgagagacttaagaacaaagggtgtttatcataggtaattatcacagtgttgttagagtgtaggcagagcagctttctaaccaacattacaagtttattttgctagtgaaaccttttatttaccaatgaagcattagaatttcagagagttaattgtttgtgaactttgttcatggtctttctgaaactttcaactctctgtttagttacaataaggctcattttatagcctttattgtcctcttttgagaagaggcagtataggtagataggaacatgggcttgggatcagatagactgggaatagaaatccatgcctgacgcttggacaaattgtttaaacttctgaatgttaatttcttaaccagtaaaatgggaataataatgcttaccttacaggcaaggggacaatttctttgtgtggaataaaaaaaggaaggtaagctgactcattttcagaaagatctttaaaaattaataaacatgccatattccttaatcttatttatgattacatttggtttatttaagttttaccatgcatatctacttagtgttatcaaactataaggaggaagggctcttggtaaaatcagtgagataatctcagagtctgtgctcttaggaaattaataaaaaaattaaatctgataaaaaagatctgttttaatagcaaattcctttttaagactaattgctgtattatctaaaaggaaacaagctgagtgcagtggcccatgcctgtaatccaaacacttcgggaggctgaagcgggaggattgcttgagctcaggagtctgagaccaccctggtcatcatagcgatatttcatctctatgtttttatgttaaaaaaatagctaagtgtggtgctatgtacctgtagtcccagctacttgggaggcagaagagggaggatagctttgagcccaggaattcgaggttacagtgagccaagattacatcactgcattccagactgggcgacagagtggcatcttgtcttaaaaaaaaaaaaaaaaaaaggaaacaaggggccaagggaaatggggagactaggaaattcaaaggattatttattggcaaacagcaaaacccttgattatttgaatgttttgctattttgagtaatgttatttactgattacagtgcagtctgagtaataacaaatccatcatccagagagtttttgaggctagaccactcagttttgactgttcacatacattattacatatttgtaaaagttgagtttcatgtgactgacacagaagaggtggagtaatcaaatgttcctctctaggatactatgcagtgatcataaggaaaggaaatgaaggttcccttttccctaatgcctatattgctcaggccagcactcctgaagatgcttgttctgttgaagctccataatgtgtcgatgaccctctttgcatctgaggctgggttaatccccagaggtacaaagacaagtcagggatggcatctgtcttggagatgaggttatcctgaaggggatgtggacattggcacaggggatgccagtatcaaatgattggtgttgaacagggagctgggagatcatagaaaacagcctcttccctcatgtgagaagaagggaggttagggcaagacttcctggagaagtcgcctagacggagtcttgaacaatgggtaggacttagatgatgaacgggtgagagagaaggaggaaggcattgtaggctaagggaacagcatgagtgtcagtgcattaaacagtctgtgtatgcttgcaagggcaagcctttccatgtcaatagcatataaagcataagggtgggaatcaaggactataaaggggtagttgggggcccagccatgaaaagccaagtatactctatgaaggcttagagcatatgcttctagctgatggggaactgttgaaaaattttaagcaggggtgtaaatggccagattttcctggtttgctatggcagctcattgagtcatagatttgtggctggatagcaggaaccgatcatgataggctcaatgtgagatgatgaatatgtgtaagaaagcagtgaaagtcagggctggagaggagaagatgggtttgagaagtacacaagatttggagttgatacaattttgatcaactggctacggggagtggatgagatggaagagaccagaatgacacttgaagttctggtggccattttgaacctggggaatataggaggaagaatgggtatgtaggggccaaggtaatatactgattttaaaaagtgtccatctggcaattgaatgtgagtctgacgctctgggaagatggcgtctggagatgggaatctgggagccatcacctagaggtggtagttagagccatgtgagtaggttggtgcccaaagagaactctgaggatgaagaaggcaacgggcaggggatggagtccaagggaacaccagacagaagtggagggatggagggaagaggaaatttctagaaaagactcagaagaatgggtctggaggtagaatctgtggtgtcacagaagctggggcaggggacagttttatttttaataaaaattttttacatatatatgtaaaaatatgtaaatatataaaattttatatatatacgtgtgcatgtgtgtgtatatgtgtgtgtgtatatatatatttgtgtgtatatatatatttgtatatatataatatatatatatatatttgtgtgtatatatataaataaattgcccaggctggttttgaactcctggcctcaggcgatcctcctgccttggcctcccaaagtgctgggattataggtgtgaactaccatgcctggcctggagacacttttaggagatttatagctgagatagctaacccaagtcacccttagtatttgatgaagtagcaggcaagatagaatgggattgggaacttgaagagaatggagactgtttggaatatcccagtcactgaaggaaatgggagatgagatgattgaggaaaagtaaaagaagtgtgaagagatgctgaggctcagctgagattagaaactgaatttacagtggcccaagtgtgtgtggctccccagcctgtgtgtcagaggcagcagatactgagactggtccagggtggatttttaccagtcagatgtggcagaaagaaggtgtgaggacgtgtgtatgtgtttgcagggggtgcttttaagaataggaatggccaggtgtggtggttcacacctgtaatcctagcactttgggaggctgtggctggtgaattgctggagcctcaggagttcgagagaccagcctgggcaacatggtgaaaccccatctctaccaaaaagtacaaaaacttagccaggtatggtggtgtgtgcctgtagtcccaggtactagggaggctgaagtgggaggatcacctgagcccagggaggtccaggctgcagtgagccatgattgcaccattgcgctccagctcgggcaacagggtgagaccctgtctcaaaaaacaattaaaaataaaaataaggaacaggaaggagtgtggctaggagggacctaagaggatagaaggaagcagttcgtagacctggatggcttgtatggttaaaaagcagatgtaatagaagggcaggaggcggtagggtgatgtagtctccaaggtagagcagtttgagggagtggccatgggaatggctgagagaagtggcctggaagtgaaggccagtgaggtagaggatagcccacagggaaacctttgtagaaatgggacttttattccacttgtaagattcacactgaattatagcattggatgtgtagaataagaaacttcattttggtgtttgagaacacagtagataggtgtgtgtcctaaatgttttgagccatatgcaggggcaggtataggatagtgtatctgaagatgctgttgggattctattgtcatttatttatgatgtggtaaaaagtctgactttgtgtctctttaaaggaaagttttgacaatgaatataacttataataatacttttatgtatttacacttttcaaagtcatttcataatgtttgctattcagtttagtttagtggctctgggtaatctatttaaagtccattttcagtttgttagtttctgtagactacaagtgtagagggaaaatgtatttcacgtatttcactgggtaagagaatggattattagcaagaacttaaatctaaaatttaagcagtttctagtgctgagggacacgatagatttatgctgaattgtatatttctgtatttgatttttttttaaactgcaggcatctgtgtcttccaaggtgagaaaaaacgttaaaacatatcatgtattttctggcctcctactatgtaccaggtggtatgaggacataaagaggcagaagatacgattcttgcccctagatagcttcacatttagctgaagaaacaagacataaacacaggaaaagttagctaatcatgcagggtttaaatagcaaggcatgacatgactaatggggagatgcattgtttaggcagtaattcctacaggagttcagaagaaagagattattttaggctgtgacagtaaaggaagggtgtaaagacttaaaaggagaaaagagaaaaggcttatgtagaggaactgaaacttgggaatgactgaagccttgttctaccacttatgccttaccttgtgcctcaatttcccaatctgtataacataatgatgatgtgttacctcccagactgtcagaagatgagacagtgattgcagaaaagctctttgcaaataatgcctggtccctccatactgtgtagacagtaaaaatcgtacactttttgaaagtctttgaaaatttaggttactagggtataatttctgtcgttcaagtttgccaagtaggattttttaaattagcatattgccagaagtttgactttcttctttttcccagtaaggagagatttgtaagactctgaaaaaattttaagcaagcaattagacacattattactttgggaaaattgcttttatggccaggcatccttttctgtttctttatttccttgagcaaagataatgattgataaggaagtaaaactagaaagaagccagatccaaacttagaaggaaaatattttgtcacgtatggaagttcagtggaggttgcaggttggctgatgaccactttgggtgaacccagcctgacactcagcattttggagatgatagtctcagagttcacaggtttcctgtgtataaggaaatggatgtcggtcatttcaactgtactgttaattgctttgggaaaatgagtggtattcattaggcaaggaagcttgtagccagccctgtaattaatgtgaaaccttttcatacagccagtggctcttcagcatctctgtactttatgtttatgtgtatacttaggcttgcttcagtggccagaggcttcaaggcattcagggctctgggggctcttattataatggtaatgaaaattggaccctagaactttggacctccccagccttaaatccactgagaggagctctctgtctagggatgtggctccttctgctggcttcttcccttctctaagatagcagtgagatgcactaaacatgagatttctaaaacaaatacttcgatgagtaggaaagtctgttttcctgaatatatccactttcctacatattccattgcttgtggaagcaatgacccaagggttatatgcaggactttttcttactttggcagactggagacccagagctcagagaaggcagaaagtgtgttaaagaacaataggaaaagtggtgagagacaggcagatgaaggaagcatgaactaccatcacagagaaagggtagagtcagcaggtaattctcaaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtgtcagaggtcagccctgatgtaattgccaccgaggtcaccgtggatgaggtcattgtgggtgaggttacagtgcaagagctgtcttttggtgctgttctggtcttgtgatttccctattttcagcacccagtaggtaggtgctcaataaatgtttgttggaggaatgggtgctggggccagccccctaactctggcctctgttggacgttttgtgacctggaatcattctagaaggaaagagactgcccagagtggatttgtgtcctgcttgtgactttcttggtaacaactacaatgaatatgctccccaggctcttaatctggagaactcctttttttttttttttttttaaacagtctcgctctttcacccaggctggagtgcagtggcgcaatctcggctcactgcaagctccgcctcccaggttcacgccattctcctgcctcagccttccaagtagctgggactacaggagcccaccaccacgcccggctaattttttgtatttttagtagagacggggtttcaccttgctaaccaggatggtctcgacctcctgacctcgtgatccgcctgccttagcctcccaaagtgctgggattacaggcgtgagccaccgcgcccagcctggagagctcttgatctgtaggtgaatcttagtatgagggccttggaggagcttccaagtgtctgagagcctcatgaaatgggatgcaaagttaggaatttctaaggagaaagtcagaggagcctctgattcccagccggctgctaagcccttccttaaccaaggttcaccctcccatgttgcctgctgggctgccttacagcagcctctagttccaacatctgctgtagatttctgacactcacagtctacccttcacctcttctctggctattaccagtacttcctcactatccctagtcatgggaaaaaaaaaaaagagaaccgtgtccccaagatgatcttgcctttgagccttgtgtgtttcctgacagggaaaaggccctgtactgccatgtcctcccctctggctgcttcatgccgggtcttctgcctaatacctgacacaaggagactcctccagactgaactgcgaggaaaggctttacaggcagaacaggctctgcagagttgctgctcagtaggccaggggtcagcagacttcatgctgtgtgccttaggccacatgagtgatcctcctgtagatatttcccatcagtgaaaacagagctggcactgatcacctcctctcttacagactgcggagctaaagtgggctgctggttggaatgtgctgtgaaagttggaatgtttttgcaaattttattttattttttgaatttgaagtagaaagctgtttgattataaatggtgacttttcccttctaaaatcatttaaaatttttgtaccctttgaaaatgacatttaattataggcactcaaagtgcagttgacaattattgttatttttggggaattgtttaaaggatgttcattcatgcatgcatttttttcattatttacttattcagaaagatgtggaagtctaatatgtgccaggcactgggaaacagtgatcctgctgctcatatttccattctacacccaagctgtgtacttggtcatgtggcttggatctttgtaaatctcctttaccctctttgccctgaagaacgttattagaacttggtatgcaaaatacaccattggctgattgttggaatacttttgagcaggtttgtaaccactttcagtggatgctgtgtgaagacccactaaagcagtggttctcaaggtgtagcttgcatcagtatcaccgggagggtttgttaaaacagcttgctggacccccatgcccagattctgtttcagtccctgactgcatttctaacaagttcccaggggatacttatgctgctggtcttggggatcacactttgagaacctctgcattagagacatttctttagacctaagggctttgaagtctcttctcctgagaaattggtgtggtttcattagggtttatcgtgaaccttgtttgtgaacctggttttctttttgtttgctttgcttcgcgtcagaaattcagattcaaatttgtagctcaactttaagaaaattttaacagttacatcttaacttttcccagccttgatttcctatttcattttccccattctgattttacatgtttacacaatataagttcctgtatactgactgttttgtggaatgtagtatatattgagaaatatgattgcagtcagtgttcttttcttggacatttgtctttcgaatcaactctaaagtattacatgttttgactgtttaatgcattagttatgggagtagattccccagaagaattatattattaatagcaactaaccaaaggattggaaagaaaaaattgggaagaaagtgacagaaagttcttggtaaaaaacagaactttatttttaaactattgatgcatagatagtatctacaagcagtaatacatatgcatatatctgtatgtttatatgtgtatatatatgtgtgtatgtatggttttttatttttatttttatttctttttgagacagagtcttgctctgtcacccaggttggagtgcagtggcgtgatctccgcctcccaggttcaagcgattctcctgtctcagcctcccaagtaattgggattacaggcgcccatcaccacacctggctaatttttgtatttttagtagagacaaggtttcaccatgttgctcaggctgcctcgaactcctgacctcaagtgatccgcctgcctcggcctcccaaagcgttgggattacaggcgtgagccaccgcacccggccatgtgtgttcttttaaaaactgagaaccctaatacataaacaatatactttctttggttgttggagaaaaagcgaagggatgaggtggtgatgagaacagtgaaggcaaactacagtggttgcccaactttactggagtcacctggagtttgttaagtgcgatgccagtttgctaggcctgggggtggggcctgcatttgtaataagtgtatcaggaaattctgacccacgagaggtgggagaggtttagcactgggtagaaaaatgaaaggcccaatctgtattaaacctgctccaaatctttgtatccatttttggatgaggagttcctgttcagattttctgcaacttttcctgaaatcagagtgtaatgggcacaatatcattcatattagtcagtcttagctccagaaagtactcattatgttagatgttcattggaagtagtttgtagctgatttttttctctttcttcgctctctgtatttctgtcttctacttctgtttttagttgaagagaagatactttaccaacagcttgtctgaaaacaatttgcagataggagtactcatagaaaactcttggggttctcactgtgggtcttctccaggggtgtggataacaccaaacactgcagtatggaaactagcgcaaaatgggatgtgctgtgacactggccagctggagacagttgggacaggggatgacttaacgttaacatgggaatgttacatacacagtctagaaaggccagatattcttttgcactgctgcctctggctctcttttcatctatttagtgaataaccaaatttatcacctgtagtaatcagttactaatttagaatttaatttctttaagagttacctggatttagggctcagtgaaggcagtttttatttaaaagcattttcttgaataaacattttagaacagttttagtattacagagaaactgtgaagatagtgcagagaattcccatatacccaacagtcagttttctgtattattaatgtcttaggttagtatgctacattgtcacagctaatgaatcaataatgatacattattactaattaaacttcatagtttatcagatttccttagattttacctactgttccatttctgtgttaggatcccattcaagataccacatcatgtttatatgtctgcttaggttcttctagtctgtgacagtttctcagactttccttggttttggtgagcttgacagcttgacaagtcctcgtcaggtattttatagaatgtccttcaaattgggtttgtctaatgtttttcctgtggttcaagggttttgggaggaagaccacacaggcaggcatagtaccacatttcattccatcatgtcatatcaattgcataattagcttttacatgcatacatgctatcaaaacgacctatcactgttgatgtgaaccttgattgcatggctaaaattatgtttgtcagatttctcacataaagttcctcttccccttctttccatactgtactcttgggaaggaagtcactgtacatagctcacactttagttgtggagaattatgctctacctccctgagggaggtagtatttagagaaattattgggaattcctctgcttgggagatttgtctattctcccccatttatttattctatcatttatttgtatcagtatggactcatgcatattttatattttaggttataatctaatatcacatgattgtgctcctcaaattgtttcagatttggtttttgggagctgtttcaataggctcctgtgtccctttgtgacatgccacccatcctggtgggtttttgttgttgcatgtgtgctttttaaaatcacatccttattctttctggcactaaaagatgcccctggctcactttgtatattctttgccccatccctagaatcagttatttctccagggaccctggttccttttgttggagaatggttttagaaaccaagttctgggcactgcgtgtccttgttgctactgaggtgtcattgcttttaggtctgttcagctgacggaacagagaaataggtgtatactcacccttgtatatacacatatctgtaaatatttctatatgtatccatctgtatctatattaagttgaacatgagttcatgctaatgttttcaactccgatacagtgttacagacctttttttactagcctttctcccttgtctgcaaactcctgctctaacagtgaaaaactggttcctaccacccaccatccatttacttacatgtatagtggtttcagaattgttaacttgtatcccttatgagaaagaactttattggctagagttcagtggttatgtgaaattcgttatgtaaaattcattttgcccttagatctagagtccatactcatttctgaaggtccttaagccagcatcttttccctcacttctttcagtgaggttatttcatgcattttgatacagttgattctcatgtcatagtctgcatttcatattccaccccaggatctcttgataccctaactttttaaattgcatatattcaagttctgtgtgctataaagttctatgggttttaacaaatgcttagtgttctctgtctaccattatagtatcatagagaacaatttcactgccctaaaaaaaattctctgataggcctcaactcatcatttggcttaacagtcctgctgagagagtcctgccagttgcatctgagagacagtcctgccagttgcacctgctgagagagtccttcagttgcatctgaaaccagtctggtttttaattttacctgatgttcagaaaatgctctcaggctgtcaccgggctgaagaactagttgggttgtagctgtggctgtgaatctggttcccaagaactggctgtattagtctgttctcacactgctataaagaactacttgagactgggtaatctatgaagaaagaggtttaatggactcacagttccacaggctgtacagaagcatgactgggaggcctcaggaaacttataatcatggtggaaggcaaaggggaagcaagcagcatgacggagcagggtagaaagagaaagggagagtaaaggggaaagtgccacacactttcaaccaaccagatgtcatgagaactcactatcatgagaacagcaagggggaagtctgcttccatgattcaataacttcccagcagcccctcccctgacaggtggagttacaatttgagatgagtggggacacagagccagaccatatcattccgcccctggcccctcccaaatctcatgtccttctcaaccaattatgcccttcccaacagtcccccaaagtcttcgtttttgtttttgtttttgagacagagcatcagtctgtcacccaggctggagtgcagtggtgtgatcttggctcactgaaacctctgcctcgcaggttcaagcaattcttctgcctcagcctcctgagtagttgggactacaggcatgcgccaccatgcccagctaatttttttgtatttttagtagagatgggattttgccatgttggccaggctggtcgcaaactcctgacctcaagtgatctgcctgccttggcctcccaaagtgctgggattacaggcatgagccaccatgcttggcctgtccaccaaagtatgaactcattgcagcattaatgagtccgcaatccaaagtctcatctgagacaaaggcaagtcccttccacctatgagcctgtaaaatcaaaaacaagttagttacttctaagatgcaatgggggtacaggcattgggtaaatgctcccactgcaaaagggagaaattggccaaaacaatggggctacaggccccatgcaagtccaaaacccagcagggtagtcattaaatcttaaagctccaaagtaatctcctttgactccatgtctcacatccagggcacaccgatgcaaggggtgggctccgaatgtcttgggcagttctactctgtgcctatgcagggtacagcccctgcgactgctttcgtggcgttgagtgcctgtggcttttccaggtgcaagatgcaagctgtcagtggatctaccattctggggtctggaggacaatgtctgtcttcccacagctccactaggtagtgccccaatggggactctgtgtgggggtttcagccccacatttcccctttgcagtgccctcatagaggttcaccatgagggctccatccctgcagcagacttctgcctggacgtccagatgtttccatacctcttctgaaatctaggtggaggctcctaaacctcaactcttgccttctgtacacccacaggcccaacactatatagaagttgccaaggcttgaggcttgcaccctctgaagccacagcccgagctgtacattggccccttttagccatggttgaagctggagtggctgggacacaggatgtcaggtctcaaggctgtacagagcagtgagggccctaggcttggcccccagaacaatttttctcttctaggcctcccagtctgtgatgagaaggggtactgtgaagatcttggaaatgccctggagatcttcccattatcttgcctattaacatttggctccttgttgctgatgcaaattcctgcagctggcttgaatttctccccagaaaatgggtttttcttttctactgcatggttgtactgcaaattttccaaacttgtatgctgtgcttcccttttaaatgtaagttccaatttcacaccatccctttcttcactcatatgagtgtacactttgagaaacagccaggccacatcttgaatgctttgctggtgaggaatttctactgccagttaccctaaattatctctctcaagtttagagttccacagatctctagggcagggccaaatgccaccagtctctttgctaaaacataggaagagtgacctttactccagtccagtaagttcctcagtctccatctgagaccacctcagcttggacttcattgtccatatcgctatcagcattttggtctcaaccattgaacaaatactaggaagttacaagctttcccatatctccctgtcttctgagccctccaaactgttccaacctctacctgttacccatttccaaagttgctaccatacttttcagatatctttatagcagtaccccactcttggtaccaattttctgtattagtctattctcacactgttatacagaactacgtgagactgggtaattcatgaagaaaataggtttaattgactcagatttctgcaggctgtacaacagcatggctaggaggtgagggggaagcaagcacgtcttatcatggcagagcagagagagagagagtgaagggggaagtgccacacactttcaaacaaccagatctcgtgagaactcactgactatcatgagaacagcaaaggggaagtctgcctccatgattcagtcacctcccagcaggccccttccccaacatgactggattacaattcgagatgagatttaggtgtgaacacagagccaaaccataccacgggcaaaaattgattttataagaagtgagagaatgagacaggtgaatattttgaaggcttgtgtggcaaatattcattagccaggtttattaaaaactcagctacttgggaggctgaggcaggagaatcacttgaacccgggaggtagaggttgcagtgagccaagatcatgccactgcactccagcctgggcaacaagagtgaaattctgtctcaaaaaaaaaaaaaaaaagctcataaatacattaagattttattcacagtgtggtgggtgtggtactcaaggcctttaatgggattttaataatccaaacctaattcagtctccagatgactgtgcaatataatggagataatgctgctttacttttccttactcagaaggtggttgtgaaggtctgctcagggtagccagcgtgcctttcccaacacccttctttctgttttgctggttctgctttctctcattctctaaacatggctttggtccttgattctttgctctttgaactgtacaattgttccttgagggtcagtcagctgtcttgtggttcagttattcctgtgtggatgactctacctgcagcccagccctttattttaagtttcaggtcccatttatctttttgtcacacatttctaatctccctacaaatcagtatttttaaaaaccagagtcatcccaaaccaactgaccctctagattgccttacttcttgcagatttagtcttaccgtcttccagatactacagctgcctttgggcttttcatcatcccttatccttagccaccaagtcctgctgagcttcttttgtaatacttctctcctgcctcctccactgcacacttgtaccactgagacagtctcttaattctgcccagcacctccagccccatctacacccctctagtttgtcctccagcatgttgttttaggactgttgctagcctaattatttgaaatgaaatttcagttcttaacttggcatccaaacctttcgtccattgcatttctagctttaccttctaatttctagctttaccttctaattcacttaaatgagatacaatttaattaaaccatgtattccttgcagcttctgtgctgttttccacatctgtctctttccccatgttggcagggtaaattttagaggtgtaatgaaatttgcaggtggaagttatggggatatagattgtctttagcttaatgtaaggatgacctttccaacagaattgctaatgatggggtgggtatcatggaagaagtctacctgtcatctcccaggtcatctactgtcatctcccctttaaagacctcatcttccatatctgcacatttggcttctcctctcttttgaagctgcttgtttccatgtcccatgatgctaaacttggggactcctcccacctctcagattgtattttctctggttctttctttcactcctttagtgaatttgctttttcttttcttcttttcctgtgctctttcttgaaaaatttcactgctcttagacttagtgtttaccttttgagaaaaattcccaaatgataaccccagccgtatgtttaactacatgatttgtctttatttccaacatcttgccagatatttctatttgagtacttttgtgtccaaatttaaactcatttctttccctttaaaacatgttctttccctgagttccctggctgattagtggcaacagagatgggcagatctttctgtaaagggccagagagtaatatttttgtcttcatgggccataaggtctcaatcacagctactcatcttgtagataatatgtaactaaagggttgtgactgtgtttcagtaaaactttacttatcaaaataggcagcagctggcattggcctttgggctgctgtttgctgaccctgatctaggatacccaggccccaaactccatactcctttggcctttccactgcttttgtttgctctcttcacatgattattaattttcactgatttcacccttagcaaaccattcatacttctagaccatagctgtctgtctattcattcatctagtagacaaaatcttccttttacatgttaatctctatcattttacataatcaaaaacctctagtggctccccttggcctgcaatctaaggttacagttctctgggtgtagctctttctgtgttttgcctccagccttctctcttactcctgtatggacattcctccaatgacactgatcaagtgtgtgttctgatattagttctatcacttctcacaggttgctcctgactcagaatggtctcacttcccactaattgaaacttgccttcaggcctcaattcagggtctcacttcccaggtaaagcttcgccctagcccagtgattgctcctctcctagggctttttttttctttttctttttctttttttttttttgagacagcatctctctctgtcacttaggctggaatgaagtggtgtgatcactgcagcctccaactccagggctcaggtgatcctcctgtttcagcctcccaagtagctgggattacaagcatgtaccaccacatctggctaattttttttatagagatggggtcttattttgttgcttaggctgttctggagctctggcctcaagtgatcttcctatcttggcctcccaaaatactgagattacagatgtgagccgccacacccagcactgaatagtgcttttgatgttgccactgacctattcagttgagaccgcattgggttgtaatttgtggtgttcctccctctccatctgaattttcagaagctgttaaggacagcccagtagatgctcagatgtcataggtaaaggtcatacattgaactctttgtctttcctccagttctgcttcccccttggagtccctgtctcagttaatggcaccagggatcatcattgccttgtgattctgactccttctctttcacctccaccctacctgcatcagttacgaaaagtccagctgctgctccctcctatgtctttctcctatctgccctctcctctccatcccttctactgctgccttagctcaggtcaccactgtctttcactcagaccattggacttgccttgaacatgaattcccaccaccagcttctctcctcttataatcccaacagttatgtatcgggatctgacatgtaggtatgaccttgtaactttcctgattgaaacccctcagtggctccccattgccctgggataaggaccagcctgccagcatgtcgtgaggccattattgattggatgcactttcctctgcagtcctatttctgacttgtctcatttacacagcttacatttgatcatctgtaacccctatacatcttctgtgcatttgcacactccccgtctctgtgtagatgccccccctccccaggtccacttggaaaaccatcacctgaatttctaggcattgtacaaacgttccctcttttgtggagctttcgtctccttccctccagaagaccaagaggagtaaaggtgttatcatagaataactgttgggatagagatataggcttcatctattttctaatgcctcctcagattcagagtcttccaaagtttccctgcagactgagcaatgaataattaagcaaacaagtctctaaaacatcttgaaatgcttatgtatgctaaatatgtagttttgagttcttgttttggttttgctggagcttttgccttcttcctccattacaatggatgatgagaatcaacaatgtagaattattctcggttagtttatatcttgtttttaacctggtatcttcagtgtgttaagacatttttcctttcttgtgggggttcccctgcaaagaaggaggctcacttgtggggccgatgaccactgtctctaggcaacccagagaggtgtgaaagaaagaagggggctgtgaggctgcagggagtatattccccatctccagccagggtcacacctgtcacttctgtttagtacctcttcctagtaaggagaacgtatgctccctttctggaagggtctacttagcagaaacgaggagtggcgagctcatgtggaaagtgcttttttgatgtgttctttcatgtaggggacacacggtgtggaggggatgcacaattactcttctgtggttcctctttcttactccagggtctcctttgccatgaggtccctagggacgtcttatcagaggagaagaaaagtaccttcttagttcttttttgttttgttttgttttgttttattatggggtttcactttgtcacctgggctctccggggtgcagtgttggaatcgtggttcattgcagccttgacctcccaggctcaagtgatcctcccacctcaacctcccaagcagctgggactacaggtgcatgccaccacacctggctattttttattttttatagagatgagatctccctgtgttgcgcagactaatcttgaactcctggactcaagtgatcctcctgccttggcctcccaaagtgttgggatttcaggtgtgccttggcctcccaaagtgttgggatttcaggtgtgagccactgcagccaaccccttcttagttctggagagcagagtcttgcctggcatcctggtgctataccaagagtcctctcctggtttccagagaggacatttgacttcttcaggagaactcaccccactccttttggtccattaggagcaccagaagctttggacctgatgggctgggcttggtctcttcagagcctctgtcctcattcacagaggaggtatcaggtaggccttccagcacagaattacattacctgggaatttaagtgggaggaattgcagtggagtattttgaagatcctaaggcatccttcatttaatttacattttcgattcttcagatattggaatcaaagattgagacacacacataacactagagcacacagtagaccatttctaccttgagctatctccttgttagagaaaaaatagttttgactgtttgtgattttttactacgggcagaaaaactttgaaaaattaatttcaatgtaaaagagttttacttttgccagatgataacacttcctatgctagaacctgggggtactgggatctgacttgaagtaattctaagtttaaatttatagcaaccatgtgggtctgttcagctgggaggggagaaatattgcgagccataaggatgtattttagagagtttctttagtagtcttcagatgtctacttgccctgtacaaagttcagaaactgtttaggacttggaaccttagaatatcagatagaaaaggattgacaggcttagtctactctgtttttgagatgccgaagccaggtgacttcccctagtggcaggtaggcaatgtcagagttgtgatcatggcctggggctcttttccaacctgctctctgacctcacataggatccggattgagcagggtaaagggtggaccagtaaaggctttaatcagtaaagtaatgacagtgttttccttcatttgaaaccagtcagatttgatactacttttctgttcagtttttgccatcattgttttctggaagtttttaatctgtaatacctcttagtatgctttaacacataacacctagtgtcattgttatagagatgaaagtagaaaattagcagggatgtagtatttgcctattgcaacttcttttcctttaaaccccttcccatgtcggggggataccttgtgtgtctgcagcatgtgatgctgactcggactctccaggcagctgactaacggcacctaaactgcctgctgcattttccctgccccagcacagacttgcttagcagctcccgcctcgggccctcattgagaaccatccagcggcacatcaggctggtgccactcccagtggccttggcagtgaggaggtgaggcgagagcaccctcaggtgctagtggcacgagtcttgcccaggctcccaggggaatgagtggtgtgatgacctcatgtgccagaagccagggcaggcatgcttgaggctgagagaaagcaacagatggacctcaggcagaagcagtcagagcagcctcaagggaggctggtgcggcaccagcgtggcatcttcccagcatctgaatgttggcttgaccttcgctgtttgtgtgacctcacccaattcagtaacctcactgagcctccctttttccatctgtgcaacggtgatggtagtacttcactctgcaagcggtggaggtgagagataatataggtcaagcatttagcagttggccaagctaaagacatagctgttgtttttgttattagaaacacagcctcagccaggcacagtggctcacaccagtaattttagcactttgggaggctgaggcaggtggatcactggagctcaggagttcgacaccagcctgggcaacataatgagacctatctctacaaaaaatacaaaaattagctgggcgtggtggtgtacacccataatcccagctacactggaggcttagttgagaggttggcttgagcccaggagatggaggtttcagtgagctgtgattgtgccactgcactctagcctgggtgacagagccagactctgtctcaaaacaaaaaaacaaaaacaaacaaaaaaaaacaagaaaaaccaatacaatctcatttttcctgttaggttattcatacaaacctgttggaattttttttctttaggaatttgaatgctcatttttaagccagacagtttcaggtggaagagaatcatgaaatgctttatcatgtttttgttatttatcgctagagtaagacttaggaaagctatagaaaagagccatccagccaagaatttgaattttgtcaacttctctattacagaggtttgctcaaagcccatagagtctagatgaaccttctacctttgcccccaaaattgcttttttcttttaatatgctagatccctttgcttattccaggctgaaatgaatgttatgtagctagaagtttcctgtctgtgatcaattctaatggcttttgtgaagggaaatggttgtaaattattaccagttaattaaatgagtgtttctcttgagtcctttgtgtaggcttttatccaagcctgtttagaatcatggaacattacagctagaatatttttagacaactcttgtttcatggacaaggagacttaaccagtgatataagtacttgcctaactcctgcaaagtgatgccaaggaaaagcaaactttggctgagggtgtaggagtggctgtgctggggatccggtgggtacatcaagctaacagagtataatttctaagcagtgagcccttgtcatccatatgtcaccggtattccttggagccatcttggagtgcttttattttttacaaagtgctatcttgtaggactattctatagtaaatattacctttcctatttttataggtgaggaaattgaggtggtcagatgaccttatttagctcttagatcaactcagcagatatgtattgagtgtttacttggttcaaggaactctgcgaggctccttgggaacataatgtcagatcctgctggaatggaggttacagacttattgcaagtgatgagatatgtgtatgaaaatgtaagtaattgttcaaggtatagataagtgttaataatagttgagatgtgaattttgagaccggagggatcaatgtgaatatcaaatcctggcaccagtttcttccttctgctgctcatgaagctgtgtcatcttctgtgctcggtaacccatccaacctgtagccctaggagctcctctggggagtcttgagtaccttgcagttgtcccgaccctgggagtcattcaataaaggttcaaatgaatgaatagataggtgcggtgaagagagacaggttttccaagcagagaacacggcatgagcaaatgtgtggctgagtgatagagccaggagaggggcctgactaggacagcaggttttaaaaagtgatttttttcttctttttgtattttaactttctaaagtgacaatggaaggaagggaattttgaaaacaaagtttggatagattagtgggaaggcagcaaaaggggagcccaagtggtcctgaaagccaggtggagcagggtgttttattctgaagactctcggagaccagcggaggctttagagggggaagttgatgagatcagcactttagaaaaggctgctttgtttttggtggggtgttccatgactgcaggagaaaggatgagggaggaggcctgcagtgacagggatcctagaatgatggagggaacgaagggaaaaacagatggtcacggtgcctcaagtcggagtggctccaggattttaagcctgggaacgcagaagaacagtggttctagtgattcagtgatgaccactggaagctttaggaggaaacatgggattggagccctttaaagctggaattggccccttagagagaatctggctcaggcttcccagatggtggtccgtggtctggctatatcagagttacctacagaacttttaaaaacagcagatgcctagaccccgttcccttgccccagaaaatttaaaatcagtagatcacctgtggggtctgggaatcttatatttaatccctttctgtgattctttggcaaagaagattgaatggccttcctgatgtcgcagattggtcaggacagagcaccaggacccaggtcttctctagcattgctattactcagccacaatgtgggagataggggataagttcagatggggaggtatagtatttgaggcagcgctgattcatgtgagttcaacactgatggctctttgaggaaggggttacttggcatgagaactcaagggttagatggctctgagggtgcacgttgggaatcattcagtcaagaaatgctttcccgagtggctgctgcaaaccaggcataggatattttcagtccacttcggggactcaaaagtgtagaacagagtagtagaaacaacatagagaaccctaaaggctgaagttgtgtttatgttttcttctctgagctgttttgagtaaatttaggtgtaagttacaatgtatgggttgaaattcattattttgggtatggatgtcccgttgttctagcaccatttgttgacactgagtttttatacttttgttcatttgtctatttgtatagaagaatcacatttttttaaagaccactgttatctgggtttcaacaagggcccaggagttgttctttttaccaagagaagtggtctgtaggggagggggttagtgtgtttattgctccttgaatgactgttatagtaagaatgctaagtgtgttcatttctatgtggggctgccctagactctgacctcagctctgttctattagacactctgtcagtgcattagccaatgacataggtagcctgaggccctgatttggggagccataaaactgagaaggggagtgaatgaactgactggatttgcgatccagtgaacgctatgacctgggacaagccaaaatattgcagaaaaaaaaaatgaagcacttaggtttttatgaaggttttgagcctaaccactgcacgagcacaggatgtgggaagcaaagccttatggcagctagaaaagatgcagaggttttagttcattgcaagctcagcctgggtcactggggcttctcagagcgcccatgtattctcgctgcattggtaaagggcactgtcactgtcaagatcaacgttaatgataatcttgctcttgctggtgaaagtcaggtcacacactcagcctgacttcaccctttaatgggggtgtgaagaaattggggcatgtcaggaggaaactgactagaatggtgaaggaggagaaaatcatgtcctacatgaagttgctgagagtttgagatacccaggtctattttatttactcatttgttccacaaaccattttctgtccccttatatgcaaggtagggtctcctttggggacagggcataatgactacaacatgatgtgggttccagcagtagtcttcataacaggtgtggagttgcccacctgtctgaaagaggtctggaaaggtccccctatacaggtgggtcttgaattgatggacaaataggagttggacaagtataaaaaggaagaaaggagtttccagccagaaagatcacataccccaaatcactaggcaataagctacagatgggtaatgtgtaattttcataattttgactatattccccagtatgctgcttgatccataatgcgtttggttgctctctcagaataaatgaaataacatacctccctggagagtgtacaagaattaagagatggggatactggttgtatgcagctgcagtggtgggaagagcttaggctgaaaggtaggaaggggtttagtgtctagggctatgtgctgtgctaaagaatttggaccttatcatggacaggagaggaaacactgacggtttctaagttaggaagccacatggtcagattttaatttttgaaacatgtcactggcagcagctggaggacagtagtctggaaatagaaggcagctagaagcccgttcagggaggccagatgaaccacggcagtaggagtggagcaggggtagatccaggagagacttcgagagtggacgtgttgggatctgagagcgattcaatgtacctgctgaggagctgggcttctggcgtggcctactgggtaaatacagggctcaggagtgagaggagggccaggaaagggtggtgtcctggaagtaaggaatgagagattcatgaagaggaagatgtcaagatcagatgcggcagagagatcaactgagatgaagacagacacatctttgtatctgacagtaggacttcataaaagttgctggagctgtttcagtgctggtgggaggcagggaggcagacggcaggggatagcacggatgttagaaggcatagagggatgtgataattgttgtcgaatatttgacctattctctttggctgacaatttgaatatgttttttgagtgcaagtgatagaaacccctactcaaactggctaagacaaaaggaatttataggctcaaataacaaaaaaaaatcccaaagaatcaagcaaggcttgatctaagggtttaaatgatgttacgaagagctgttctctttctgtccctcagctctcccctctttgttggcttcattctgtagctcagtggggggacaacacaggtgccggacactcccaagtttgtgtccttccagattgaagtttagcagaagcgagatcttgtcccttccttgtagatccaggattcctagttggacctacttggatttttgtgctcaaacctgaaccagtagatgctgataccgggtagggagttgtaattacactgatagccagagagaaggaatgtgcctgccccaggccagctgtgcagagttcagtcagtgctctgatctgctaggcctgctcacatgtccactctggagttaggggcagaatcccagatgagccatttggactacatgtgagggaggagtagttctcaaataaagctcaagtgttattcccagaagctgggatggatgtactagctagagacagtgtccactggagctgtagagggcgaaactaaggtaaatgagtggaaattattggtcttgctgcgtttgtattcatagagaaagatctgtctatattgtacaggaatgaaataggccagctgttaaggtagtgaattggttgtcactggggggtatctaagcaactaccgtgaataaatgataacagcccatcagcagtgtatagaaggaacaaataacctccaaagccacatttttcaaactgtttctctgtgacacagtaaggaatacatctttacattaaaacctactgtacccttttatatgtatacaaaactacacacaaaagttgcatgaaacagtgcttttccttactacctgtagcatgttcatattttctgttctgtttttattctactttgaaatccctattgtccgctgggtgtggtggctcatgcctgtaattccagcactttgggaggctgaggtggacagatctcctgaggtcagaagtttgagaccagccttgccaacatggcgaaaccccatctctactaaaattacaaaaatcagccaggtgtggtgacatgtgcctgtagtcccagctatgtgggaggctgaggcaggagaatcacttgaacccaggaggcagagattgcagtgagccgagatggtgctactgcacaccagcctgggtgacagagcgagactctgtctcaaaaaaaaaaaaaaaaaaaaagaaagaaatccccattgtgtgcaacccactaagttgctttcatgtctctctaaaaagtttcaacctgcagtttgtaaaaccctgttctaaggtccagtgtcttaccacatctgccctaggtggacaacacttgaagaccgtgtttaaatccggcttttccaccacagtgggtgacatgggtcaaaaatgcggaaggaaacctgttctacttgtgagagctcctgcttctaactggtggaatctcctgctgtctgtcagagtagctcctgacccatcttggggtggaaaggcctttgtgggccctcagggaagtgttgaagggagtttacgggctggctgtgggctgcaggatggcggaggcggccaggcagcaactgtgcctgtgccagcagtagtttatgttgtgaggtcgaatgtatgtgtatgtatgtattctctggcaggcctttatattgaagatgagggagtgtggcttttaaaaataatgtatttttgacttgaaacaagtcaaggcagagagtggagacaattagaggctgatatcctgtttagtcatctctctagagagctctattttcagagctgttctataaaggttcacaagtggtattaagatagttaagaggatattgttaacagtagtcatgatgcaagtagctgatttgaacagggaggtgatttatagtgtggtaaccacattggtaacaggttttatgcagagaaagggtgggttgtaagaataggttgttatacaggttaagctttctgaatctgaacaaagcaggcatcttttattttgaaaaagtatataatcagggtgtggtggtgacctagggtaagtccagtgcatttttgggggctttgtcatgggtagatacaataaattttaaaaaagtaaacagtactgttaagaatctttgagattggctgggcatggtggctctcgcctgtaatcccagcactctgggaggccaaggcgggcggattgcctggtctcaggagttcaagaccagtctgggcaacatgcctctctaagccaggcatgatggcatgtgcctgtggtcccagctacttggggggctgaggcaggaaaatcacttgaacccaggtggtcgaggctacagtgagtcatgattgcagcattgaagtccagcctgggtgacagagggagactctgtcttaaaaaaaaaaaaaatctttgagatcatatgtggaggctgtgttagaaacgctaggccaatgccaggcacagtgactcacacttgtaatcccagtgacttgagaggctgaggtgggaggattgcttgagcctaagagtttgagactgggcaacatagtgagaccttgtctctacatacatacatacatacctagataagcaggcaagctggttatggtggcacatgcctatagtcctagctacttgggaggctgaggcaggagaatcgcttgaggctgggagttcaaggctgcagtgagctatgattgtgccactgcactccagcctgggagacagtgagaccctgtctcaaaaaaaaaaaaaaagagaaaaaatgctaaataatgatgccatagacttttcagattggaagagtgaggctcagtgtggtaaaggaccttgcccagggtccagaaccagctgtgacagaatcagactagagttcttggcctggtctagtaggggggctctttccactgtaccatgtgactatttgcagcttattttaaatttaatatttgaccaaaaatggtcattcgtatctctagtgaaacttctctatatgccagtcttcctcttcagatgaaaggtcaaaggcagaaatggagccacagccaaagaaagagaaaaataaaataaaaatggagccatgggcagaatctgaaaagatttatttaaggacaattgtaaattcatgtatttgagtccacaagagcctcacaatgcaaggcttagaggtgttcatggatagtgaagttagcatccggtaggaagaggggagtccgcccacctaagctagtggtgatcagaacagagccagaggtgctgttcatcctgggcgccatgctgtatggggtctttcggaaactggactatatgcagaggacgacaccatatgaaaagacttcaagctgcattgcttgcagaatgcatgtcttgatatttcagctgataggtaacttcaaggtatgttgatactcccgtgactaattaagagtagcagtccgacacagtgtctcacgcctgtaatcccagcactttgggaggctgaggcgggaggatcatttgaagtcaggagttcgagaccagcctggccaacatggtgaaaccccatctctactaaaaaatacaaaaacagatcagatgtggtggcacacgcctgtaatcccagctactcaggagactgaggcagaattgcttgaacctaggagatggaggttgcagtgagctgagatcatgccactgcactccagcctgggcaacaaagtgaaactacctctctctctcaaaaaaaaaagagtagtgaatgcaaggctcctaaacttccttccctagtgcttccttaagattgaccagactttggtggaaatatgtagcagagactctttatactttttactccataaaactaaagatttgcagttgaccaagccacatgtgttcattaccttgtatgttgccgttatttctctatttcatattcttgccatgtggtttagtaaaatgctgctcttataagccatatgcataagatatggaggtctcaaaaacaattaccaagtatgtggatgtgcctgtctatattatgacaagccaaaaatgggagagaataaaattcaagaggaaggaaactgataaaatgtggtttcttttcagtctttacagttttttgagctttcacttgtttccctgccactctactatttaatgaaagacttagatttatttgatttgtggctgtgatttacacattaggcctctctgtgatgaattgtttaaggcccacaaaaatattttaaaactaacatataatatacatttttttttctctttgtaggtggatctcgagccagaggggaaagtatttgtggtaataacccttaccgggagtttcactgaaggtaagaatgagttttgggtagtttccagaatacatgtaatcttggtttacactcagtaggaatttctatcatggacattataaaaaagagcatgttgtaagagatgcttaaaaaatcactttcataagttgggctggctagtattttgttgcccagtggtctattggttcaggttgccaaattaaatatatttgctaaatctggcaatctcacgtttcatttaacacactcaatgagtttttgtttttagccagtgtcatcgtagctgaatggtttttgcgtctttttggttcatgactgtggaactctacgtctttggttttgtgccatcttttagtttgcctgtgaatgtctatgaaagaaatttagggatccagttatcttctttataatctctatctcatttgtgacctgtaagggattctgttcttcatctgtggctaccgtactccctactcccccatccaatattttttttacttgaggtaaaatttatatgggggtgaaatgatagatcagaagtgaacaatttgaattttgacaaatgcatacaactgcataaccagcaccccaatccaagatacaggacatttccattattgtgaacatttccctgtaccctttttcaatcccctgctcccagaggcaataagtaaagtgctttatttcaccacaggttagttttacctaccctagaagttcatatacatggaattatacagtatattctcttttatgtctggtttctttcactcagcatagtttttagaagattcatatcattgtgtatatcagtatttttttcattttatttctgagtagtagtatcccattatataaatgtagcatccatttgtttacccattctcctcttggtggacttttggggtttttcctattgttgtctattatgaataatgcttttattaaccttcttacacataaatttttctggacataacactttcatttatcttggataattatataggagtggaattgctgggtaataaagtaggtgtgtgtgtaacttcagaagaaacttccagatggtttccaaagtggttttattatactcccaccagcaatgcatgagagttccaattacttcatatcctcattaacactttctatggccattgcttttcatcgtagacattctagtgggtatgaaattatatcctgtgggtaaatttgcatttccctgatggtgagtactttctcacatgcttattggtcatttgtttgtttatttgataatttccagttccagtcttttgtcctgttttctaaaattggatttgtctttctattattgatttagaggagttctttgttttctggatatgagtcctttgtgagaaataggtattgtgattactttttcccagtctgtggcttgccttttcattttcttaatggtgtctttgagcaaaagttttaaatttctatgaagttcagtttattaatctcatcttttgtagttcatatgttttatgtcttcagagatctctctgtcataggatcactaagatattctcctgtttctttttttgttttttttttttaagaagcaaatagttttaggttttatgtttaggtctgtatgccttcttaaattgatatttgtgtgtgatgttacagaggagttgaaacattttttttcaatacacgaatgcagttgttctagcaccatttattaaaagtctcccctggccccttgaatcaccctggaacctttgttgaaaatcaattgaccatataatgtgggtctgtttctggattatctgttctgtcctgttgatctgtttgtccatctgatctctctttcttttctctacattatgccagtattacactgtctcattactgttgctttatagtgagtcttatggttacatagtatgagccctccaactccgttcttttttgtatgtttaaggttattttagctattctcagtattttgcaatttgatatcagttttagagtcagcttatatatttccagacaaaatcctgctgtattttgaattgaaattgtgttggatctatagatcggtttgaggggaattaacatcttaacaatcttgagtatctttaaacccatctgtagtcaaattagtcaattctgtagtccgtggacatggtctttgctcgtaaggcatagccagtgtgaggtttcagtagaaatcccaaggtgttttaagcccattaattttatggcactcaagcttctaactctttctcctatgggtgggaaacagctgaaatctcagttcctatctttcagcatcctagctcttgctcctgtctggacctcttagagtttcccttgcacatgcacagtttaggaagatgtgagggcttgaagagtttacatatgtggaggttcttctttctgtggccccatctttccaggttttctcccctcaatatccagtcatctggtaggcttgaattttgtcaattctgccttcaagccaataaaactgtggttccatattgagttctatttacccaaccctgcacaacctggggaataatctggagaaaagccctacaaatgtgggtctcgcctaatgcggtttccctccttcacgtgtcagattctctctagtttgtatgtgtttttggttgttctctcacatcatcaactagttgtttaaaatatattttccaggtattttaatcttttggtgggagggttggtccatatcaagctacttcaccattactaaaacctcatgaagatttttaagcatgtggcttaattgtttgtatttttggtattggcattttgcaaaattggttacactttctttgagaaatagttttctccactcctttcagccaaccattcccattcatatgggtgaattgttttaatgttaaagtttttcaatatatcgtctccattattaaatcttgtctttttgcacaaacctggatttagcagaaacctagaatacttgacataaaaaaaaaactgttcaggttacaatttgggggggtgttctgcctgctccaaggtctttttgctttgcttggtatcttttatgtacagagaaaaatgagtctgttcctagcctagtcaaataaaatcaatgtagtattatggaacattgttgataaaacattctcatcatgcacgtagaacatggatcagctatggtagaaagaaacacaacagtgagaaagaggtcaggaggaggagtgggtaagattctctctcattcgagctgaatcaactctctgcattaagttacaagggactggcgaagtaaagcaatgcatattagaccaggtctgattgtgccataatcattacatgacttttttagagccatgccaactctctaggactaaatgctcaccaaatacatctgattgttctcattgtatttatttcttagtttcagtgataataagaatgaaatggtaagtcatactagaggtgagttcttactaggtcattgcagttgtgtctttcagagctgaccctgggtaaaattgtgagatgagttgagtttatctttggtaattccatctttgctttaagctagtcctttgtctctgcctacagttgtcccttactgcagcaagaagcccagtggtccctgtccagaaagagttgctgataaggaaaacagttaattcataggctaattcacactacagtgatagagattgatgtcatagtactctattcctcttaggtgtgtttgcatattttaaaagatgctggaagagctgctttatccatgagaaatagacttttaatgctaaaattttaatattgaaatctacgggtggggtatattttaggaaccccatatctgttctctgtgtctctgtgcgtgcattgctttttcattttggctcctagactggggctcagcttgagcttgcacgttgctgctgcctttaaaacaccgctcccttgtcacatgcagaggacgtgatggctgcctgtctgtgttaagtaagaaggaaatggagccccccccccccccatttgcctgccacagctgtggcagcaacctggacctggcactgagagcatgtccctagcttgacctcgctcctggaagccaccttagattatgtccagccataatatgacaggttggctggtgcaacatttggagctctagttcccatcttggatactgaaagccttcatggaaaagcagtgtaaggtcaggcctgcccagtgtgttttggactgtgaaaagggcattgtcctaggatcctggaggcactgtcaaagctcaggaaatgttggctgatcctcagtctgtctcacatggttgtcttgaaggtcagatgatataatatatggggaagtgctttgcaaactataaagtactatatgaaggtatgttagtgggattttcatttccatgttcctattgtcacagcaaggagatcccagtcatttcccctacccctgccctgggaccatcttgtatactcagcaggttcgttttatcttaacattgactttatggccaggcgtggtgtctcacacctgtaatcccagcactttgggaggctgaggcaggcagattgcttgagctcaggagtttgagaccggcctgggcaacatggtgaaacaccatctctacaaaaaatacaaaaattaaccaggtgtggtggtgcacacttgtagtctcagctacttgggaggctgaggtgggaggattgcctgagcctgggaagtggaggttgcagtgagctgagatagtgccactgcactccagcttgggtgacagagtgaaaccttgtttcagaaaaaaaaaaaaaaaagaaaagaaaagactttattttatacaagaagcctcaagaatttcatggacagtggctagcataatgttggcttatctccatgcctgttttcatgatctcctatgcgggttctgccataagctcagattctataatctcaaagcactcctttaaaaaaaattacttaaattggacggtggtctgtgatgtacaaggctggtattggggctactgactgctacttacctcattttttaatttttcattaattatactgaattagctcaggcaaaactattttgttaaatgtaagacatgattgagaagtgacataagaaaaacctgctgggtgcagacctgtaatcacatcatagatgctggagagataaagatgaacgagacatagacactctcacaggagctcataggagggaaggcagatacatattatgtatgcaatgcagggagccaggtcccatggcaggaataagcccagtgcatagtgttggcacatgggactacataatcaatttggccaggagggtttagagaaagcttttctggggaggtgatgtttaaaacaagtctgaatgataaataggactgtgcctagaagggaacagagttcaagagagggagacagtttgtacaagaaacgaaaaggagtgtggaggtgctaaaggtagggggtgtggaggtgctgaagattggggagtgggatggggggatgtggccagagatttcggagggcttatgtgtgggcttgcccaggacaggctcagtttgttggttacaccagaataattatacaacagcgccactgttcactttcaaaagggtgccaggtcagacaataaattgcatgttcacaccacttgtaggctaatagaaatgataagataccagtgaagggttttaagcagagatctgatttggtggcagtaagttcaagggtggggaaggggtgttagttgataagactagatctaaggtgtggagaaccattatagagacttggaaggttgtctcagggcaagattattagggcctgaattaggttggaatatgtaggggtggagaggagggggacagctttgagagatgtctgtgtagtaaaatcagtaggaattagcaatccactggatgtggaggatgaagaaagaggagtctcagatgatgctcagatggtgcctcagagtcatttaccagggtagaaactgggagaagatgatgaatccagctttggacaagtggagtttgaggtgcttgtgggaaatctaagttgcaatgtctgggagaaattggaaataagattccggagtttggcaagatgcctgggcctgagatgtagctccaggtgccaggtggaagacaggcacatggataaagaggcccattgagaagatttagcaagaaaaccagcaaggctgaccagcagcagaactctgtggagcatcaacatttaagtactttggctcatgaattatagtttatcaaaccaaccaaactatgctgaaggtttacttaatgaacacccattttgctaagatattacttgtgaaatagtatctgagtgcttgctgtatgccagggactgtttcaccagattgtttaccgtcttccaaattggcaccaaaatgtttgataatgaagttagaagaaagaacagaacacaaaaggctttgaaaagtaatgtttgcattggtggtaacagtggtttcttcgaagtttgatgatacaatgtgctgtgtgaaggtttatgcctaatgcgggggtaaaaagaacagatgaacctactcaaaacctgcagtgaggggtcttcactgaacttagatagagcaagaaaaactcttttacattcattgctttgtggaagtctctcacagagctcaaggcgtataaaattatcaactggatcagaaacccctcaccactgttcatcttgttaaaggtgtcactctgcatctgtgcagaattcccctaggcactgaggcagaagtagaagtgatttattattttgaaaaagctgcctaatgtcaatctttattctaactaagccttcctgaagctaagaactggatctgaagtctgatcaaattgaaatttattatagtgatgaaacagccctggatttttaatgcagccttcagattccatcattgttgccatgtgtgtgattgtcactatgttggactaatttttgtctggaagagtggagtagcaaaaaaaagaatagattgaaacaatggaaactgaggaaaatgcattaaactaaattcataactgctttaattggaagagaaacaacagaaagaaattaaagtatgacatcatcttatgtgaggacaaaaagatgtagctggattattatgctactaagaaatatggtgtaagattttacgatttgaagagaacatagtttgcagtaaatgaagtttgcttggactcagggaaccacaaacttaaatggttggcccacaaatgaaaaaccagacatgatgtgtctcctgatggaagcccacacaacatcgtgatcttgccaaaaagtagaggtagttttgcccaaaactcaagccttagaccagtcaggcttccagatccaaccaccagttaagaggaaatataggggacagaggagcattttaagttacaccatgggatgtaatcagcaaaatccagactgtggaaaaattttacaggaaaagagacttggtttcttctaccaaacattggaagaaaaaagtaaaggaaagagaaccaaagtaacaagagagaggcatattaatcatttgcaatatatgggccacattttatcccaattcaaacacaaattataaaagaaacattaactcccaggaggcaagtgaagaaatggaaaccgtgcctggatctgtgaggatattacagaattgttgatgttatttaggtgtgattgtggtattgtggttacttaaaacaaaaagaacatccattagaaatacacttaaaaatatttactgatgatatgatatgacatctgggctttacttcagaataatgcagaggtgggcagaggagatgggatagaattgaaacccgattagccatgagttgtttactgaagctgggtgatgattatatgttgcatgtggtttattatagtattctacttttgcatgtatttgaaattttcattaataagttaaaaagtaaaataaaatgacaaatttcaagaatatctgcttcttaaacaaaaaccagaatctgggttatgacatcaaaatgatgcttgaacttgaacattttacctctttccacttacaaattaaagctggagggttttttaatgtatatgttttatccatgattctcagtttttatgtatgatgaaaaagtaagttaaaaattttaaatgactaaagtactgtgcttcagaaagacttttttaaattgctaaataaataataagctgtgagtcaaaaactgcaggtaggaacaggtgagtaagataattccttttgttccgtcataaagttctcactcacagtgaatgacaagtagattatctcctactaacaattacataacattttgcagttgcgaagtttaattttaaggtagtttcctaaaagaataaagtaaatcagaaggattaatggtagaagtatctttataaagatagtaagaaaaaggttcttagtgtacttgtttcttccccagagttcccaaggcaaatataaaggtattctattttgtacaagtttttggggaaggaaaacttcctcaaaaacaaaaccctgacaaagaacctgttatttgtgaatttgaagcttgtttagaaaaaaaaggccttttacttctgctaaaaccttgaattgttccttatttgagacatttaatatgtaacttggaaaagatatacatttgtcctggggagacaatggaaaggcacttgaattttggcatctgctttttctctctactaaggcagtgcacaatggtgcagaataagagtctgatctttttctttttgtcccattgcctcagtttttagctcacatttcttgtctcaagcccactggtttacaaataattacgttctctgctaagtcatgtggcacatggaccatcaaggcagatgaagcatgtgttactgctttgaagctgcagcccacagttaccccctgtatcaacacttcagatgcatgtcatttttaaagagaaaaagtgatttctggtggtagttgatttatagcattcctttctcagatttcaagcctggtgacaagttgttgatttaatttttttaaaatgtagctttaaaaaaatttattcttttggcatattagcttgaagaatgagtgaccactttagtttttgtgtttgttttttgctggtctaagcaattgtggctatcaggttgaagacagggtaggagagaaagaaaggaattgagggaatgggagaataggaactggaaacgggcgaatgatgtttttaaaggattgagactaattgtcccttgtcatagatgctctctcgtcttctccataatatctagctcatttgttgaatgccttctgaggaccagacactggagttggcttgtaatttagcaaatagcaatgggagccctcattttattttctggtagcaggataaactcttacctagtaactgagtacctctacgtgttcataccatgctatatattattccattttctctctataacaaatttctgaggctgttgtaattctcagtatgcaaatggtgaaccagactcagagacgctaatttactatggtctttcctggatagtaagtgccagagcccagacacaagctcagattgcaatgctgaggtccaagatctttctacaccatccagctatctgaggagttgggggtgggggggcagcattttagtttttttctttattccatcttagaggaaaactgtcctcaggatagcataatcccaccctccagagagtcttgtcttttgggatgatgtctttttgcaaggcttcccttgagttcctcctccttaaactggaggaccaacattcacccaggaaaggtgcagcattctcagacatcaggcatggatgggccagaaagctctaggcagattgagtttaagatttgctcaggttttgttgtcagtaggttctcttaatgtacatcttaagctagaactcagaagatgaaaatacaatcagtgagttcagcataggtatgatagctctatttgcctttttataccccagtcatcattggcttcactgtacctacttctcttattttgactgactgtaagtgaaaaaactaggtggtggctttgttggaaattttaaaattcattctcaaagtgtgatcctgcagacttctgagagttccagagacattttcaggaagtctgcagttccaaactgttttccttataatacgaagattttattcatccttttttccccactgtgttgacatttgccccaatggtgcaaaagagaaatggtgggtaaaagcatggcaccaaactataaagtcatcattgtattcttgatggccacgtagttgcaggaggaagaaatctagtttcacttaagaatgtctttgatggaacagtaaacattattcatgttattaaaggtcaatccttgactatatacctttgtaacattctgtgtgacaaaatgggaaatatgctaaaagcattcctgcttcatactgaaatactgttgtgtctcaaggaaaagcacttgtgtgattgagttgttagctgagctagccactttttgcatggaacaccatttttactttgaaagaatgacagacaaaccatactatggaactggcagatttttcagacattgtctaaaaaacgaatgaactgcgcctgttacttcagggaaaacaactgtaagtatttggtgccagtgataaaattagagccttcaaaacataattcgaattttggaaagtttatatccaccattgtgagcttgacaacttcccagtacttattcttttctcatgagtttgttgttattaacgattgtaatttttaaaaattgtgttatgagatatgtcaacatttagaagatgacttccaatgattcagtgaacacgtattttcacaatggccagtacgagatgttataaaatcatttatgggtcaaggatctcttgaaagcgtaaggtagactcatgtatattaatttaaagtatgaaaagttcattgatacagttttatattgcaaccaacttttgagaaactacgccttgtttacttttgtgtggtattaaagaagaatatctgcaattatctgaaaaatctattaaaattatatttttaaattactctgtgtgaggctggactgtattcatgtacttcaactagaacaacattacagtggcttgaatacagaagcagatatgagaatctagctgtcaggctgggcgcagtggctcacgcctgtaatcccagcactttgggaggccgaggcgggcagatcacgaggtcaggagatcaagaccatcctggccaacatggtgaaaccccgtctctactaaaaatacaaaaaaaaattagctgggtgtggtggtgcgtgcctgtaatcccagctactcgggaggctgaggcaggagaatcacttgaaccagggagtcagaggttgcagtgagccaatattgtgccactgcactccagcctggtgacagagcgaaactctgtctcaaaaaaaaagaaaaaaagaaaaaagaaagaatctagctgtctttttttttaattaattaattaatttatttattttatttttatttattattattagactttaagttttagggtacatgtgcacaatgtgcaggttagttacatatatatacatgtgccatgctggtgcgctgcacccactaactcatcctctagcattaggtatatctcccaatgctatccctcccgcctccccactagctgtcttcttttaagtcagacattaaagagatttgcaaattgtaaaataatgccactctctctatctttggggggatgtttgaaaatgtagttatattttattaaaatgtgtatactaacatgtaatggaattgttattgtttttaataaatgataaatatttttaaatgtctccatttaaatttctaatttgacaaatatcagtagaatccattcaaaggggtacttggaccaaaaaattttacaatttctaggttatttttttcttacattctttcaaaagcccagtgctttaaattttaatgaccacagggagaaggaactgacacatatttgtgtatgttataatcagaaaaaaatatgtacagttaggtgatacaggtgacagaattgtcatttttttgaaactttctttttgtttctgattatttctgctgtgcagtgtactttttcagccagtttttgttataagcctgttctcataaaaataaggtcaggaagtgacaccaaaacaactcagaagcctgtggtggtttctaactttagagctgcctgttacagatagcttcatgctaaacctttgcttgatttgagcagaacaaggcagtcacgatacttctgaacaagtgatcagtgctgtgagcactaaaagctgaacctcaaaaacagctcaagatccatggacagagcctcaggagacacatttctatggcactcgcttactgactagcattctccttttctaatcaaggttcttgaaaaacagaggctgactcgtttgttaatttttttcaagctttattgttttttccttgaaattatagtgatgtggtattctctctatggaactgaggtttgggtaaaacaagaatgatttaattttttgatagaaaagttaattgctccagtgtctgttttcattatacttccattttatttccagcaaccccttatctctctgctctctttgtttcaaatgaacaagacagtagagtttgttttccaggccacttgtgttggtaacccttttcctaagctttccctaataacaccctgtgtcagtggacaggtagtaggtaggaagacctgcttcttcccttctaccgtgaaactcgtcttcagcatcattctttcatcctgatggctgagagttgtgttctggtctcaagtcagcagtggataacccactgcatgaagttgatggggagtgtggggcatggacaacagtggcctgaggttgcagatacattctttgtatatgtaagagaccaccttatattttgtaagtggaaacttagttctcataggattttggagaaaatcagttgcctcctctaggaattttcatttgtttacaaaatgtcctgggtcaagcaatacttttatgttatccccacttaggtttagtggatccatccatccatccatccacccacccacccacccacagagtatttatgtagaaaactatgtaatggatgtatatattcatgcatgtgtgtatgcatgtacttagtaatgacactggtttgttctcacagaactcaaaatttggtgtgtatgtggagacataaacaattagaaaggttaacataatatgtacctccacaggtggtacatgctatggagaaaataaaacagagtaagaggacagagatgggtcctatgtgtatgctgttttgttcaaatcagatggtcagggaaggcccctctgatgaggtatcatttgagccagaggtctgaagaaagggagggagtggaccttgagtctgtctattgggatggggaacaggaagtgcaaatactgtaagggttgcagcagggagaggagtgtagctgggccttgaggtcaggggaggtgcccacatggttgttggcacaactttggtgccctgctaatgtcactttcctcttcaagaatacccttgtcacttaagtgatgttcacttatgcttgctgctggcttaccatttggctcactgagcacgtcttttcccctttggttaggggcttgaagagcacagcatcacatctatttatgacttgatgtattttgctaatgcggaaaccattccaaattcatgataacaactttctccagttctgtgaattccctcatggtttctttttgttctaagccaaattaggagccaatccccagcttaataagcattaaaagttcaaattgactgtctggaaatctataacaagtccatgcactcctaaatataattagctgtaattcagttctagttatggattattaagaaattactcttatttgagcacctcactcatcaaaaataaagtcagaaaatttaggcgcagctggaatcttctgctcttttttttttttttgagacggagtctcactcttgtcgcccaggctggagtgcagtggcgcaatctcagctcactgcaacctccacctcccgggttcaagcgattctgctgcctcagcctcctgagtagctgggattacaggtgcgcagcaccacgcccagctaatttttgtatttttagtagagatggggcttcaccatgttggccaggctggtctcgaactcctgatctcaggtgatcggcaccccttggcctcccagagtgctgggattataggtgagcgccaccatgcctggccaaatcttctattcttgaacttgtggtgaactatcatttgttgaggagttttaataagtgttagtgatagatctctactaaataactggagaggtaagtaggttggagctcagtcttggtaccttatagggacttagtatatagcttttggaaagttaattcttactgaattttgatgatacttcttgtttcatgtaaatgtggatgcttccgttatgtgagtcctaagatttgggatttaccaagtactgagaataggaccttcaaaaaatatgaaatgccaagaggatctgttttaaagcaatggaattatttgagaattttgaaaaatacagattctcaggacccagtctgaatgagaatctctggggaagaggccaaggaaacagaattcaggtaagcaccttggctgcttccagtggttggccaatttggatatccctgttgtgtcctaaattatacctaatttgattaaagttttggtggctgggaggtttgctagttgaaaaacacatacaggaaaaaaaaaatgtacaggggagtgtattgctttggtgtagtcgtttaagagttgacaaaaaccccaaatgtattcttttaagaaccttttaaaatgctgcgacaagggtcaggttacagtttttgcgttgttaggggggcacatgagactcagcagctacaggccttgttaatgtctgcaaacactcagtgctaatgtggagactcaagccaggcttgaaagtgataaaatcaggatgggaatgttggctttgctgcccatcaactgttagactggagacaagttacaggcatttccttttttgtggggtaactgagaccaggaaaagacaattgaaagtggttccagttaaaatgggagccacagttttttcgtagtatatatctttaaaaaggtttgattaatactgttcttaaaatgacaacaacaattgtgaaaggaaatttcattcatcttatatttatcagtgtttgggttccagtggcacctgtgtgctaattcttagaaccaagaatggatcacataactcagtaggtatttctctgactgatttgaaagcatgataacagcttccacttcacgctgactttctcagcattgtgccgagcagagttatttttgcaaaaaggtttgaagatttcatcagtttttccagtagacaggcatggctccaccagtgttggtctcctctttgttggtgatgaactcgacatccgagatttactctgtcaggggtttgctgtgattggagtagtgtattagtcaatttcatgacttcccgcatccactacaagatctcactttttgatccggggctgatttttgtggcacagtttgtattatgggatgtatctgctactcagaaagggagaacaacagccatttacatggtgggcaggaatagggtagttttaagcaaggaggggtgttagagtagggactgatttaaaagtggtcattctgttcatcagagactattctcatgctctgaccatttagtttatctaaatcttaggattatagggattttaataattaatactcagatgatgagttcaggtgtctctgtaaaatgaataatgcatttattattaagtctaaataccctaccattctgaaggcgggactgcatgtctaataccaccatcttatctaatggttccttgggatccacccaggcacaggagaacataacaatgcttggaggggttctaacctaggacttcagaaagaattcatcgacaaagactgaagcttaactctaggagggaactgtattgatttccttaaacatactaaggaatggcaattcagtaggactctgctgtccccttccagcccctcctcagtgaggacctggtggggacactcagccagagtgtgaaaggaacagcttcagggccctgctcaaatgtgtctgggagctgtcactttttccatgcctctttctcgggtgttggacgtcctcatttgagacttttaattcctacattcttggtctttgcctctctgaatgcttgaaggtcacacttaggtacagcctttatagaaccttttgtctgatatgcagaatattgactgcatgctggctgtgtctgtctgtctgtgcctctgtctttctctagccagggattacagactgcccatgggctgaaatcagcctgcagaccagttttgctttgtatgcagcatggaataatgcttttgaggttttccaacttgagctcttcagacagggcagggttctccagtgtcccacatcccctgttgtctgaatttcctctgaattcacacctctatgcctccttctctggcctcagtttgcaatcctgaatctgagcatttgtcccatgtgtttactgggcagtgtgcagtggccttgggggagactttgaaacatgttttagtgagaaggatcacttctttactggagtcaaaactgaaaatactttcccttcgtggaataccatacaggcgtctctcttgcactgttcagcatcccatcctactcagtggcattcccactctaggttttgggtagtacagagtctcactgctttggggagcttttgggggcatggtggagagagaaatctcttcattttttcaatttgtttggatcagaagattagcctgctttcaggtaataggtctacttttagtgatgcctacagttccctgaatgccccccaaaagttaatttctggtgtcactgttaatccttacagtcaaaatttcctgggaattgctattggggatctgtagctgtgctggagataggggcatgggtaggggaggaccatcagttttggatcagatggacttggttctgctgcctgtccttccttgctgcgtgaccttaagcaatggttgccttatgtgtaaaacaaggggctaatgatacctaaacccagggttgctgcaaaggttacatgagcttatgcacacaagcacacacccacaaagtgtagcattaggatctgatgcagactatgttcccacccacttgggaaggaaatccgtgccccatttacttccatgtacttggtggtgaatcatctaaaagatactggaaaaatgtgattacagatgccccctttctcggccattgcttcaaatcctagacagctattgaacgtcaccggatagacgtcatattctaggagggtgtcaagtacatacaggtctgtgtttctatgtgctttttgtaggagctatcaactataaagctgtgggtatgagaatttcagggcaaggtcgggaaggtgtaggagggattcactaactctggggaaagtgtgtgctgctttgtcagtttcctgttcgctaggccacagggaatatgttggctctttctgaatctgcccaccagagccaatgtcataccttttcccaagccactgcttgagggtccagctaattgatgccaccgcattgcctctcctggtgaggaccgactgtgccatgggggtggtggctgtgggcgtagacagccctgttcatgggcatgcacactgccatgggtgctccatgggaatgctggtagatagcagaacatggatcaggagttctactctccaggatagcatgacccagccatgggctcaaggaattgctctttgggatatgtttgaaactcatcccctactctggccgattctttcagtacagatacagaaatgcaatgagaaccttctccctgtagttctgttaagataaatgagtggtagtggctcatacctgtaatcctaatactctgggaggctgaagcaggaggattgcttgagcccaggagttcaagaccagctgggcaacatagtgagatgccaggcatctccaccaaaaaaagaaaaaaaaatccaggcatggtggtgtgcacctgtattcccagttacttgggaggcaagaagattgcctgaacccagaggtttgaggctgcagtgagccatgattgtgccactgtgctccaacctgagtaacatgagtgacacagtgagaccctgtctcaaaaaaaaaaaaaaaaaaaaaaaagagttaatgtttataaggtgtttctaggtcccaggaaaaagaaatgttttaaaagtagattgtatatgctacttgttattaatttcttatctctagagattgaatggtaaaagccagggccagcattgtacattgtcaggcagcattgcccctgtcgtctgccttttcctcctgttactaggagcttgttaggtttggtcaccagcctgatgacctgatcaaatgttgcctgtcaacttggagtgactgtggttgtttattttgttatttattcaccaataaattgagttggttcactctgtgtatttttacagcatttggccttttcccaaatatttgccttagtttattaaattagcttctcagttataagttaaagtgtgtgttgacttttatgattttaattttacaggcttggttggctttgaatgaccagatggcatctcttgagtctgtgagcaggttttgtttcacttaggacttcacccccaccccgttcttaaaaatggtgatatgttaaatccactttaaatctagtatttgattattaattaaaatatctcttatgcattttgaaggtaaaattacaattttgttccatgtgaaatgggagcatgtgttgacaaaccgttgattaacttgagtggatttgggttaatctttttactctgctccatgctgcctgcctgtagggtaatataaatccgttgggctgttgctaggctcagctgcttctgagtagtttgacaggtttcatcctgttaaaggctctttttctctaggccctagattctaggggtattggggtgatgctggtgaatggagtctaactgcgtatttgcttcttgcttccagcaccaattgtggccaatggagtgaggcaaagagcactggtgtggctaaattactccttctgcagtccccagcatattattggatgctctttttccctctcccagagctttccttatcttctaatttcaaagataagcgttacctgtaggcaatgcacccgacctctatccctgttgtggtagctacacataaacatagccatcatggccaggtcccttgggtggtcacatttcctactgttctgatcaccttccactatcaacactgaccagtgtgcctggctaattccaaaccgtgcgaatggctgtgttgcctgggctcatgaagcctgtcaggaagagctgtggacagatgatttttgaaaatgagggtgattgcaaagggacagaaagtatgagacatcgtggatgctgtcttttccttaggccttcagtcatttgaagtcaggacttccaagcctggatatccagtgggcttctggggaaagtggatcagagctcagcaaggattgagccccagcgacttccaacaaaccatcccatccaacagaggctgtcttcactatgcagacctttgagccacctcagaagacaccagccttcatgctcatcctttacacgtctctttggttcatgtaccagtcccttgtcctcctcggtgaccaagataggaatggtgtcaacggatgattatggcatgacatagagtaactctttgcataaaagagtggacagggcaggcacttaacacttgaggacccctgttccagtcagccacagatgtatttattaggccttaaactgatgggatggttcttggatttttcagtttaaaacctatagggggactttacttttggccaaatgctgaaacaagtattggatttatcttcccatgtgaaaaacaaaatatggacaaaataaatgaaacaatgatttgtaagacactggatacatcagacaacaaaggccaatgattcctgagagataggaaacaaatgaggtgagacctctgagttttttcaaactgccttaaaagagtttccaagctatagcacaggaaaagggaaccatgtggagcccagcagactccctcagttgaggattggatctgagagtccagagagactaaggccactagagatcatgggatacagtactagagaagagacagctgcaccaagacataactctggaggtgtacaaagttctgagaactgatcagtgtaaagaagctgcctgagtctggggaaagcaccattcaaaaggagcaaagataactgtttctggtgctcacacggggccagaaatagtgcttctgccaccaaccagactggaaaacttcaagagtcatggagcattgggtagagtagagtacatagaagggccttgcttgcttagtggggaataactaacccaactgagcatggctttaaatctaaaaagcaagatctgatagggccgaactatttctgagtaacttagctgtgtcccagatcaaagctgattttatagaaatacaaaactatcactcaataggcaaaaaccagtgtctggcatccaaccaaaaattaccagatgtacaaagaagcaagaaagtacaacccataatgggagcaaatcaaccaatcaaaactgacccagaattaacgcagatgttacaattagcagataaggacattaaaatggttattataactatattccatatgttaagcagaaacatacttgtctttaaaaagacaagtagaaaagtgaaaatggagaaaataaacaaaaagaccccagttggatttgaaacatgggttgcttttctatgactccatccttatgttacttcaaccgaacccatatgacctgaacctggcccctgctaatttatctgaaccataagctcctacttatcttctcagtgctctctctagcccagactgtggggtcatccctgcagtgctaactcagtgatgcccaggggtcacttgaccctttaatcttccttcatgcctgctgtgccaatgcctgacctgagcaatcatctcacagatgattggatgttgctggctggacccatggcatataaatttttggcattaagcagatacttagcaaaaacggaagcattcttcttgtgttggtttctcagcaattctaaaacttttacacctgaaagccccttcccactttttttcccactcatgttctctttctcttactctgctgaaaaaatcctgcaagatctgccatctttatgtgcctgctgtccctcagtgtggccatctcttttcttcctttctgctggctgccagggaacctctcttcctacagaagctacaccttttcctgggtggatccatcctctctggcctcttaacacattctcacatgttcatttacctggactgaccacactttgtttagtcccttgctctcctttggctgcttctcctgtggtgatttaaacagaaaaaaaaaattcttcacctgatcatagtatcctcagctaccatcctatttctttcccccctttgcagccaactatcttgacaaacgttttgtatctgcgtctcaccaccaactttctactcagctcctgcttcgctcttgcccagacactttctaattacaaagtgtacctctcctttctctgcaatctttcgtgtgaccgtgatgctgcatttggttctgtttcatgttctccctttgggcacctcaaacgactgcaaacccttggcctctattctgagtggtggtccccagcaccccagctccttttctcccattcccttcagtgatgacaaccttcatcatttctttttaagcgccccccccccccccgcccatgtaccctgtgcctatattctaagcaagtggcttagatcctacttaatctggaaaattgcatcaggtgtgagtgacttccctcaactacactgactttatctgcattcccacccatcctgagtccttagcctctgttccagaggatagttgtcattgcttttgctaaagacctgtgcttcctcacgaactttgcttccctttctttaacttctccatttccttctctcattttctttctctgatctgtaaacatggccaggcctcctcctcctaaaaatctccttgggtactttctaatttgtctcctttttttcatccggatatgttgagagtacagcctacatactaattcttcacttcattgccttctattttctcttccagctgctacttaagctctctggcttccctcaccactattctgctcaagtagcgcttgataaggtcactgagggcatctatattgccaaatccagtaagcagtttccaggccccatcttattggacatctctgttgtgtttggcagtgctcatcactcttccacctcagagcccacactttttgacttctgcaactctgaagtctggatcatcccattcttcccttctcttcctttctcgtatctttgggcttctctaccaccctctgcagtttgtatccttgggggatccatcttcagcccgccgctgtccccattcacatctctggtcatctgtttcagtctgggatttcactctgcctgttgctctccactcctccgtctatatctgcagcccaggtctctcccctgagttccagcttcctgtgtccagtcgtgtgctgggcactctcaatgggcttcatttaatcttttttttttttttttgaaatggagtctcactctgtcacccaggctggagtgtagtggtgtgaccttggctcactacatcctccgcctcccaggttcaagctactcttctgtctcagcctccctggtagctgggattacaggtgcccaccctcatgcccagctaatttttgtatttttgatagagtcgaggtttcaccagattggtcaggctggtcttaaactcctgaccccaagtgatctgcctgcctcagtctcccaaagtgctaggattacaggcatgagccactgtgcccggcatgggcttcatttattcttttttttttttttttgagatggagtctcactctgttgcccaggctgcactggctaagttttttgtatatttagtagagacggggtttcatcatgctggctgggctggtcttgaactcctaacctcgtgatccgcctgcctcagcctcccaaagtgctgggattacaggcatgagccactgtgcctggcccatttaatctttcagttagcaaacatgcatcttctgtccccacactcttgaatatgaaatgttgaatataatgaataaaagcattccccctctgccaagcaccatactatcctgattctgtttctatccctttgtccttcctctgtttccttcctgggctcttgtgttcttcactatcttagaagtgggcgcccattctcatagggcctttcatctgcagggacactctcagtggttaccttcaggccccatttttcctgtgagccctggttctgtgctgtctttcaaactcctctggctcagaccccagttgtcattttcctcccatatcagcactgtcttcactccatttctgtcattgccttcttctgaacactgaagcttgaacacacacattttccccacctacacattttgtctttcctactaacttaaaagtaatttgaagtgtgtgttctattgtgtacctgtgcacctctccctccccaacatggtgatatgtgagggtataaagtgaggcaaagaaaaggcaaaaagatgaagttcctgtcatttcccattttaacaagagttgcagagggtccccctaccccccatctcccacagcaactttgacattaagtgatcacttcaggggtggtatttgtggaagaggtttcacccacacttccatttccttaggagagctgaggaagggggttagccattgaaggatgaagatatgtaatcaatttaatgaggactgtcatttggggattttacaggaatttttgactgcatttactttaggctacactatgtggaatcttcctttccctttgggtagtggatcccttaatgccatatttgtctggttccatatctttcctgtcaccttcagttttttaaaaaaattgtgataaaatgcacataaaaatctaccttctgaaccatttgtaagtgtatagtccagtggtattaggtacactcacattattgtaaaaccatcaccaccatccatctccagaattcttttcatattgcaaaactgaaattctatacccattgaatactaattctccattccctctccctccagcccttagcaaacaccattctgctttctgtctctatagatttgactactctaagtacctcctataagtggaatcatacagtctttatccttttgtgattggcttgttttgctttgcataatgtcttcagggttcacccgtgtggtagcatgtgtcaaaattcccctcccttgcctcttttttcttttcttttcttttcttttttttttttttttttgagacggggtgtcactgtcaccctggttggtgcagtggcatgatcttggctcactgcagcctctgccccgcccccgggctcaagccatcctcccacccagcttcctgagtagctgggactacaggtgtgcaccaccaagcccagctaatttttgtattttttgtagagacaggattttgctatttgcccaggctagtcttgaactcctgggctcaagtgatccactggcctctgcctcccaaagtgctggcattacaggtgtaagccaccatgcccagtcaatttcctccctttttaaggctgaataatatcccattgttagtatagatcacatgttgtttgtttattcttccatcagtgggtgcttgggttattcactttcagttttaaaacaatctcttgttagtatttaatattggattttgtttatgttgaaaactttggtctcaaactcagttgagatctccttggcatatatctcccagcttggctcagctgctgggcgtgaagaagatgatgaggccttgtcctgagatacaacaccccctaacctcttcccagctctccctcctctctctttcctctccccacccctgcttctctctcctgtccctttccccctcccccaagagtgatagtaagtaaactcacattgtggcaacacccgttggagtctcctgcccttagctttctgttggggagagaatagtctgccacctgaaacactgcatgccctctaaggccaacacccctttcctttctcagactcattctgactttgaggaagtagtccagaatagtggaagggcttagcggtcctgtctccaggaagcccttatgggaggaggctctcagaacttaaattgtggggtactttgtgcctttgtcctcacgtgaaattctgggacaacaggaaaattgccacccaacattgttttaacacttaaaaattagaggggacctagactgatatgatatttataagggctgtacataggagccctgaaattctgtcttctctctccatccctttttcagtatccttcatacttgaagaggaggggttggggtccagtatagaatgggattttaaagtccctttattaatcattatttccagaggcgagactgctccttaaggatagacgtctttgaaagggcttccttcctgttgtctggacccaattgctttaccacatagaaccgtcattactttccctctttttggcagtcttttttgagctctcattgttggtctaactgaaagcacctgatttctagggctttaactgaaagcacctgatttctagggctgtcagtgcagcacagcagaggctgctcttcaaatggtctggcttagtggtttctaacccttttgattaagaagaccactgctaaatttcccagagcctcacctaagtgttgtactttgtgtctcttttgactaatcatatacttaatgacaaaaatttggtaaattagtgaagcctttaattgggcatatttttaatttatgaaagtatatcggcacttgtgcatatgttaggcttatttttcattcggagacagtgcttggtgcattgtagatttatggttccttataaggagtcctccttctgtctttgaagtcttagacacacagcttgggaatggtcctaatagactgtttcctttaaaaaaagaaagaaagaagagcctgtagtgtgattgaatctctatctgacaaggcttaacagtctaaatgaaaacatctaggttgaaagtgtgtttgtgtttgcagtacatttgtgtatgagggtttttgtggatgttttcaaggactgatgaggaagccacacacgggttatttctctgctgaaagggtagaggccaggtcatctgacctactgattaaacttgaaaagggagagtgtgtcttttgccatctcaaaggccagctgtttattgaatttctccaccctgcaattgtcttacatacggaatagttcctggagaaagatctaacatctgcgcaggtctatcctgttctgtggctgtgtttactaaagtgagttctgcgcttacattcacacactgcaaactgcacgtacgatgtaagtgtacttgtcatgtagagttttaccaaaactatattagattatactctgaagcatgttttgcatctgacaggtcgagctcattcattcagtattaagtccctcatgggccaggctctagcctgtgtcctggtgataaggaggtgaatgtgacagaattcctattttcaataaactcactgtctggagaggaaggtgatcatcaaaataaattttagcacgatgtgtaatgattaatgcacagaggatctttggaatctccaggaagaaggcctgacaacctctggatgaaggatgggatggaagataaagtggacttagagagatgtatcgtgtggctctgtctttatccctggaaaggttagcctaagcatggggtaggtgctggtttcttttgctgagaaatgtctcagagaacctcagagtagcaggaggcctttgtgatagattggccagcagtttttatttccctgacctttcagcatcaaaaagtgccagttggaccctgggttttgccttggaattagtaaatagatagttcaacagcaatggttgaaaagcctcttggagtctgtcccatgagagtaaggatgttaattctgaagcctgggccattttccatcctgggaattatactctgccccttcctaaattcccattgtggtttcaaatgaagaggccattgttcactttccttcctaaaagaagcaatatatttaacttctggctctttgcctgactgatggcgagttgatctctctgaagccaacacccgtggcttcctatcaagagaaacactctgcctccatctgatttccttcttgggttgaagttatttagatcctacactggctcagtaggaggcttgcctgccgttatgtcctactaggtggtgacagggcccttgattccctccctgtgtttaatagaaataaagacagagtcttagcgctttagggcagctagttattctcccaaagacctattataggaatttaaaagcaaatgtctgatgtgaaaatctatgctattttagggactttgaagcacaacacaaaagagtatcactttgttgaatagtttgggtccaggcaggtgtcctagagcagaagttttcatttatttttaagcaacaaaattctttctttcccaaatgaaatctcctacagaatccaaatactgaagggtttctcaaccccagcatgcttggtattttgggccagataattcttgttgtagaagctgttgtgtgtgttggaagatgcttagcagcattcctggcttctaccctccagatgacataagtggcacccacattctctagttgtgacaacaaaaatgtctccagacattgcaaaatgtccactggggagcacgatcacctccagttgagaatcaatgcaatataatctagaaaacagacttttaattaagctcctcctttagaactctgcccagggtccctgactgttagtgtttgagacctggtggggcgttctgggctacacagatgcactgtcctagagggttaagttgtcattttaaaaacctggggcatagagaacttgttataaacaaagcaaaagagctaaaattagacaaatccacaagtactttgaacccacatgtacactaaatatttctgtctatgtattatgtatacattgtgtacttggatgtgtagcataagggaagagtcgaagggtggtgtctgccttactccttatgtgttgaggtttggctaccacaatttgccctgttttgccagagatgccagttgaaggcctgtgactgacagcccagtgatagagtcaccctcactgcacaaaatactcagcttctgtgggactcagtggccctggccctgctcatgggcattccgtggtgagtgggccagcacctgcagcctctttcaaccagactggttggttggagcttggaccatggttattccaaggtggatttttatccttctgccctttgtactaaatgggtcatgtgtgcctctgtacgtgtatgtgtgcgtgtatgtgtgtgactacacgtgtctgtgtctgctcttctcctttcagaagcccagagccactctgggcctggccactctgagcattggttgtgtgggggatgctgggagcttggcacatgctactcctcctttttcctcccttagaatgatgaaagtgttgttggagcctgtcccacagacagaaactgtacctcatttatgtgggcatcagtataaacaagaacaataccactatgtgagtcaccctcacctgcggggagacgcataggctcagggagggaatttgctgccagagggtctcagcttcagtctgtctccccggcagactcatcctaacttcattccacagctcaagtgcagtgtgaatcagcaggcagcctgtgcctagctaaaggactctctctgtgttttgtttgtttggttgcttgtgaagatctctgggcacatacagcagtgttttattttcccaaaagatcgcatgaccactacagttagccttgggaacagattgagtaagcacaattcatttgatctatctgcagatctccagcccttctaagaagctcacttccaaaaatgtttcaggagtcctgtagaagtttgcttagagttccttaaagaggctaagcgtcagttgcaatatctctctatcaaccccatttcccccagtgccactgccatgggctggaggagtgggtaacttgcttaggaacttgggtaagggacctgaagctccccacccactctggccctagataggctaaagatttgaaattagtttgatttatgtaaatctctggtgtgaattattgctatcagataaatacacagaccattgaactgaaaacagagcctcaacacaggttgccattgctaatgttagtttatagtagccattatctagtagtgcctttatcagtgaccccaggtgtataattggtttgttgtgaaagaggagtggagttcccaggatgctttttgtcccccatggttcccttataagtgactgtatttcctgagctctctgcacttttgtcaccttttgtcatcaatatatacaatcagtttcaggcaatattgatagggatgtgaaaactaaacactataagattgaatggacttaatagctaggagttgcagaaaatattcctacatgtatacataacttttataatgtacaaattgttcttatgtgcatactcttgcataatcatcacaagtcagccttgtgacttaggctctctcttggccttatcttgagagaatttatgaaatctgataatattgcagccccgtaggaaaacttttcagtgccttgctatgatctctgaaggcctatactcctccttcccttcctaggctggtattgacctgctttttaaatctcatctcctaccagaccttcatattcattgtagttctagcagtagtgtactacttgtaggtacctgaatgtggcaagctcttttctacttcttactaatttatggaaacaccaatctacccattcattctttcactgctacttgtatgctaggcattggtgatatcccctaaccccctggtccttggtctaagcaggcataggtggtgctgtgtggtaagagctttggtcttggtgctaggggagctgtaaggagggcaccaagccttgacttgaagggattagggaggcttctccagtaaggcatctccaaagtaagtcattttagtgtgaggtggatgggagagttaggagaggagaggaagaaagagattagggcaggtgtggaccccaggctagacagggatggatgagtgataaggtcttgatagtgggtagtgccagatgcaggtgtatagttttgaggactttgccctaaggcctgaaggcagccattcaatgtttttgttttttgtttttttgagacagggtcttactctgtcacccaggctggagtacagtggcgcaacaatggatcactgcaacctcgaactcctgggctcaagtgatcttcccacctcagcctcatgagtagctggggctataggcatgtactaccatgcccagctaaatattttgtttttctgtagagacagggtctctctatgttgcccaggctggcctcaaactcctggcctcaagcgatcctcccctcctgccatggccttacaaagtgctgggattataggcgtgagccacagtgcctggccaattaaatgctttttaagtaggagcatagcagggtgcagattgctgcaaagcacctttctagaatatatcctgttcccctcattctccctctagtactttctagtatataccccgttcccctcatcctccctctagtactctgctgcttaggctttaggttcaattcaggcatcactgtctctgtatgtgctccagattccccgggcaccatcgggggtccctctgccccacagcaccctggacatgcatactggagataaagcagcaattgcttttgtattttaaccgtctagttgtgtgtccttcctcctagaccactggttttcaggatttaaaagtgtagattcttgttgcccaccccagatattcttacttactgtgggatagagtctaggcatccccattttttttaaaagaagcagaaacattgcagtaggctaatcttattgagggcctggtttatacattatgtgtgtgcacacacgtatgcacacacccccacatacttgatctcattcatgcttatatctgtatttcttttatttttattttctttgatcctgtcattcaaatatccatatttcttaagaatgtccggtataaatttgctatgctacaaatgtttgattgaatgaatgaatgaagttgcccaaatttacgtgtgaagatgtgttggagcctaagttaaaattcataggtgattccgaggcaaggccctttcacagcatcactcttacaccacagttgctacactgagatggcctttgaaaagcaggcagtcccactgaaccacagtatcctagagactaagaaacggggacaagagatctttaacttgcattttataattttcagtggcacatcaataatctgcagggatacactaataagatgggtattggacactcattacgacagaccctggaggatccaaaactgtaaaatctagctctgatctcctacaaatttttggtctacttgagggtaaaaggcagaaatacacagacagttgaatgattgtgccagatcgtgacagttacctggagtaccgtgcacagaagggcaatagaatgatgcagtgactgagtaagaaagagcatgccattagctggagtggtctgcagatacctttggatgaggaagcacttttatgaggtttggctttagaaaagtgagaagccattccaagtgggaggagtgacatgagtggaatcctggcaggagatgggctatgaatggtgagggcatcagtttgacaggaacataggtttgtttgtgtaggggagtgatggttgacacctaaagggagtgctggttcaggattgggagggccttaaatgataggtggggctataatacagttggggatgtgtggcacattcagcaatgtaaaagtctgttgtcctcgaccccagatccattcaccttattaatgaaggtcatgaatttttaaatataataactgatatggataggttttgtgtcctcacccaaatctcatcttgaatcataatccccaggtgttgagggagagacctggtgggaggtgattggatcatgggagcagtttgctctttgctgttcttgtgatagtgagggaattctcacgagaactgatggttttataaggggctcttcccccttcacttctcccacatactctctttctcacctgctgtcatgtaagacatatctgcttccccttatgccatgattataagtttcctgaggcctccctagccatgtggaactatgagtcaattaaacctcttttctttataaattacccagtttcagtatgtctttatagcagtgtgagaatggactaatatagtaaattggtactgatagagtggggtactgctataaagatacccaaaaatatggaagcaactttggagctggataacaggcagaggttggaacagtttggagggctcagaagaatataggaagatgtggaaaagtttggaacttcctagagacttattgaatggctttgaccaaaatgctgatagcgacatggacaatggagtccagggagaagtagcttcagatggagatgaggaacttcttgggaattggagtaaaggtgactcttgctatgctttagcaaagagactgacagcattttgcccacaccctagagatctgtggaactttgaacttgagagagatgatctgaaattggaacttatttaaaagggaagcagagtatagaagtttggaaaatttgcagtctgacaatgcagtagaaaagaaaaacccattttctggggagaaattaaagctggctgcagaaatttgcgtaagtaacaaggagccaaatgttaatcaccaagacaatggggaaaatgttcctagggcatgtgaaggacttttgcagcagcccctcccattacaggccccgaggcctagaagggaaaagtggtttcatggactgggcccaggaccctgctgctctgtgcagcctaggacttagtaccctgcttcccagccactccagtcatggctaaaatgggcaaatttttaaaaagtcagctcaggctgtttgcttcagagggtgcaagccccaatccttggtggcttccatgtggtgttgggcctgcaggtatacaaaagtcaagaattgaggtttgggagcctcagctgagatttcagaggatgtatggaaatacctggatgtccagtcagaagtctgctgcaggggcaaagccctcatagagaacctctgctagggcagtgcaaagggaaagtgaggggttggagcccccacacagagaccccaccgtggcactgcttagttcagctgtgagaaaagggccaccatcctccagaccccagcagatggtaaatccatctgcttgcactgggcacctgaaaaagccacaagcactcaacaccagcctatgaaagcagccaggagggggatataccctgcagagccacagtggtagagctgcccaaggctatgggagcccaccccttgtatccacatgacctagatgtgagacatggagtcaaaggagatcattttggagctttaagatttaataactgccccactggatttttgacttgcatcaacctgtagcccctttgttttggccaatttatcccatttggaatgggtgttcttatccagtgcctgtaccaccattgtatcttggaaggaactaacttgattttgattttacaggcttataggcagaagggacttgccttgtctcagatgagactttggactgtggacttttgagttaatgctgaaatgagttaagactttggtgaactgttgggaagccatgattggttttgaaatgtgaaaagatatgagatttgggaagggccagggctggaatgatgtggttaggctttgtgtccccacctaaacctcatcttgaattctaatccccaagtattgactagagacctggtgggaggtgattagatcatggggggtggtttcgtccatgctgttcttgtgatattgagtgagttctcatgagatctgttggttttataaggggctcttctcccttcacttctcccacacactctctgtctcacctgctgccatgtaagacatgcctgcttccccttctgccatgattgtaagtttcttgaggcctttccagccatgtgtaactgtgagtcaattaaacttcttttctttataaattacccagtctcaggtatgtctttacagcagtgtgagaacagactaatacaataaccatgttctcttctttctggagatctccagccacatttgacttccaggtctgtgggaagcagtccaaggtgcaacctggaacactttcatttggcttcttcatgtagaggaacatttacatgtcgctgcttgttccttctacccatggcctacacacactgccaagctgtcaccttccctgttgtgcaatgtgtttgccatcaccttcaatgaaaacaatttttttaatgtcagaattttcttagttattaatcccaaacacagacaccagaaacatgatccagaataaagttttcagttcacactgagcttgtcattgctgaagtaagactcttagctctttcaccagtatggacaaaattcagtaggaatgttttcatcacaagtcttacttcttaataatgctttgatctagggtaatttctctttagtcttggatggtaattttgcctgaggaaagtccaagaggtcttatgtgaagatttctgttttgtttagagtttgccacaaatactggaaggagaaagttttctgtaatttatacagctttacattagaaggctatagcttattttaaaatggtttctgttcaaaaaattttcacctacaattatagtataaagtgccttgtccttgtattcacagaggaattttctcatacaactacaagaaaatgtggaaagtttcgtctgagaaaattcaactttttcatctctcataatttactgcttcaggaatgcaatttaccaaagtggattagaaactgtttgtaatggggaaatacgtgcactctttgaaggcagttgtcgacaaagagtcaaactctaaaatatttgaagaggtttattctgagccaaatatgagtgaccacagcccaaggcacagtctcaagagatcctgagaacatgtgcccagggtggttgggttacagcttgattttatacatttcagagggacataagacatcaatcagtacatgtgaggtatacattggtttggtctggaaaggcaggacaacttgaagcaaggggtggggagttgtatgggggagggtgcttataggttacaggtggattcaaagatctgcttattggcagttagttgaaaggataaattagttattatctaaggacttagaatcaatagaaaggagtgtctgggttaagctaaggggttgtggaggctgagattcttattatgtagatgaagtctcataggtgtcagcccttagagacaatagatggcaaatgtttcctatatagacctaggaaaagtgctagactcaacagttaatctctttaggattgggaggacctggaagaggaaagatctagttatgttaaagagattctttacggatgcaaattttcctccacaaaaagatgctttgcagggtcatttcaaaatatggcagagaaacatattttgggataaaatattttgattttcttctttggttgttttgtttgtttgtttttgagacagggtctcactctgtctcccaggctggagtgcagtggcgtgacaatggctcattgcagcttcaaccttctgggcttaagtaatccttctgcctcagctgcccaagtagctgggactacaggcatgcaccaccatgcccagctaatttttgtatttttgtagagacagggtttcatcatgttacccaggccggtctcaaactcctgggctcaagtgatccacctgcctcagcctcctggagtgctgcaattacaggcatgagccacttcacccagctgttacctttatctatcatgtgatgctagctgagtgtggtggctcacacctataatcctagcactttgggagactgaggcaagtggatcgtttaagaccaggaatttgagaccaacctgggcaacatggtgaaacctcatctccacaaatatatatatatagatagatagatagatagatagatagatagatacacacacacacacacacacatatatatatacacacatatatatatatatatatatgtctctcacacgatgctataccagagtcaggttgagttggtatttttgtagagacagggtttcaccatgttacccagactggtctcaaactcctgggatcaagcagtctacctgcctcaccctccgaaagtgctgggattataggtgctctgcactctagcctttgtaacaataagggtctattctgtcggtttcaggtctctattttagtgttaatgctggtcagttgagtctaaactccaaaagggagaggatataatgaggcatgtctgactccctctttgcgtcatggctttcactagtttttcaggggttttttttaatccccttggttgagaaggggtccattcagtcagtagggggagcttaaaattttatttttggtttacaaagtgaagagctttcctcttttaagtcctcaccatataaccagtctctaccagatgctgagaatagcttaaactttcttactgtcttatttgagcctggggtggtttgttgtaggaccttatcaacatagattttttgataattgatctactttacttcgatgtctgagtaaagctttaacctggcccttaaacaccaaaaatgctttagtgggagctcttgttttgggaaaatgaaaaatttctgtgtctatcaatcacggaaagtattccccactggtttgattctgaaattcaatcattgcctatgaaagttaaaaacatttttttttccctgtagctagcttttactctgtctctttaaaatacctttttttggaggagaggtggagcaagatatgtgtaactatagttttttctttttttgcttagatggtttaaagaattctgcatgtcatagttgacattccatcattatcctgtgttccacagtcaaggccaaaggttaaaaataagttcttaaaggaaacaaaattaaagcaagagggaattacctctgaattgttttagggactcctagcattttgcatgagtttctgttggtctggagaatagaaggaagcatgaaaggtttcattccttgcaaatcaagtgaaactggctcctaccctcttcttcaatacaaacatgaaacagaaaaagtagactggaagaccagaaagggcacagatttttataccattttcatcaggattactatgttcatgttatggaaccaatttgtaagttttgggtaacagcttaaatagaaacctatagaactgaggcaaccttctgtttctcaaagacagatggtgaagcaacatttataaatgctttacagttagagagcatatgctctcgtccactgttttttgtctttgtgatcaaagaaggatttgaggaatttcttttaaaaatcagtctgtacaataactgagtacattactttcagataatggagaatagtcacacccattgttttcagggcctcagggaatcctagaatgtgtgtcttgtggactgtgtcatagttggctagttacagtggcagttactaaaatcaaatctgtttcaattaataaagaacttgacaatgaaactaacaagacccattctaaagacgccaggaaaataaaataaaaacccatatgtactaggaattgtaaatagagaggaagcagaaacaatgtaatttgaattatcttattaaaattttaaaatattaaaatttaactagtttctcttattcagctagagacggtataaaaacttggcagaagtgtgatttttgtctatctgctggccagaataatactatatagatgggattttgtaggttttagtctctctaccccgctgtcttccaatatgtatgcagaaaaagtaaacatgatccctaacctttctgaaaccttctttaccttcagtctacacatacatagtcttgggcaaagagttatcaggtaaattccatggaatcaagagtagaggcatatgttgcttttcttaataggaaaaacagtgactgtgtccccctaaataaagtcatgattcaatgaaaagacaaacagcccaattttaaaaaaatgagcaaaagatttgaacagacattttctcaaaagaaatatgaatgggcaatacacacatagaaacatgctcagcaattttaggctttagggatatgcaaattaagaccacaatgagataccactagaaaggctaaaatgaaaaagaccaacaacactaaatgttggtgagactgtggagcactagaacttttcatatttttagtgggagttcaaaatggtacaaccgctttgaaaaatggtctggcagtttcttacagaactaaacagaccactaccttgttacccagcagttcttaggtatttacccaagacaaatgaagcatatctctgtcaatagaaaagcagatgccagccatggtatgattttgaacagccagtggaataaaagaatagggactatatctgaccttgctgttagagtagttaggcagatatgagcggggcaggagaggcccccctcccccacaggaatgtcaggcaaccatcaggtgatggtcaggtggttgttaaactgtctcactaacatactagttggtcacagcttgcaccagggaaagcagactcccagtagatagaaaacaccttaagctcttaatcagcagcttcctttttttttttttgagatggagtcttgctctgttgcccaggctagaatgcggtgtcgtgatctcagctcactgcaatcgctgcctcccgggttcaagcgattctcctgcctcagcctcccgagtagctgggactacaggcgcgtgccaccacgcctggctaattttttatatttttagtagagatggggtttcgccatgttggccaggatggtctggatctcctgacctcgtgatccgcccgcctcggcctcccaaaatgctgggattacaggcgtgagccgcggcacccggccaatcagtagcttcctcataggatctcaggcgttggatgagtgggctcaaacttgcatgctaagagacaaaatggtggagtttagctggtgtatgaccttcctctaggaacactcaattggtaagggaaaaatgcctcaaatgaacatgtgcacagcttcagtaaacacactgtacatgcggcccttcccaagtgctggcaggccactgcacatgcggacagcccaccccaaggaaaaaccaagggaggagagacacaaacctcagcaccatgccattgtgtaaaaatcccaagtcaagcgtcggacagggtcctcggatctctcaaattgcccacttggccctcttccacgtgtactttgcttcctttcattcctgttctcaaactttttaatatactttaactcctgctctaaaacttgccttggtctcattctaccttatcctctctggccaaattctttcctccaaggaagcaagaatcgagttgctgcagacccatatggattcgctgctgctaatgttgccatttggatttttttttctttttagagtgttctagaatgcatgcttagagaagggaatgtaatcctaggacaccactcagctctgcaacagtatagctctgcagtaatgagtaaatgctgtttgttggtttactttaaagctctgctactgaatatatacaaatatactgttatattttcctggtaaaaccttttattatacaatcacttctttttatttctagcaattctttcttttacagtgtattttatctgacgttaatgtggctgcattgcatgtcttttggctagtatttgccctgctttgcatcttctttaattcatttactttctactttttctacctatgtcttaggtttgtgctttataaacaacaggtggttagatttcctatttctagaagtttattgagattctccctctaccactgtctctaccaattccattttttcccacctctattggtttggaagatagaatctctctctctttttttttttttttaagtgattatacttggaattttaacatgtctgtgtaactaagtctaaagttagctaccactttaccctcctactgagcaatctaaggatgttagaatgtttttaactccagtcactttcctcctggcttatgtgcatttccttgatatttttgatatctttttatttttcttttgaagctccattaactagatgttattagttattccatccttctttgtttctatttacttacatgtttataattttttaacataccactttcttgtatagctcaaaccttccctcgaacatttccctccttcttcaagtagattctcttcaagtacattctttatttagcgaaggtatttggtagtgaacaatctcagttttctgaaatatctttattttgccctcattctggaaagctagtttcttactttatttttttaatagacagagggtcttgctttgttgcccaggctggtcttaaacttctggcttcaagcagtcctcctgccttggcctctcaaagtgctgggattacaggcacgagccactgcgcccagcagtaacgctagtttcactgggatcatggactcttaagagctagaaggaacttcactgattatttgactcagccttttccatttccagaaaagcctgccaccaggcacagaaagaatacatgacttccagaatccctcgctatattgtccagactggttttgtactcctggcctcaagtgatcctcccacttcagcctcccaaagtcctgagataataggcgtgagccaccgtgatcccctttacctttttctttttttttttcctttatttcttcttaataaaaaaaaagtggggggggatacatgtgcagagcgtacaggtttgttacataagtatacgtgtaccatggtggtttgctgcacctattgacctgtcctctaagttccctcccctcaccccccaacctcttcaaaaaaaaaaaaaaaaactatcaaaaaatggtggccgaggttcaaagctctcaccttggttttgtgataaaggtggttaatctttggtgttggatttcaaattagtctgtttacagtgagcaacagtacagcagttttaaaaatcatgttgaatcagaaacatgaagaaggcagcagagctttctctccaccatgcacttggagaaggaaatgactcggcagcatactcctcatggctaatatcctttaagatttttccaaaatcatgaaaccagaacttgagagcttaaaagggactttagaagtctaccagtggataagagagaaaaaaaaatcaaaagggaaatggaataagccaaactaaagggcaggattcttttagttctcagcaggaaacatatgtttatctggaaaagattttggttggacaggttgtttgtgtaagaatcttttttgtgaggaaggaagatcaacctgggcttgaaggctggggtgggggtagagagaacagtccctgagcttcaagtaaatgagaaaaatacacagattttaaacagaggagccctgctttcacggggatcatatgatcgtgctatcagcttacttttaagttgtgataatgtatacatactttatgaaatatgattaaatggtaactttagtattagtggctacaagaacagaaacagcaacttttaaaaagatatgaaaagatgttttgggtgaaagtagttggctgcgcaacacatagagtataacatacatcattaatttaagactgtagatgtacagtatatatttggcatgtacaccaggattttcagtgattattgatgtaataagatttatgatttttaaaaagaaactcttcatgatagttttctgtaccacttacattttccatagtgatcatcatattgtctttataaacaatgacaacaataaatcaaaaagagagatcttacatggtgcctcttctctgacagctgagaccacatcatagctacgttgttcccttacattgcatttacattacatttaaaatgttatcaggaggacagaggctcatgaatgagacatgttctctccagttaaatttagtaaagaagaatcagagaaaaatctccagataactggaaaatgtttacattttcaagtatataaaaccaggatacattatcttgtttaagcttggagttgacaataataccattttgagatgtttttcagatagaatgacagtgagagtcatagtggggttgcacctccacatgatgcaacccaaatgtgatggaacagaaacatttttcttcatcatcctgaaaccgagcagtgatgatccgctgaggaatgtttaattttcatgtattaaaaaatgaagaatgtctgacctactgttaatgagaaaaaaaaacaccaaaaaggaagaaagaagaagtggcagctaaaagcctttttatggatgacgtcaatagaggaaaatgaaatattcatagaatcacagcaagagaataggaattctgaacatttttgtagaaggaaactgtaggattcttgcaattgatagtaggacaggagggaatttccatccttatgtgtgcagaaaggagtagacacagtgaaatttgaagactattgtaaacattttctacttcacttcaccttgaagaagtctacagaaagcatatatggcatagctgggcagagtggctcatgcctgtaatctagcactttgcgagaccaaagagagaggatcacctgagcccaggagtttgagaccagccagggcaacacagtgagaccccaactctactttttaaaagattttttaaaagcatatatggcagttaaatttcagtgagaaatcaggaccagggtaaatgtaaatacattactatagcagataaataaatatggatgccccacccatatttcctttcatcccacaacagaaagctggaaatgctgaaaaattaatacctcccacccctgaagcagccatcagccagtgaggaatgggagccagaggataaataacccaacttcctcacccgctgagggtgttcaaccaggtccttgaaattcccgacaggaatcgagcctcagttgcccaccctggaaacctgctcagtaatacgcttatcgttggtttccttccctttcctgtctcacttctgtaatcccctggtgcatctgggggttccttcccgaataaactacttgcaacttaagtccctatcttgaactctgctcctgggggaatccaaacaagaacaggtggagacagagtagaacaaggataagcaaagcaagagaggagatctgaagacgtctctaaggttgtttgagtgactccaaggatagtggtacaattagctaggagaaagagagggtggaggaggccgagaagagggttcagcccaacaaatgccaagttttaggtagcttggggataccttgaagagatgctgacaagctacttagaaataagtttattagctagaagccggagctggccaggcacagtggtatgcacctgtagtcccagctactctggaggctcaggtgggaggatggcttgagtccagaagctgtttgaggtcagcctgggcaatgtaatgagacctcatctcaatatcaacaaaccttatctcaatataaatgaatgaatgaatgaatgaatgaatgaatgaaaccagagctatagctgtatatttgggaatcctcagtgtacaggcagttgatgaatgaacatccagaaagactagaagcatggtatgcagggaaccttggagcatacacatatttaaaaattgggtggaggagaaaagccagtgaaggagactaagaaagacgattatagagagaagaaccagagctgttattggagccaaggcctctttcttcaaggactgagaaggggagagtttgtactttggagtttgcacagatcacagacatgaaaaaggaaagatgatgatgagtggaaaatgggaggtcaggactctcctcccatcctgatgtggcaagaggcttttctcatggttctggatggaactttggccctgttgcagatgctcacatgcaacgttctgttctaatcactgttctgctggcagaggaggctggagtgatgagtgagcatgggctcagcttgcgtggatgctatgagccgtaggtcctactcaagagagtcagtctagtaacaaattattttcctctccttcttttgccatcccatttagtttgcaggatggttggtgtttgtgtgggctgagattcctcagagggaaccaaagccctgagaaacatgtgtagcagctgttgatttgggtctccacagtgagatccgggtctaatacagtgagtccaaccactttatctgagtttggaaataactatgagttacatagttaagctgttttcaaaaaacacagaggattctgtactgctagtgccattgagggggcttttgctgccatttattttcaacttatttttttgaggtggagtctcactctgtcgcccaggttggagtataatggcgtgatctcagctcacagcaacctctgcctcccaggttcaagcaatcctcctgcctcagcctcctgagtagctgggattacaggtgcccgccaccaggcctggctaatttttgtatttttaatagagatggggtttcaccatgttggccagacggtcttgaactcctgacctcaggtcatctgcccgcctcagccttccaaagtgctgggattacaggcatgagccgccacacccggccttgctgccatttttaaataccaaaaccttttgttgcagtctttgtcacaggtgctggcacaaaattcctggtaccttctccctgctctaattcaccaagttctccttcctcttttccaaagactactaacatggaagtcttccttaattagttacaggactatatctgcaactcctgtgatttattcgctcagtgcccgtgtcactgtcacccactggtggggtgtgcttgttgtaaatacccatttaaatgtttacattttcaagtatataaaaccaggattgtaaaataccgttgtatttccagttgtaaatagccgtttagttaagttaggcatttgtttatcacgcgtcctaatctctgtttgtgtcgttactgtctcagagatcatcatcatctgtgtttacatttttatgcatcattctttatgcaagtagttcttattcagtgtttttgatgatgttaagcaaaattctgttgctaccttacctcattaccttcccgggatatattttgcagatataaaccaataatattttctggttctttcttgactagtagcttttggttaactctaaggtttttctgtttgtttttctcacagttgttttctcccacgtgtacaaatgataaaacaaattatctcaggaagaagaaaaaagacatttgatagtatatccagtagttcaacaatagtcaacggagtctggtgtcctcacttctgtcattggctgcttgacctcacttaaccttcctgttagtttctgtttcctcactagaaaatttattactttctagggataccaggagacctggtgttaataaagggcacagtgcagggtgtgtggaagattttagtgtcagttctagcacaagctagctaaatgtgtctcggggtacattaacttctctaggccccaatttcctaggtattcattcttcttctagacaatagacagttgaattaaaaaatcctttctatcgaccaggtgcaatggctcacacctgtaatcccagcagtttgggaggccgaggcaggaggatcacttgagcccgtgagtttgagaccagcctagcaacacagcaagaccctgtctcttaaaaaaaaaaatcctttctattcctagaactctagggtagtgtgaagtaagggttttcacagttacactaggtaagttactacctgtcgggtacttctctaattatgctgtgcttattaacttatcaagtcctcaaatggccctatgaggaacatatcctttatgttctatagatgaggaaactgaagcattggatgttaaacaacttgcccagggccaccgagcttataagggaagaagccgtctgcacaccccaggctccagattccacagcctcaaccaccaaactctcttgtctgtcgtcatatagaaggctgttctgttttctcagtgtagcccccttaaagataagccacagtaaaccacagtgcttttgatattaggcaaattaaacttgagttcaatcgtatgttacactgaatcaaagttatattcgctgtgcattttacgccagtaattctggaaactaaaaagtgccatgccagaaattttctctgatttaatttgcttacaatcattttaaaaatgaggagctgtgatccacgcttttgccccaggttggaatattttagaagtactttcaaatatatatttctgctgctgggatataaaaccataaattcgagcagatagaacaaaagaccaaagaggatgatgtatttactgtttttgagttaaagttacaacagtttacagaatcacagcaaccgagaataggagttctcagagacatactcctcatccacagaagcctcacatgaccaacacaagtttcagtccagtgcaactttttgcaaatgaaaacttaccctggggttgtttggtgactcctagtcacatgtgctttctaaagttctcaaaacaagcatggggtgacagtccagttttatgaaatataattttagttcagaagagatgggattttagaatagttaatcttcattatatttgacataattactctgcaccctgtggatggggtggcttttcaaaacccacttctggtgaggcagaccagggctccaggccagcacccctctggagattggaatgtgaatttccgtgctgggacacagagccagcttcctatttatttagagccattgggcacctaaggagccaaacagaagttgtgatgcaagttttggctgcagagcatgttagggttgcctgacgtgtctaactaaaacatgatctgagagatttctcaaagccctggttgatttaagcaccatagtattcaatagggtttttttttagtccttttaactcagtcctaagtaaacaggaggcggtgcaaacaatgaggaagttccctctgcattccgatggtgaagtggggttggagtctgtaggcaagtgaagagcgtgtgggagagctgtttccttttgctcatggcagcagtctagaacatggtgacagtgaaagtcattggaagccatgggggcccattttctttatgtgaccaaatgtcttgcaaagtcccaggtgtgtgtgtaggtgcatgagtgtgtatgtttgttttctaaacgaagcacacgtgcaaaataatgtaaaagggcagagtgaagtttgtccatgtccctgtatgaaagtgcatgggaagtgcctggggcagaagtgaaagagacacggccccaggtcgtgagagaagacattgaggtgcactcccggcctgctgtgggaacagtgggttagcatgtcaccggtgcactcccaggctgctgtggcaacagtgggttagcatgtcacccggctttaggatttgggggagtttgctcaggctctgaggcaggtaggttaaggctaatttaactcttaatggttggaaggaaagagggaagggccgtttaggaaggtgaaaaggcaggagtgaaggtggcaagaaatgattggcatgcagttttttcctaaatcctcctctggttataaggaatcaactggaaaattgcagtggcaatagctgttaagaaaaaaaataggattcaattgatgaaatattaaacatgcaagtgggctggtcttttaaccaatctttgtagtattaagggattaaaaagttaattcttggtaattagatccccagggagaacttaatttgcatctatacatgataagtgtttactattaataattcaagacaagttttgctttggccggtattgagctgggtctcaggctggtgataacagaggctggatagagagtgataccattagcctaattttgtcatctgcaagcaaaggaatgttaaaatctgttcacttcgtggtttctaaatgacttctagaagtatcatgagtggaagagggcagtgtagtgtagtaacttttgttcttccgcagtccttagaacctgtcaggattattggttatgacactgttcccacagggtggacaacaggggcatttttatcttcttgagacatatgggaaacttaagaaggaaagtaactaggctgtttgccaaagattacacctacctccaaacaaaaactgaggcaggtataattttaactgtgctggaatctctgaagatgttggtgtcttggccaaattcatttggactctttctgcatttcactctttgagatctattgtgtagactctaatttctttgacaggtattgtcacattggtctccacaaaaattattattgaaagccaggcatggtggctcacgcctgtaatcccagcactttgggaggctgaggcgggtggatcacaaggtcaagagatcaagaccatcctggccaagatggtgaaaccctgtctctactaaaaatacgaaaattagctgggcttggtggtgtgcacctgtagtcccagctgcttgggaggctgaggcaggagaatagcttgaacctgggaggtggaggttgcaatgagctgagaacacgccactgcactccagcctggtgacagagttaaactctatccaaaaataaaaataaaaaataaaaaattattattgaaataactacattttttttcttttttttttttggagagaaagtcttgctctgttgcccagctgaagtgcagaggtgcaatcatggctcattatagcctcaacctcctgggctcaagtgatcctccctagtagctgagaccacaggtgcacacttggctttttttaaaattttttttggtagagaaggagtttcattatgttgcccagactggtctccaattcctaggctcaagtgatctcccacctcagcctcccaaatttctagaattaaagatgtgagccactgcacttgccctaaataactacatttttttgaatgctgcgatgtgcctagctttgtgctaagctctttgaatgtgttacctgattcagtccttgggaaaaccctaggaagaaggggccacctgatttctagatgggaaccctgaggcttagcaagaaaaagagagccggtgcggtagggtcaggactggagcccggtttatactccgactgacaggatggggatgcctgtttcacctcacccttgttaaaaaggacactttagcaatccttttaagtatttgccagcttaagaggtaaaaatgtgatttagcttctggttcttatgcgtccgtcttgggtagcattggacatcttggcatggttattggctgtttgcacttacagttttaggaattgcctcttcacatcctctgccccatttttacttgattgttcatacttttaaaaattgatttctgtgtattataaatagtaaccctttgtcatgtgttacaagtcctcttctccctcagtttctttctttcaattttctgctttgtatttttttttttttttttgccaaatagaactttaaatttcttaaattgcaaatctgtgaactttggatgcctttagagtttattatccctttaaaaaaatttttttaagagatggggcctcagtatattgtccaggtggtcttgaactcctggactcaagcagtcctcctgcctcagcctcccaaagtgttggtattacagacatgagctactgtacccggccaagttttattatccttatcttatcctaggagtataatatttttctgtgttttcttattgttctataatttcctttgtaacaggtatctgagattatctttgaaatcttctgtctcttccagggtttaaaattttttagcaaattattatttcatggtttcttaaatttcctttgtttcaatgattaaagcattattgaggaaataagctatattttattaatcacaagtctctgcatacactagaaaaattctagtataattatttggaagacataatgatgtagttttcagagtcctcagattagaagccactgttttaaaagcgtgaggttagaaaaggaattttgcacctattccaggttaatttctacctattccaggttaacagaggtgatcctgtaccaatgggttttggacagagctctcatagtctgtgctgtgggcgattccctcatttagtttgcgaggataccagaattaaaggaaaataatgagaaatgcttatagcccatagatagacgcgaggtcacagacagccagactggagctaggagaccatgctgatgtcacatactgccctatcagaaccctgggaaacccttggtctgtgctacaagagattggcccatgatagccagttataaccaggcagtgggcatctcaggggtttgcatgggtctaaccttaaaaagccacatgactgggtgcggtgacacacacttgtaatcccagcactttgggaggccaagacacaaggatcacctgaacctgggagttggagaccagctctggcatcacagtgagacctccatctctattaaaaaaaaattatttttaattagctgggtatggtggtgcatgcctgtagtcccagcaccttgggttgctgaggtaggagcatcacttgggcctgagagttcaaggctgcagtaagccatgattgagccactgcacttcagcttgggtgacagagtgaggtcctgtctcaaagtaaagagtcctgttaggaagccataatgattttaggggggatggtttagatcttgaagaaagaaaaaataatttgaggagtgagcacttgaactatcaaactttctcatctattaggtgcgttaggttccttacatcttattctttttttccttccttttaatatatagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggtaaggggttcccttacttctgtcctcctcagagcttccatctaataggcttcctctggttatgtatgacttcagcagaatgcatgattatttaagaattctttcaggatctgatttttgcctcttactctagtatgttgacccagtaatttaaatctccattgcaaaaacatctaaataatttacagatccaagttttagataccatttctttttaaaatcatcttggtaaagatgctaatgaatcctaaactggtcaacaagcataaatcagagaaaaaggctaataagtcaataaacaatcagtaaattggataatcagcccctaaggaccaaagaataatcaacagtattgctttaagaaggcatgaatcgcataatgacttatggaaattaatggttgcgagaaaactaaacacaaagtagtcttcggcctcttggtatgtaacagaagataatagccttcagtgatcatatactgtaatctaatccctaggaattagtaggaactaagataattcaacattgagaaattctagagatttggggcaatatcttactagacatacaactgaagcttaagtctcagtctcagtggcaaatgtaaaataaatttaagcagtagttatctttagtgataaattaagcatacttatttggaaagggaagaaagaaagatgccctcacacacccatctcagaaggagaaaacacagtttggtagcgtgaaaggagatctatatttttgttgtcaactttaattattttgtttagtgaaggcagaagcccttggatcagagcagtttctgaatgttgatcaattactttgtattttgttttctgtgattattttggattttatatcttcaacagtcagaacctagggctagttagtatttctgacatttttaatcaagaaacaacgattttgagatgctaaaccagctgtagatatgaagccaacaaatgtgtcataacatttattgtatttagggaaaaaattgtattacttttttttgggaaaaaattagcagccctggcgtctttgagttcacgtttcctctttgcatgaggctgcactcgacttagccacagccccacctctctgtggtttgctcacttgtgacctaagggtgcttgcctcttgcagtgtatttcatgtcacacttttctgtttcctttacatgacctgccaggcccctgtaggcattagtggtgatggcccctgacctgaactgacattcataatggaaacttatttgatcatttcactgacttttttccaccagagaaacattaactgtacccaaccagcctttaacgctccccgcctccacacccatacactgtcaccctcatactctctctctcacacacacttaaaatattggtgtatatattaatatatatggctaagagtatggactctgacatccagtctcatcaccaactgggtgtgtgacttagtcaagttgcgtagcctgtcaatgtctcttcatttgcaaaatagacacaacaatcttattttacttgtataataaactttcatatagtacttaaagggccaggcactattgtgagcattttatattacaacttttaatcttcattagagccctgtgcagtaggaacggttatcattagtcccttttatggatgaggaaactgtggctcaaagcatcaggtcatctggcttcagagtctgtgctcttaaccatgttattttgtgtgctgcctcccgtggctttttgtgaggattaaatgaaatggtatatatcagctgcttggttcagtgcctggcacatcctatgggcttagttactgtggtctttgttaatgagaatgagaatactcctaatgttaccatcattatcatcacccatagaatatatttgggagaggcaaagatggaagtggtgggcctgaagggcatattgtggcagcaactctgcccacctgtggactccaggggtgatatggacacagggacaagggcaggtcccctgggacaggcagctgcggtagactcatctgtgcacttccacagtgtatctgtgtccgtttacttcagcatctgaacatctttatgtgagagagaataaggtgggaactcttcaggccaaggcttaatcacacgtacagatgaggatttattgccattgaggacttaggaaattgccatggaggtagatggaatgggaatggtttttacccacccatttgtatcatacagcacattctaatccagcacatggttttttctggtgtctcatagtaacaaacaatggctcagaaagcacatgatctttgcttcttccctgaaattgtgtttttcataaaggaggagaggatgaaatttgttttccttaaggactataagagggttattgctgaaatacttgactgatggtagttttcttctcttcaacaggggagtgtttgggaaacagggttatcagtgccaaggtaaggaaacatttttaaaaccatgtttcattttgttcctatgttaaaagaaatgattataccaagagaaaacagggtatcttcccttaatattgtgataaataactctctgtaggtcaaaggaaacccctgtgtagatacaactctttagtttggtgagatcttggccatattttagacaatgtaaaggggacgtttttatttctaaagccaggatacctaataaattttcattgtttaaagtcttgtctctgcagtaacatgagagtactaaaaggtaatgtgattttgtgagcatactcttaaattttgaagataaacttttgttttttacaatcctattgataatagatagggatgaaaagtagcacactgctgttttctctttttccccgtccagggaacataagctattatccaagttgttttttgaaatgttatgatttcaaaaaaaaaaaaaaaaagtgagaaatgttcaaagttaagctgtcagtgatcttgtaagttactacatgttatatttagttttcacaatctaagatgaaaccaatttactagtgtttctagcataattggaaagaaatacaatggcaggaatggaagaagagccctcagtcaggtggtttagccaggcccatcaggcttgcctgtcatttgggttcccccttaacctttgacatgagtatcatcacatagtttatacacatggtacctgtttcactatgtggatgattgataaaatagcaccacatatcctagagcagtagcctatgtgtggataagaaaatctcaccttctcttctggaagatgtgaggtaaaacattacttcccttggatggactgaataagacatactcttggatctaattttgactttactatgtatgaacaattccattgaactttcaaagttaggaaaaaacaaatatataatcaatatgacagcaataattgacctgtatgctgttaatctcagtcccaagtgagaagacagttcacaagccagaatcgctgtcactttgtggcatgggcctgtgagcacaggaatatgccctgcagtccatggtagcccatcttatgcacaccaagataagttgagaagctctggataaacaagattatggttttgagtttaaaacatgggatttaagatacatctctattgttattttatttctttttctctttgtcctatagtgcctggatatttgatggcctgattttcagtgggtcacctgctatgtaaagagcagggaagactattagttaggagacatgcagacaccactttggtgatgtctccctaaggcatataaaaccaaatgcctggttggagagaggtatgccattctaacactgatcaaaagcaaactggcataggtatttcagacagagcagacttcagaaaaaggaaaattatcaggaataaagaggggacaacaataaaggggtcagttttccaagaagacttaacatttttatttgttttgttttatttaaagaccagtgtagtagtacataacaatttttaacatgtatgtatgtacctagcaacaggaatcaaaatacatgggacaaactgatagaatcacaaggaaaaatgaacaaatccacttctatagttggagacttcaatatctcagtaattgatagatccagcaggcagggaatcagtagggatataggtgatctaaacagcattatcacaactaggtgaaattgacgtttatagaatacttcatccaacaacagcagttttcacattcttctcgggctcacaggggacatttaccaacatagaccacattctgggccataaaacataccttaccaaatttaaaagaagagaaaccataaacggtatcttcttagaccacaatggaattaaactagaaatcaattactgtaagatagctggaaaatccccaaatattggaaggttaaatgtcacattctaagtaacacatgggtcaaagaagaagactcaagagaacataaaaaatatttagagtcaagtgaaaatgaaaatataacttataaaaatatgtgtgatccagcaaaagcagtgctcagatgggaatgtatatatcattaaatgcatacagtaggaaagtagaaagatctaaaaccaagattcgaaatttccaccttaggaaactagagaaggaagataaatttaagcctcaagcgagcataagaaaagaaataatacaattagaacagaaatcagtgaagttgaaaataggaaaacaacagagaaaatccatgaaatcaaatgctgattctttgaaaggattaattgataagcctttaccaagctaaccaggaaaaaaccaaatacctcaaaaaataaagtatttctgtgtgaaggatggttttgagatcccctcatataaaaagaccagttctctgggcactttcaatttggttctcctgagaattgaatctgatgaaagctagatttgttttaaggtatgatgctatttactgacatgtcacctctctttatgtagttaatcctaaaaccttccacatgtcttgaaagatcttaagatgatatacatttttatactgcttcattgcatgtgtttatcctttgatgacaagctcaactatctgcagtatatcacttatctagatgagaatgaaaaaaatgttattccgaaagttctaaatatttcaacagttgattaagccattcagcaaacatttattgaatgcctcctctgttcaaggcatcatgcaaggaattctgagggcattacaaggctgggtggaaggtttgaaatgaaggggcaggctaagggttgtgggagatcagaggagggcaggtggtttcagtctagaagtggggatggggtagagtattttcatggaagagacattttctgagttacatcttgtcctaaacttaagatttggttagttgataggcaaaaaggatatcccagggagagaacagggcatcgatagtttgttggaagggtccaggaagagcaacccatgtagtttttactggaacaagtagatcccatagaagaaaggtgacaggtagcttggagcagcctctggagggcctggaacctgggtgggaaatttgaactttgttgatcggcagtgaattaccatggaatgttttcgattatgggggcaggactagagtgttagaagagtcctctggtggtgggtgcaggatggaataaagtcaggaaggaagaaataggcccaggacttgataagggatagtttgagcctgagcaaaggtctgtgttaggatggtggcgaaggcaataggaaggatgggcacaccagctgctgtcaagggggccagacgagtccagtcttgttggcacggtgcagccctggttgactctgctgtaactggctggactgtgagcttctgataaatgtataattgctggatttaatttcctagtgtgcacctgtgtcgtccataaacgctgccatcatctaattgttacagcctgtacttgccaaaacaatattaacaaagtggattcaaaggtaagaggatagcagtttgctgattaaatgtgcgtgtgtattgtgtatgctgtgtaccgccgtctctctccctccctccctcctttcctccccctcttttccttctccccgtccccaaacctctgctttcctccccctgccacctcccttccacattctttgaagccaagggttgtattagaatagaaatgtctctctccctttttttaaattatggcatttatatttctgtatttatgtggcatcatccctcctttgtgaggaccccattagtggttggctgggtataagctatatggattggttctacttatttggagagacttttggcagagtgaaaggagccctgaacttggcatctgacagcctggatttgaatgctgaatccagcctctgttagccatcttctctatgagctgcggcaaggcctacaatctctcttttcctcagtcttaaaacaggatcaatgtttccctcacacagtttttgtaagttaaacaacatagaattgatgtgatacatatgttaataactgtaaattatgtttcctaagtaaaaagattgctggctttctccagcctcttaagaaatttcagggaagatgtctctctctctctctctctctctctctctgtgtgtgtgtgtgtgtgtgtatgtgtataagcttcaacatcattcttgccactcatattgcattcatctgcaataggcatacattttaaattctagaggtaaaagcagatggagtgttgctgacatttagcagtagatttgcagaggcattggaagaatgactctggaacacaatggttctttatagtacacatataggattgctaaagagtatacctagaggtataaaccacagcttttccaagaaagaggccataaaagtttcaagaggagtaatgattgccctactccttgtcatgcatggatctgttgttatagcatcaaattgtggtatggactgcagagtacatgcctagtggaattatttgctggaaactgagatttaactcagattgtcagattgcaaatgccaggcaaagaaaggctggaagagctgaataagtagttactttaatgtcactttggaataaattccttctgtggttccatggcctctgagtctcttctttttatttttcttcccgtgacacaatgtctggaagaacttacagtgatagcaagtatatatagtgtataaaagacccatttaatcctgaagttaaaaggttctgggaaatagatgggggtgttaggggattggcaaggagagaaatatggcctgaatatgaaagatgaagtgaaaatcttaatttttatttctcaaaatggcaaatgatctaatgtgtttcccacatttctgtcttgtcctgttcattagaaaatgtgtttagtctggttcgtaagacctgagtaattaatcagggctgagtacagtaaaataatatacctagctcaggtgtcatagtgacactttgcatttgatgggctcctattacagtttttacaaaggacattggtatgacattttagctcttgtccctttatttccttttttacagattgcagaacagaggttcgggatcaacatcccacacaagttcagcatccacaactacaaagtgccaacattctgcgatcactgtggctcactgctctggggaataatgcgacaaggacttcagtgtaaaagtgagatgctgaggtgctgggtacccacctcttcatgggaacactatgccctaagctttcagaattctgtggactcagaatctgtcctagaactgatggttttagatatgttgtaaatcaacatcttagtcattttaaacttacatgtttcttgtcaggcatgtaaagagaacttcatctgatgccaacattttctaatcataggacattaagtcaaatggtatattcagtgatctagctcgctagctgacaaatacagcctagacactgtattttaataggtgtttggaagagaaaaagatgggatcttagtcagaaatggaagatggttgagtcaggtgagacactaaaaagaaaaaaataaataaaaatttcaaagaaatggaagttaggaggaggtgaggaggtgagatggccaaatgagaaggttggattaagagtaagaaatggcagaatagatctgatgatctcaccagaaatcagcaggaatggagttgtcacagcataaaaagagctgccctgggtcttgtgaaagagattggagacaggggtagaatgaaggaagataaagccttgattgtaagcttgcatctcaccagctgtgcccagtggagtgagagtttggagctttggccctagcaaaggctctgagtgggtgagagctgatccctgtcctgttaggagttagggagctgttggccttgtgccatcttgtatggaaatgtaatgatctgactgccgtggggtgcacctgaagcctttcttatcagacacaccccaagtcgccagttgaggagaacaatggtgaggtagaattggcatgagtatagccagacaacttccattgactgcttggacttacagagcctgcttctgtcaacaaaaaggggccagtcacttgtctttaagaagggcacattcttctatctctgtagaacactaataatttttttctcataaaaccaaaacagtagccagctcatggataacttgtagggcgttggtccaggtgcagcttgatcttagcgtgacggtctcacctgggtatgggttcccagtgggaaatccctttctgccttgcattgttgctgatgcgcagagccatgcatggggctcatctgcattgtcctcttccctagtggcctgagggtagcacacctgcagcaatccggctcttgtgatttttgcctttatggtcacttggtggttttgaaaggcttctgtaggctcgtgtgtcttacacctgtcttcctgagaggggtgggtttcccatgaagcttaagtctcagggctcctctctctcaagggcaccttccaaagccctctacttgatttggtgttctttttcttaaagaaggcctcctaaattatgtaaattcaggccccacaaaacctggatctgtgtgtgcttccaagatggactgactccataaaacaggaatgtgttgcttgtcgcttcagtttcacctcccatcagcagggcccatgtcaaaaaactgtctcagaatttattccagctgataacgcctcagatccttcattgtccccaggcagcttccggtgcctcaggagcttagctttctttgctcgcctcttcaactgccatttgtactctgaccttcagaaagttttaaaagttgcctttccccactatgaagcagttagaaccacaggctgcaaatgctgagaaccacaggctcacaggatgcccatctctgtgctgtgaggcctgcccaaccacaacaatactcagaaagaaagctgcagatagaggtttttcttgtagaaacaccatttccatcctgtttgaacagtgatctacatgtggcatttaaactgctaccttttatttcactgttgagagacagaaaaaaatacagttgacatgattctttgttatttaattgcctgtgaattgccgctacgataaaggttttaatcttagatcatactaaggcagcaatgcctgttacatgtgatttagatgaatgggtttcatcaaatcatggtggaaaaaatgtatttgaaatatattattctttagtatgcttgcctttctgcttctgcagaaaacagaaatagataaaatgtcaggaactattactagtgtgagcttaattttatgagaaaatgatactgttcagccggtataattcctctgttataatcttttaggctattaaagttctctgttgcagcacatgttgaattggttcctttctgaacatggattctgttttccttttccctctagtatgtaaaatgaatgtgcatattcgatgtcaagcgaacgtggcccctaactgtggggtaaatgcggtggaacttgccaagaccctggcagggatgggtctccaacccggaaatatttctccaacctcggtgagactttgctttttttccatgtctcgtaatttagaagttgctcagatgtgatgagcccaaatgagagcatgtggcctcatcaaagttcctaatcttagcaaatacaataaacagacttattgcctttctttctttctttctctttctttctttcttttttcttttctttctttctctttctttctttcttcctttctttctttctctctttctcccttttttttctctctctctcctctcctttcctctcctttcctttttccttccttcctcccttccccttccccttccccttccctgtcttcattcctttttgagatggggtcttcctctgtcacccaggctggagtgcagtggcacaattatggttctctgcagactcgactgcctaggctcaagtgatcctcctacctcagtctcccaagtaggtgggactgcaggtgtgcaccactatgtcagggtaattttttatttttttttttgtagagatggagtctcactttgttgcgcaggctggtctcaaactcctgggctcaagcgatcctctcgctttggcctcccaaagtgttgggattgcacaggtgtgagccactgtgtctggctgaaatagcatttttaatagcaatttgtttcacggataagattgtatatacagttatatgacaagaaataatgagcatgagcaacaagtaataaacagaaagcaaaagaaggacttttttcctttctttccttttttttttcttttttcttttttctatttgttttttgagacagagtctcgctttgtcacccagcctggagtgcagtgatattcgctcactgcaacctccacctcccaggttcaagcaattctcctgcctcagcctcccgagcagctggaattacaggtgcccactaccgcgcctggctgatttttgtatttttagtaagacggagtttctccatgttggccaggctggtctcaaacttctgatctcaagtgatctgcccaccttggcttcccaaagtgctggaattacaggcatgagctgccacgcccagcctttcttttctgttttaaaatcagcttcctgtcactgtggtctggtgaaagcctaaaacccaggatcctgggttatgcttttgtctggggaccaggcaggacaggtgaccagtaactatgggcgtcagcgtcctcacctctaaagcggttcaacttgaagatctcagaggctctgcacagccctggagtccagcagttctgaagttttggtttatggattgtgaatttatcattcacattcagcaggagacaggagtctctccctctggactctcaggagtgagtggagttgtgtcagttgcagtgcacatgtttttgtcagcactctccctgaatgacctccacctgctgtcatccagttgagccttggctgcttcccaagcccatgtcttactgttgccttcctggtcagcgtctagagatgggaaatagccatgtaagatctgaacggtgtagcttggtgtccagttcaggaaaattatcgactcaactaattaatctctgggtgctgaggaagggaagtgcaattactgtgagattcttgataatcctgaaaatgtcagcaccaaccacctcatttcctttttactgaaggactcctgcctagtagatcagggactttcattgacaatttttttttttttttgagacggagtctggctctgtcgcccaggctggagtgcagtggcacaatctcagctcactgcaagctccgcctccctggttcacgccattctcctgcctcagccttccgagtagctgggactataggcacccgccaccacgcccagctaattttttgtattttttttttttttttagtagagatggggggtttcaacgtgttacccaggatggtctcgatctcctgaccttgtcatcctcccgtctcggcctcccaacgtgctgggattacaggcttgagccaccgcgcctggcctattgacaatttattgaattgccactacgataaatgttttaatccttatattagatcatactaaatcagcaatgactgttacatgtgatttagatgaatgggtttcatcaaatcatggtgaaaaaatgtatttgaaacctattatgtaaaaaaatgtatttgaaatccggtctgtctgtcttgtgggtaggcgggcaggatgccaatattgtgcggggattgctaatgcatgggacagttatccctgaagagcagagattaaagatatcagcctgaactagggcttctgagatacaatgggaataagataagaataggaataaagatcatgcagcacgatctttaggaatggacagtgcacttgtcatttgaatcaagtatccttaatccatgacatccggtgcctggctggatgttagacttttgatctgttgtctagtggtagcttatcttataaatgtctcaaggtgggccagctgcaaaagtcaccttgcctttaggtagcaacatcctcaggtactcagtaggatggaactggaaagccaactgaggcaggcacacttaccttccattcattgtgttgaaactagaactctcatcatgctggtgagagtgtagattggtcagtcttattgtagacggtaagttggctgtgtatcagaagtcttcaaaattagcactttggcccaaggaattccatttgcaggaagttatcttaagaaactgaataatgataatgacaatacagcttaagtttattgaatgtgccaggcaccaatctaagtgctttacatgcatttgttcatttaggcctcctaatgactcatgtggcagatgctttaaccttctctttgtcagaagaggaaactgaggtagggagaggctgggtaggtaacttgctcagggtcttaggttagcttgcagagctgttattgaatccaggcagcttgcttgagagctagacccttaattactctgttttgaagatttgcatgaagtgtattcactccagtgttattcactgtggtgaaaaaggggagatgcctcatccttctaatggcaggggaattaataccttgtgagatatccatgaaatggatattgaatagccgttagaactcatattcttgaaagaaatttaaaggcatgaaaaatacccaggacaaatttttgaatacaaatgtatgttatgaaaccataatttgattatgtttttaaaaattaaccaagtataaaaacgtgtgcgtgtgtgttatttatacatggatatagatatctttggcagagggctggtgagattttaggtatttagatttttattcttcatgcttttgatcattgttctaatattcacattggacttttatttctcctatataatttaaaatattgattaaaaaacgttgcttcattcgtgtcctggtgctgaatgatgcttgaatctctgagtagacatgagaactgctctctgtaaaaagtggacactaggtggcgctcgtggaatgggaccttcccgtggaaagccaccgcagaaggcacccaagggaccacacaaggcattggtgtttccatgcacttccacttgagcgctaactgtaactccatggcttagacgtatttttaattgaccttttacacaaagcagtaagcacagattcagaagctgatactgagggagtttcgagtggcagaaccgatcatctgtcaaactgagttgatctttcccccacgttatactgggggtgagactgctcccagccaataaggtcttcttcgtgcatgggtgctccatgcttctgctgcaatttctgacttaatgtgttcttactctttcagaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgagtcttggctttaactgtttgggttgaagtaagtgtgctctgtgtatggggggtgtgtgtgtgtgtgcacgcatgcgcacatactcacatttctcatgtgccattctttcttcctgttgtgtgcacacaccctaagacccccaagaggactccctcatgctccctccttttgctttgccataggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgtaagtatgaatcacattcactgcaccaacagcctcttttcttacagagctgagacagtaagatactggagatttcataaagttgagtatcagaaattttgggggatgggctcccaaggcagggtcatatggaggtattggtgacttctgccaacctctggaggaaaaatggaagcttatgaattcaccccttccccttgtgctgtcctggggaaggagcaccgtgagggttgtgtgtcccaggattgaaaaggtcatcatacataaatcttctgtaggtgaagtgaaggtgaatgaaagttacagcagtctaagaacagagaaaatgccatgggctcattgtcttgatgaatttggctgtgactctgctcctaaatgctgggctggttctgacctgggcacaggagtttagaagaggggtctgagaggacccagagaggtaccttgatttggaacatcccagggcattgcttctggccttagcaacgaccctttgcctgaaaccatggactggtcttaagaattgaatctgtctgccctgtaatggcgtgcgtttaggaatgcttctggctgcagttaatggaacacttgaccagcggtggattaaacaataaatagaaaggatgagtttggttcattagtacaaactttttacttgttgtttcacataatgagaagtctggtggtaacagtgctacggttggatttgttgctcagtgacattggacatgtctttcccttggggtcccaaggtatttgctgcagccctagatgccacaccttggcatgatagcatccaaagcagaaagcataagggcaggggctgaagggcttcatggccagtccccttttctcagggagggaagatctttcctagacttgggtcaactgccctgtatgtctgttctcacattgctacaaagaactacctgagacggggtaatttatgaagaaaaaatgtttaattgactcacagttccacaggccgtacaggaggcatggctggggaggcctcaagaaacttacagtcatagcggaagggtgaaggagaagcaagcagggtttcacgtgacagcaggagagagagagagtgaagggggaaaagctacacactttcaaacagccagatctcatgagagctcactatcatgagaagatcaaggggggaaatctgcctcatgatccaatcacctcccaccaggcccttccccaacattagagattccaattcaacatgagatctgggtggggacacacagccaaaccatatcatgcccttagcaagggaggctggaagagcaaatatcaggccaagataagctggcagaccatgattggttcacaccaaccttgattcagcccctggagcagggcattctgcttttatttagaatcaggctcaaaattgggcttttggtatcaatgaagagggaaaatggccctggagaaggcaccaagagggagggtctgccacagatgtgtcagaatcttgctgtcaaaaggcattctgggagagtgaattctgggcatgttcctggcctgtgccaccatcaaggaagtaggggattccacgagagcgggataggggcatctgactggtcagggaggctggcaatacacctctagggaaggtaaagccatgctgggaccaaacgagtgaattagaattagttaggcagagaatgaaggtgaatatgtcatacagggtcaacagcacactatgggtctgctggtgagacagagcatcaggtgtgaaggaggctcagtacacacagcatatcgaggttgaacaggggccttgagaactgaggcagccgaggtgggccagggccaggccatgaagagccttgtaggctgtgttaaggggtttgggtttagtcctgagagcaatggaaagtcatggaagaagtggaagcagaggaatgacgtatcaggttgtatgttttaattatgaaaatctaatttcttgcgataggtaatataagtatcctccaaatattcatatcctttctccgaaagaaacaagtattgctcgttttatttatagcctttgagagaattttctgtacataaaagcatatatatacagcacatatatgcatacatgtttatctttaaaaaacacaaataatagtatactttgcccatgattctgtatttttaaaatttaattaatctattttttgagacagggtctcactttgtcaccaggctggagtgcagtgacggttatggctcactgcagcctcaagctcccaggctaaagctatcctcccacctcagccccctgagaaactgggacttacaggcacatgccaccacacctggctaatttttgttatttttttgtagagatggggttttgccatgtttcccaggctggtctcaaactcctgggctaaagcaatccacccacctcagtcactcaaagttctgggattacaggcgtgagccactgtacctggccactttatttttttaagacataatattaatagtatatattggaaattgttttgtatttctatataccaagctgcctcatttttaatggctgcatagtactccattttagaacatgacataattaatttaacttttcctcctctgttgctatgtattgtgttcctagtcttttatttcagtcattgttgcagtgagtccccttgtacttttgtctttgtgtgcttatgctggtgtttctgtatgacacattattagtagtagtattgcttggtcaaagggtatatgcatttcacattttgattgagttcaattgccccctcccccattgtggttaaagatagtgaacgttttattgtccatgtaccacacattgttctaagtgctttatgtctgttatttaatccttacagtaaccctctgaaataagttctgttattatcaccccatttcacagaggagaaaagttaggtacaaagaagcttagttcctaagtggcagagagcgtttgaagccaggtggtctgacggcagagtccaggcaggctcttcctatttgctgggctgcgtctctaaattcacactcccaaagcttgagtgagaaggtgcatttccccgccttcccatcatggcatgctctctgtcatttggatcatctcagagttagaaaaatggtatatttgaagttccaacttgcattcctctaactgtgagtgaagctgggcgttttcatacatttcagggtcactagtattcaaatctgtgttgggagggccacatgcagcctggagaatgggtggagcagagaagtctgggagcttggtgacaggacgcactgaaggagatacatggcttggactcccacgccaccccagcgttatcaagagaaaaaaaaatggggaggcagctaatggcttcgtgggcctcggctcccctgcgcgcctctcccttcccctctgctcctcattggtcctcagtggctcttgatggccctggagcccatgctgctcctgcccccatcctctgctttccctctgctggattggtccttggttcccctggagctccagttctccctgccccacactgctccctggagtagccttgaaacgacttccttggctgggcactttgccaacgtaaagcccctcccctgccctcacccccttgttgggctcttttcttggaatagaggagtggagttacagcttgaggcttgagagggatagctggtagctgatactggttgcccgccggggtttcaagcgccagcctcctgaacaccaccatgaacaccatgagtcaagccgcagagccaggtgacctctcagatcttcttcctagggcctgagccaaacatcacatggtttcctatgacatgaggttagatcatcttcaccaggtggtaacctttgagtcaagcagtcaactgatatttagtgagctcacctggtcttgcagcagcaatggttccaagttactactgctgaagcaaagaaagaagtatctcatacctaacaggggaatttgatctgtaaaaggaaattctggtgattataagcaaagatctcatcaacagatcatgttatggtagagtaaaatgaggaagtaacctggaacagattgggaacccaatcaatatagcatatgcaatcaaaatgttccaggaaaatgtataaattctacagtataccaaaattttagcggccacatgagattcccagtgtttagtgggtgaagcctttactagcattgaagtctatttttcctagtggaagttttatgtttgaccacaaggtggcagtcattaccgcaaagttacttttatttctccaccagagaaaccaaaggcatggaactgccattgcggtttaagatgtgtgtgttgtagtagatgtctccaaagcaaaggataaagggaatgtacccctgctttaggctaaatgataaagaagtagtgggaacccacttcaaagaagcaagtgaggctgggcgcaggcagcactttgggaggccgaggtggggcaatcacttgagcctaagtgtttgagaccagcctggccaacgtggtgaaaccccgtctactaaaaatacaaaaagtagcttggtgtggtggtgcatgcctgcaattccacctactccagaggctgagacaggaggatcgctggaacccgggaggcagaggttgcagtgagccaagatcgtgccattgcactccaacctgggtgacagagcacgactttttctcaaaaaagaaaagaaaaaaaagcagcaaaggagattttctaatgctgagatagaggtatacaattttagttttgctgtcgttgttgccttctttgaggtttgcaaggtatcggactccacagtacacatagcatttgctcgctgtgcattcgtctgttggaagtccttatttactgttgtaaaactatccccatttactgttggaaaactaactataaagaacagaaagtgttacttgctatgagaagttacagcagaaagatgcttactttttagctgcccagtgttgcaggccctggcttctcaagtaagatgctaatcagtgtgtaatgctgaactgtgacagtctcccctggagaatttaggagtgagagggggtgttggagccactctacctgcaaagcatttcattgtgagggcctttgtaaaaacagcactctcctcatgcagccctgtggaatcagtctctctgaagcccagagcagggcagtaactagccgaggatcccttagattgtaagtggcagagacaaagttcaagtttaggtcaggctgactctgactccatatgttgtcttattccgcatttagttggttgattcagcctcggcttaagcacctcctatctgtcttggctcccctccaacctgacaatatggaaatggcattgcccttgggaacagaaaacctgaactgtgttttagctttgttttccaccatctaaatggcttgagtctgtcctaaaattcctttgacccttaaagttcttatcattaaaatgaaaacaggatcgctgtgagggtcaaatgagagaatgcagaatattttgtacagtgcgaagtgctgttcaaaagtgagtcagttcaactgtggtgatgaccccctccatcctcacaccaaaggaaaaatgtcccagggcttcccaatggccagcccagacacccacatggaggggacagcaaacattgagaaggtaagtattttataggtccttttgttcttggcaaaaaggaaatagtaagcaaatttcaaatatttgataatttatcaagattgctacaaaggtttatgaacccatagattatttcccctttttttttataatcatatacactgcttacaagtatataaatgggcatccttatctgtttctgatagcactgcaaatcctaatagtttgtgactaatttgataacctgtactaaaactcacaaaatgtatactcctggatctgtttttctgataatctggactacaaaaataatataaagaataaaatgttattcataaagatgtttaattttcagtgctttgtttatatatatttttttggtcaacatctctctaatcctccagcctctggtaaccactattctattctgtttctatgagtttggctttatttgattacacatatcagtgagattaagcagcatttgtctttctgtgactggcttatttcaaataatacaatgtcctccaggttgatccatgttgcaaatgacaggatgtctttctttttaaaagctgaacagtattctattgtgtatatattccgttgtttctttgtccgttcatccactggtgaacacttaggttgattccatatcttggctattgtgagtaatgctgcagtgaacatgagagtgcaggcatcttttcgacatgctgatttcattttctttggatgtatatccagtattggaattgctggagcatatggtagttctattttaattttttgaggagcctccataccgttttccaaatgagtatactaatttacattcccaccaacagtgtacaagggttcccttttctccacatcctcttcaacacctgttatttttcatcttttcaataatagctgttctgacaggtatgacataatatctcattgtggttttaatctgcatatccccaatgattagtgatattgagcattttttctatacctgttggccatttgtgtgtgtggttttgttttgtttttttttttacttttcatttatttttactttaagttctgggatacatgtgctgaacttgcaggtttgttacataggtgtacatgtgccatggtggtctgctgcacctatcaactggtcatccaggttttaagccccgaatgcattaggtatttgtcctaatgctctccttgcccttgccctcccacccaacaggctctggcatgtgatgttcccctccctgtgttctcattgttcaacttatgagtgagaacatgtggtgtttgattttctgttcctgtgttagtttgctgagaatgatggtttccagcttcatccatgtccctgcaaaggacatgagctcattcttttttatggctgcatagtattccatggtgtatatgtgctacattttctttatccagtctgtcattgatgggcatttgtgttggttccaagtctttggtattgtaaatagtgctgcaataaacatacatgtgcatgtgtctttatagtagaatgatttattaatcctttgggtatatacccagtaatgggattgctgggtcaaatggtatttctggttctagatccttgaggagtcgccacatggttttccacaatggttgaactaatttacattcccaccacctgttggccatttgtatgtcttcttttgagaaatgtctattcaggtccattaaccattttaaaattgggttgtttcttactattaagttgtttgagtttcctctgtatttggatattaactccttatccagatatgtgttttacaaatattttctcccattccacaggttgtctcttcactctgttgattgcagaaactttgcagaagctttttagtttgatatagttccatttgtctatttttgcttttgttgcctgtgcttttacggtcatattttaaaaagtcattgcctatgcctgtgtcacagatttcttcccctaagtcatcatttggtaattttacagttttaggtcttacatttaagtctttagtccatttttcagtgatttttttatgtgacgtgagatgagggtctgtttttattcttctgcatgtagatatccagttttttcaacaccatttattgaagggacagtcctttctttgttgtgtgtccttgggatctttgttgataattaattgattgtaaaggtgtggatttatttctgagctctgtattctgtcccattggtctatatatctgtttttatgccagtaccataatgttttgattactgtagctttgtagtagattttgaaatcaggtagtataatgcctccagctttgttctttttggtcaagattgctttgatgtcgtgcattatttatagtaggaaaatattagaaacaacttcagcatttagcaatgggggtacacttcaataatatactatttgatgagaattttcagccagtcaagagataattttatgttacgtagttaaattgtcaggtaccgtcgtaagcacctaacatgtattgtttattgcacgtgattcctataacagccttataagataggtgcaattattatcctcattatgtcaaatggaaaagtgagacactgagcagttaagtcatttgcctaaaatctatcacagaaaatggtaaaaataggaggttagaatccaggaaataatacagaggttatgatgatgaacagtctgtatccaagtcaggttctgcccaagatagtgaattggcagacccgttcccctccccagcctcaaaaaagactgccaggaaattatgccagtaagctatcagggactggattaaggtagtggaattatgaaggatttttttcctatttaccaaatttggtaataggattacatttcttcaacaatgggggtaggaggaataagccattattaagtcagggaccagacccctggtctctcagaacctgggatacggcctagtacatgctgtctccctgactcatttatggcgaaattcacatcacactccttttatctgaatcagtgagggttgtgtcagcagctgagtccctggcatggatgtgctggaatccaggcctcccatcccccatccccggctcgcaggggcctccccttcggttctcctcctggagagagaggaacaaagactagggggtgagggatggaggggggctatcacaggaagggggagcagcaaagtaaatattggtctgaggctttgttcggagacccagtttatggaagcaaaggtttccatttggaaaacagaagacacttgtggccagtgcccgaaacagcctctcactagcaggccctgggactgggtgagagggctgagcgaagtactcctcattgttttgggaatgccttaagtttgagtttaggatccaccgctttcaggtgggctacaggacgctccgatgccggtcgcttttgcctcctcccgctcctctgcctgctggggcttctttacgatgtcagcctgcaaggatggagttcctggcaggaccatagctttccataagaaaccacttctcaaatggccaacaaagttgaaatcctggtttttgaaggtcagaatatcttggaatcttgtgaaataaatgccatcgctgcatacatgctggcacaaaatgatctcacgtgtgctcagtgtacctgcagcttgagtgcaaaggaacattctttcctttgtattactttctccattgttgttgtattaaatattagcgaagaagtgggagaggcagagagcagccaggcagcaaggtagtcatgtggccctggaattcatctttcagaattttcccaggcagggaactgcactgtgaccttcagcacaagagctctgagttctaattctggcttagctggcccacttgtctttaagaagttcccctgccttttattttgagataagcctctccacctaaatgtgtgttccttatttctggacctgttggccaacgtacctttagggagtgcccctccagctggcttcaacatgtggggtcgtagcggggctgcagcctgccctgtccagctctgatgcttcccagcgcctccagctcccctttcccttcctgaggcctcactgagcatttggctgagcccctgccagccgctggacgtggggaggagaaggcatgctcagaccctacagtggcattactgcttgtgctctgtgttgctgtgacacccagcgcaaggggaagaggccctgtgacagagggttagacaaggagaaggggaagtatagccgaaaggctgggagactttcccctttacaggcatgggaattctgaagaagcctctgttcatgccttggggtagttggttgattcctggggactgaatggtgcccactttgcaggaggggatgagcgaagaaggaaagggcagttcatgagaccctagcatatgtcctaggtgctcatattcattaccaatgtctatgaaactaaactgcacattggcattccgtaaatatccattgaacaaaatatctcatttaatacccaaagcatccagggaagagtatcatcctcattttaaaggcctagaaactgagatccagagaaattaaacaacttgccccagatcacacagtaagccagagtcagtgcatggattcctgacctgactgtcctgccaaataatatacaagccatttccattatatcacaaatagaagttttgagtctctaatatgtacaactgagaatactgtcattagatgggaatagaggcagttttccacaataggtggtttttggccttttgggaaatacctaaggatatttcctctgatctgtttggaaccaggtttccccctttccctgagcagtggctgctacaaatacaatctggtttgctgcgggtcatttgttgcagtttgcctttggctcagatcaaaatagaaaatgagccagaacatggtgtttcctgtctctgcatgttcctaccttattcatagtgttccatcttttttttaggttattaattgtggatttatttccatagtaagacaggatctgactttggggccaacatatgttggacccgcctccttctctgctgaagattctctgaagacaaaatgtgcataggccttctccaggatctggatttttgggggattatttgggacctttgcttctgtcctctccggctaccaggctttctgaccttctgtagctaaatagggccacaaaaatgaataggaataagagaacctgaagttcaagctgtgtctttggctctgtctctttggacgcgactgccaagatatttggtgtgacaaaaggatttgaaatagttggcctgtttttttcagtttgaggttgttctgttgtaactggtcttgtttttggtagccatcattatcactgacaacctagagactgagtagaccgccacctccatgtctgctaagatagtataatttaaatctttgatgtaaccagaacacaacccaggtcacactttgcccctgtgtctcatgatgactgaaagcttttggggtgatgattgcttggttatggttttcctggacccaacttggaacccttaaagcctgccaagttatagatactctggcttcagtagggccctgtattgaaacaccaagtgccaggactgctcaaaaggtgaaaatgagatgggtgttctgccaggtggtttagtgaaaaatcagtcaatccaggatcccactgactgaatgctaggcaaaagaaacagttcttttatttgttttcattttttgcagagttggaggtcttgctatgttgcccacactggtcttgaactcctgacctcaagcaatcctactgccttggcctcccaaagtattaggattacaggcatgagccaccgtgcctggctagaaacagttttttaaaaactcattctaattaggaagagaagaccaatacacatggaagaaaagtgtacagtagatagcatgtagtaaatatagtccttatgctacaaaaggaaaggtagttgaaaatgaacattgggttctaggggaaactcttaagtatgtgccagtctgtgctcagaagtacaacctgattggctgtgagactaaagccaactgatagctttaagcagcccctcgggtgtgggctgcagatggttccctaggaagctgggttgactcctgctgtgatgagctgggactgccaggtaggacctgaagcggctgccaaggggctgccaccccaccctgaagacaaaatcatgcagtctaaaaacctgactgctttggatcaaaatcataccctgtaatatgttctagtttttaaataacttgggttttccttaattacttaatctctgctgagaacccagctgcatccatctcttctaggtccggaattatccacagcatctcatgagcagaaacagccatgtcaacataaagttagcagactcgtcgtgtagagagttgtgcactggcaggttaggggggaaggtgttcattcattcagcagatatgcactgagtgcttgcaaggcatagggctcgccttcaagccttgaggacgcagcagtgagcaaaacagaaaagagtccctgccctcatgaaactgacattctttgggaagcttataagcctgaagctcatgaacagattgttcatcttatagtctcagctggtgaccctccatggcagctgctccctgtggcaattcctggattttcctttcagacaggctcagagccgtcatctgcttgaagagtctggggggcttgtctgaagctgcatttgcatatcaagtgctccgttatattttttgtaggatgcagtgagaatactggggggaggctactcgagtccttggtccttggtactgtctctggttagtggtgggttctgggtcactattataggggttgggaggtttaaagcaagaagcagaatggcaagagtagcagccccagtaggctgcatttgctcccgttgccacttgcacgatctttctcatcccgctggcaagactagtctgttcactggcagcccctgcatcaggctgtgaggacgccctgtctacctcccgtctccatccctgtattaacccatgtgctatcaagagcgactgactctttctttacaaggttctttttccttccttccccgtaagctaatagtttggctcaggctcgccagcagaccctccccttttttgctggagggctttggcatgccctgtcttttctttggggccacccagggagttcctgtttcctttctgtgggaggcttccaattcttagttatagcaaaagagcctgtattttttagctcactcctgcccacttctggtcttgaatgacttatggcttaggtgttacaaatgggagtcctggaactcttcccagaatctcttaattccattcttgtggtatatgacgttctaaacattaaaatgatgtaatatataactcccaaccaaaacaaaagaggagatccctgctagccaaattcttccctcctctccatacacgtttttccgtcgctgtgcagtgaatcctgggatgtgtttgtcagtcagcttccttgttcttctggctcctcactccccagggaccaccgagccacagactccacggttttctctgagggcatgcgaagtggaaactaacctatccctgcagccagcccagaccttctacaatcatatctaccagtggtgaaaggcagttcaagatgagttggacacaaccaagaaaaatagggaacaaatatgtcatagctcctctctgtctgctgtctatagaaggaggctaatagcagcagatctggtgagggccagtggcccatggacctgcctgccccaaggcagcaatcatgggagtggggtcaaggaaacactaaggaggtacacctgataggactttttaaagaggagtggccagggttctggccggtttgaagcctggagagaatggaatggcatgagttcagttttggggacattcagtggtaagactggtttctgttttctcttctggaagctcatagatacaggatctgctcattcacttgatttgtgcctcttatttgggcttcaggacacatctctggccaatcgcaattaaaacaccatgcccagttagccatcatcgccactcagagctgtctgctttaccgggctaaaaaaaatgatctttatcaccagttgtaagtgacttaaaaaaaaaaagtacccttccacattgctcagaactttgccgtcaccttcttgaccctcaccaacaggtcaggttgttttaataatctagtggctggtaagctttcatcctttacaattaaaaaaaaaatcactgatttgcataatgcagtgccatttgcctactttgttgggggtgggggctgtcctgttcattgtggatgtttagcagcatcccaaaataccagcagcacctctccagttataacaaccaaacatatcgccagacattggttcccaggggggaagaatctcccctggctcccttacatgactgtcaggtgattgtctttggtatgaaaagtcaaatgggttagacgatcacttttctttttatagaagccaaagccaaatgtgtcagaccttctttatgaaaatataagcgttattttttttctgagtttgtagaaaggcaaagttcctgttgggggctcattacagctgttggtgcctgcactgacagtggcattgttagggatggagcccctgagctcgggggagacagcggaagcgtgcagcgtctgtttaatgtgagtgagggctggcatgctgctggcagctctcaacagtgaagcctgctgctcgataaggcattattatcagagcctgggggcatccagggagcaaaagattagctgactgagcatatatctaaaatgggttatttttaaaaagcaagcagtacaaatactgcagcttgtcttgttttagcatttaataattacactttcactttaccagcaaggcattgagtcagtggcattttatgaaaagcatcctcccaaacctgaactttgtgagtcagattcccatcctgtgtgtggtacatgtggttggattgtacaaacagataatcagagttttgcaaaatgtttcccaaccagcatgggaaaacgtgctgatagcaatatgattgggctttgagggagagccacttgctggctttttttcttttgtttcccatacatggaaatgccatttcaacttgaaatgtggataccttaccagaggattgcttgagcccgggaggttgaggctgcattagcgaactgggactgcaccactgcattccagcctggatgacaaagtgagactcctgtcttaattttttaaaaacccacacacaaaaaaaacaacaaaacaaaaagtagaaccttaaatgctatcttaaggctgaatagtctctaaatattgaaagtagaccctagccaaaagagacattacctgtttctgtaatataatgaatggtattagtgtacttaccttgcattttaaattcaattctgtaaatgtttatggagcatgcattatgtgccagggatgaagacacaagaacaaaatgtggacctgccttttaattgcttacagtcaaaggtcatgataacaccatgtgatggagagaagaaagtcatgattgatcctcgtggaggttggaaggacttcccagaggaggggctgtgtgagctgtgttttgaagatgaatagggatcttatagtcacaagaggagggcatagactcccagacagaggtaacagcagtgcaaaggcacagaggcttaaaattgcaggatgtgcccaggaaaccccaaatgactagatgaggcagatttgtaagaagggaaatggtggtggttggcggcgggggtaggggggtggtgatgaagaagcaaagtcataatgggtctgatgtcctttgctgaggagcttagactaaactgtttaggtaaaaggagccagcaaaatctttaagtgagggagtaacataagatttgcatgttagaaggctctctctggctgctatgtacagagggaggctaatggcagcagatctggtgaggatgctgggcccgtgatctgggaacttgcctgccccaaggcagcaatcatgggagtggagtcaaggaaacactaaagaagtagacatgataggactttttaagtgggaatggccagggctctggccatttggaagcctaaagagaatggaatagcatgagttcggtttgggggaaattcagtggtaagatgcttgtttgtcagaaacacacttgagatgggagatcagtttggtgtcatccatgtcctcttggtaagtggaaactataatataaaatctttcaggccaggtgcagtggctcacacctgtaatcccagcactttgggaggccaaggtgagtggatcacctaaggtcaggagttcgagaccagcctggccaacatggcaaaaccctgtctctactaaaaatacaaaaattagccgggcatggtggcacgcacctgtaatcccagctactcaggaggttgaggcagggagaatcgcttgcacccgggaggcaaaggttgcagtgaaccaagatcacgccattgcactccagcctgggcaacagagcaagactctgtcttaaaaaaaaaaaaaatcaaaaatcttttagtagatgtttatagagagagaagagaggagacttgaagaaggaattctaagtaagggttaaggttgagtggaaaaaagaagaagaatcagaaggaagtggtttcatagtaggataaatcaagtgctgagatgaagtcagttcactaacagactcagagttctattggatatggcatgaggttcttggtgtcaccatcttaggatctgctcatttttggggttttaagaacctgtctgaactccacttagccaactgaagcttgccttcaaagttaacacaatgtgctttctcccatataaaccttttaagctgtttctgatgactgttcctcttcctgttagagctccacctcttttaatttagcctccatacctttagagtaaggtctgcaactttcttccttaattgacagtggagatcaatatgtaacccagattgcaaaaatggtttgggaacactgcatgttctcactcataggtgggagttgaacacatggacacagggtgggaaacatcacacactggggcctggcaggggatggggggctgggggagggatagcattaggagaaatacctaatgtaaatgacgagttgatgggtacagcaaaccaacatggcacatatatacctatgtaacaaacctgcacgttgtgcacatgtaccctagaacttaaagtataattttaaaaaaaatttttaatagtttgggaagaaattgtgggcatgtcatttgcttgaacagattttgttccccagccagaggaccagagaagagtttgtcatggctacagtggaggaatcaaactcagaatagcatgtgaaaggcacattccacacagaaacttcggcccgtgcatcagcactgcagacagggggagaggaaatgaattctcagccagtagattcccaggcatcaccttgaggcagatatggcatattcttggccatagtctctacttctctaactgggcaaagtgtctaatcaactataacccaaaatatcttcccacatggcataagtgtcgaattcatacatagatcagagggagaaatgaaattgtggttgtcttaaaagtttacacagtttagggatctccatcatgaaaaatgatctaaataaatgaaatggtatttttactctttatcctacaagccctatacaaactaagtccataaatatcctatttgatgcttaaaccaaaagctttataaagagaatttcactatgtgaaataatgacttgaagaaatcctattgtggatgcttttgttaagttgctaaaccttttttaaaaagtagataatcatccaagatatcttctttgtgactcttaagttttagtgtatttcaaatgtggatagtttttgactaggaggtttgttcaaacgttcttctcgaccactagggggtgctctaaaggttagtgatgtctaaatgattgaccaatcaattaaaacaccgtgcccagttagcaatcatctccactgagagatgcctgctttaccaggctaaaaaaatgatctttatcatggcatagagactataaaagctgtgtccttttattttcattaacctaattagaagtcaagctaattgtaggacttcatagaactggcatcgggaatagtatgcaactgttaaaaaaatcatggtcttgatgactaattatatcaggaaataatatgcaatataaatgaaaagagaagtgtatgttttttactttttcctttctgtttttaaaacatgctataaaatgttaagtataattaggacacaaaggaaaaattaaatctagttaacattaccttgaaaacttcttatttgccctgaaatctccagttctttggaagctaaaagcttgagacttctatatctggttgtcaggattagggtgattttatttgaattttctttattttcttctcaattttctatctatttactttgtaattacatttgaactatggatatgtaattagttttataaatagaaaaatcaaagctttataaaggaaaatatagcatcagcagacctgattgtcctacttaactcttccacaaactgttttaactatgggcaaggtacttcacttctttgccctttgcttctgtaaaatggttgggtgaaacgaatcttggcagtttgttccagctcttctaaagttccattttaaattttaccaggagacaaaaatggttcctattatgttcactcttgaagcatttattaaccctcacaattggccaggcactgtgcttggtgctattaaagatatctcacttagtatctgggctctgccttcaagggtttccggtcccccatggaaaagaagaccaagtgcacagatccatcccagccctacacaatgatactggaaagctgtatgtggaccagaaatgccaaaggaggttccatcaggaagaggggacttgtgctctgactctgctgtacccctgatcatatgttaccacttatttatgctttaaagaacatcctggcctggatgtttcacagtgtgttaaactgcaaggtagatttcctctttgtttccctggtctactgtatatatgccagtaagccttgtcaggtttcattatgagagatggctataatgcatccagattactaggaaaacacttggtctttgaaaagagctgtgtgtccctctaggtttgaaatgcaaagtcctaaggctttgttatattcaggacatatttcaccttcccaaagactagtctcagctcagacaggatgtatcttgcctgtgggcttgacacaggggttgctgggtgattgaattaacctctgacatcttctgggctgtgcaaaatgataagttcaaaaaaaaatgcagccattagactccttctcattgtttcttccttgaagcctttgtaatctttcttaatgtggttaaattcaagttatttccagttcagacatggtgcaatcagatttcctcatgcgggtgcttttccactgtgacctctttgacgtcagtaactgtttcctgtttatttgaactccctgctcaccctgtagatgactttgtctgagaaaaataataaagcaacggtacttaggagaagttcaacactgctatctgttacggagatttccttctcctttcccccagccgtcaatagcactctgcagcttttcatacagcatgagcttgttattcatgtagaaatactccaaggcagttcttagaacttgggtaagtaagaatagatgtggctcccagcttaacattgccttaaagcaatagctacatttttcataacttttacgtgttatgtctatctttgaattatttccaaaaggtaatctgcatcctcactataattctgagtatggtggctatttcctactgccttggtttctggaatgatacatcttcaaatgcagtctttaaatcatagagacaacagattttttctttaaatggagacaaatctttgcaatctggttctgagattgaatcaactttatagaaaggaagaataactgctataaaaagtctcgcttacagtaatatgtttttagtacataaggagggcatttgttttgcaataataattattataaagcccctaaaatagaaaatatgaattaccagtcagtgttagaaaacttatcagaactgaaacctttgttagtatgttttggttatcaaatctagttttgtaaccccttgcttagcaagcatttcccagaaagaaaagtccttacccggtcaaggccattaccatatagcatcgggaaacatccctgtgtcccagcagctgggctaggactccttccacctccttcgaccctctatacccttgtcccacactgagggttgggggagctgctgcagttgctgtttcggctgctgtttcattcctgtccacttgtgagtgtgtgtgtacctccgccagtcttggaggtctgtgaaggaggcctcgagacccagtgcatgcagctcactgccacgtgtgccacagccacagccaaggggccttcctatgcctcatgcatcaggccctttggagccctgggagcagacggccatggcggctgaagctgcagtggatgcactcatgatgatgaggataataatagttgctaacatttcttgagcatttcacttatggtatgccagacactattcaaagcccttagcttaaatcatttaatcctcacaaacctgtgagttgggttgtcttattatccccattttgcagaagtgagttttgtgagagagaagctaaatacagcacagcaggagttgctcttggacctcaagcatcctggcccagagcccaggtgtcgccactgccctgggcttcctcttagtcataccagggacttgggcactgggcacaaaatctcctctttatataatgtagtggtaccaatagcttctattgattgagattcttttctgggcttggcactgtatgaggcacttggcttctggtttaatctttacatgatcactgtagttatagatgttattatcccagatttataaataaataaggaaacttcttaccccttaaaaatgggtgtgtgtgccatgcatggttgctcacgcctgtaatcccagcactttgggaggccgaggtaggattgcttgagcctaggagttcaagaccagcctgtgcaacacaaagatacccagtctatacaaaaaattagccagatgtggtggcacaaacctgtggtcccagccgcacaggaggctgaggttggaaggatcacttaagcccagaagttcagcgctgcagtgagccatgatcctgccactgccctccagcctgggtgacagagcaagaccctgtctcaaaaagaaaaacaaaaattgtgtgtattttagctgaaattctcctggtagcagaaaatttacttcaggtagtaagaaaactttcttaaggctatgcaaaaaaaagaactaaaaataaagattcagaggtacaacggatgtctcatgcaacccaagggcaggaattggccagctctctcggctgatctgaaaccagaaagacatgaggaaccctggcagttttgctcttggctcactcaccctccctgatctcttgtctctgcctcactctatgtttctgcttcattcttctccttcacccacccacctgtccatccacccacccagtctttctccactctcttatacccaggcatttcccacgtttacactgcaaaagcagtttccgtttcctaactcatgtttcctcagttcctgcacacagcctagactaaattaaaagctttttacctcagtttcagttttctggaaaagagactctgagcaggtgcagcttgatctaactggctgtgcacagatgctgagcgtttacccatgcggccaggctggagcatgggtaaatgctgaggaagggatcaccatgagctgagcagatgcctccaaagatgtttgccccagtgaccttacaggatcttgccctgcctggtccatgctcgctctccagtcactttccttagttagtatcatcttgtcactggtaccatcctggcatagcactttcatccacccggatgttatgtctcttgttcatacaaattgcccatcagctttaactcctatcgaacagcccttaatgagggggccttagggaatgcaccttacttatactgacagccattattcgggggatatttttagccccttgggcctggggaaggaatagttctgaactgatagccagggcagagagtggacccagactgcagcaggtcagtggcatcagagcaagtgacgacaggaattctattatcaccaggcagcagctcctctgcctcccacacctgtaactcacaccaggtgtgggacaaagggatttctgagttgctttcactcccaccggtgttcatcaccccatgttaatgacttgtacttgtggttggctgaatcagggacaaaagagaggagcagggacaaagggcttagccacttggctttagaagtgatgttaaaccggtctcctggccttgagatttcctaccacacaggtcagggcagacttcacctgacagaagccaaaagcctcaggtaaagctgtacagatgtgcaggctcagtttctaggaaaatggactttagaaaaaccaaaatggttctatgcacaggtttaaatacagaaacagtcatctttgccatctctgtctagagtgggatttgggaaacccctctctgccataggagtgactcactacaaccataatccatcttccagtacttccctaaatgcaggatttccaaaaaatgcttcacctagttgcttcacaattgaatttgtgaagcatgatttggtgtttgttgagtcatcagtgatactaattcttaaatagcacagactgagagtagagctgtaggtgagaggttatcttttgcctccttttagagcttcaaatacaggtctttgctttgtaaagggcattcactaaatatgagaagttttactcctttggaattaattttgctggagtgatttgcttttgtagctgatgttgttttattctatgtggcaagttccaacattactggagtctttttcaagccaagcaccatagctgcacctgttttaccccaggcactgggcttataattctagtagagactggtagtgagtgatcatgtttattaatggcagcagagaccctgcacttctcatttgtgggtgacctgtgaaagcacccctaagtagctttttgctttttctgcatttcattttgaaaacagcagtacagttacagcgaagcctcacactcacccactccagcgcttgacaacctgcctgccttcgcagtccctcccgtctgcctgacatcttacacttcaactgcacagtcttcctgacacctcccacctcagtccccactccagcctgacttgcataccctcatccttctaggctggggaattgactcctctcagaagcttccccccaaaccccacctgccaaattccacctccacctccaggctgctcagatgccctgctcggtgtccccataacaccttctgtacctctccactgcacttaacacactgtggcgatgtgctgtgtctgcatgtccatgagcttactgagagcagtgtggagtcatattagttttaggagactgggtccttacccaggccctggcgtaccacgtgtgtgtttagtaaacatttgtctttgttcagaaccttaaaggaaccaagaagatctctgcaagctgtagtagatgtcgtaaagcctgcgcaccaggctccaagtggagctgctgggacctgaaccagagccagccgattttcactgtggatgccattccaacaagcctggttacctcaggcagcagaaaggccattatgggacatgggtggttactcgtgtcccttaataatgggcaacaaggatgcaacaatttctttttgtagctgctttctgactcccattgcctaaacaagggctctctcaaacagcctcacaactgtgtctttcccatgtcttatcttccatctttcagatgaaaataagaaaaacatggaggaagcacatgtgactttagtttgcttctaattgcaagagtaatacacactcatcatagaaactttgaaagatactgaaaggtagaaaaaagaaatgtcaccccgatcccacaacaaaaaactgacttctgtcactctatagccatcttttttatcctttctatgcatctgtctgcatttttggctataactaaaatcatcctgcacattcacgtttgtgatctttttttaaattgaaaatacctacatgagagcacaagcattggcagcttcagcagcagctatcacttactgcacacttgcccgaagggacctgaggacatacttaatacaattttacttctgatgatgactcctcaccccaccacccaccacctgatgatgtgtgggtcttctttccttttcctttttttttttttttttttttttgagacagagtccccctctgtctcccaggctggagtgcatggcgcgatcttggctcactgcaacctctgcatcccgggttcaagtgattctcctgcctcagcctcccaagtagctggaattagaggtgcatgccaccatgcccagctaattttcttgtacttttagtagagacggggtttcaccacgttgcccaggctggttttgaacttctgacctcaagtgatctgcccgcctcagcctcccaaagtgctgggatgacaggcatgagccaccacgcctggcctggatcttcttttctaaacactagagattttttgtcgtttatctccttctcttcaaaagtaatcttggagaaattgctgccaaatctttgcctctctgcagcaaacattttaaaatggggtgaacagaagtgcaggtcaacagagggtttcctcacagcaaaaacattttgcttgttgataaacatgtctttgttttttatacctggtgacgttatttgaggtctttgataggatggaccagtactctgcattaagtcgtcgtcgtgtctcagctggcctgtgtctcctgcctgcttcaagagttgctcataacctgagggctgtgaattacactctgtgttccaggtggtgccagacaggaggttagaaatgagactctgaatgaaaagaaacaggtacagcagaacccatctttctggaattctaaagcttatggtccctcactgtgtagcagaggtgaatctgccagagtctggcattatctgagaatctgcctccagggctgtagatggggctgggctaaagcaagactagagggcaggattttctccccccagatctggaatttagcccacagtctggcttttagattttaggctttcgatgcctactgccttaaaactcttgccaagtgcgccacttatagcagcctaaggaatggccacttccccactgacccagttccagtagccaggtgttcagagcaattggaattcatgtgactgccagtcagatccacgaggaagatgaacaggctggttaacgaaaacatgtaagactgacctccttgcccagagatgattcagggtggctttttgtcttagtcttcctcaggccatcagtggccatccctccaaatggacagatacagcattggcataaaaccttactatgcagatgcagctttttgggatgtttccggtgtgtgtatatcctccgcccaacctgttgctaacctgctaattctaccttaatccttcccatttagaaaatacaggacagccattgctcatcaaagcttgtcccacccaattctgcctctccccttgtcagtcaccctcaaatgaaggccaggagcttaggcagatggcttgctgtatttacatagtttgcctgttggcttacattggccaacccgaagagttgttttggtggtggtggtttttgttttgtgaatcttgccattccttcttcactattaaattcttgcttcgcttttagcagaaagaagtgtttaataaattcaggggatttttttttcttctaattaaggcgttagttaaaatagggcataggaggtcataagccgtgcttccttctgataggggtctgcgtggttacaccaggcttgcaatgggagctgagcaggagcacgcaccctgctctgcccattgttcagctgtgaatgtgtggaaacaccctgtgcaaagccggtggcacttacaaccacaaataaagataggttcaaggctgggtgtggtagctcatgcctgtaatcccagcactttgggaggttgaggtgggagtattgcttgagctcaggactcgagaccagcctgggcaatataatgagaccccatctctactaaaaatcaaagccgggtgtggtggcgcacgcctgtagtcccaactactccagaggctgaggtaggaggattgcttgagccctggaggtcaaggctgcagtgagccaagatcgtgccactgcacttcagcttgggtgacagaatgagaccctgtctcacccaaaaataatgataggttctgtgtatctgcatccgttggtaaaataccactttcctcgcaaaataatctgcaatcccacaaaatggtatcacggggtcccaagtcgatggcactcatcctgtgggccttagctcatgtttcccttgctcagagacgtcgcctgacccccaggcaggtgaccagatatcacgcttcctctgcttttccttcacaggatttaccagaatttgtcaatctgcttgtgtcacttttttttttttttttttttttttgagtaatgtgtttctcacaccaaactctgtatggggagaggctgtgtctgctctactctctatgggatcgcggctccgaactcagcaccagctaatcaggaatttcataaatgtcacaggaaggagtgaggaaacccatttatcttagaggtgcttgaagcaaaacgttttacacttagataaatcttggatcactttttaaatgagacctacacgtttctttcatgaagcagtcatgatttccatagcactttattcacactacttgcatagtatttagtacactgcatagtgacttttaagagtccacttttacctgctaggttgagagtcacttaagggggagatggcatctcgctcatttctacattccgactcttgactcaatcttttgaaggactgagtggtatttccaatgtggatgctactgtgaggctgtcatttggcttcctttttttttttttttttttggaagaaggagtcttactcctgtcgctcaggtgggagtgccgtggcacaatcacagctcattgcagcctttacttcccgggctcaggtgatcctcctgcctaattttttttttatttttttgtatagacaacctcttgctatattgcccaggctggtcttgaacccctgggctcaagggatccacccacataggcctcccaaattggtaggattacaggcatgagccactgcacccggcctccacttctgtttggctgacttgtctaaaggggtgttctttttctgtgattgttctctgcccacttgtgagaactagagcacctgctaggtgtcctttactttgggtaattaaccccacatgttccagattaaaggcatttacctttcgatttacattctctctccaggtacatgacctttaaggtacagagctggaactcgagtcaaaggtttctgatgccttctgtacttttgatttcatgtagcaattcaaggctgtgtgaaatgaactacaggagatccaggtgctgctctgcccaggggatctaatcccaccagaccggttgcactgcaccctgacccatggtcaggatgtttcctggaatacatccacttgacagtctcctctctgtgccacagccttaggcaatatgctgctgatggagctctaggttaattgctacaccacattgggccctctcttgtgtttgtatccaggatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctataggtgagttttggttgctgccctgtcttctaattcactgcctcttccctctcctggcatgatccatccttccacttctcatgataatcagttgaaaccttttttggaattaaattcacagaagttttgttttggtttttgtttttgagacagggtctcactccatagcccgggctggagtgcagtggcgcaatcatggctcactgcagccggtccatctggacctcccaagtagatagctgggactacaggcacgcaccactacacatggctaatttttattttttattttttgtagagacaggggtcttgcaatgttgcccaggcctcacaaaggttccaaggatccattaggataaattaataacagtaataaacactgcctgcaatctaaaatttgcctcactttgtattcataaaataggcccgacagtctcagaagagactgtttattcatgaattggttcagccccagtttgctaagaacctgtcatagccaagacctgcagggtgctaaacacactgttgttctctttttttcattttaacatttgaagtgaatcccttaaccatgattctattccattttaagaatctacaccttaactaaagggtgtggctaacctgctctaagttacaagaattacagtcatgtggagcatggctcaccagtcaggagctaggtgagccacttgtgagcagtgtcctgcatgataatatcttccgtgtgtagccccctcccaaatatttgattctccattttgtgacacacaatcttttgatcataatataccatactttgaatggactccgaatctgcttgatgttgttaagtctcagaattcaacagatatcaaatgtaactttagtcagagagaaggttggagacagtgagaagtgtaatagtgaatgttagataatttttattctcacattttcctgtttttttttctgctgttagtgtcctcacctaattgcacatatgctcttttttcttttttattgttttatttcttttctttctttctttctttttttttttttaagacagtgtcttgctattttggctaggtcggtcttgaactcctggcctcaagcaatcctcccaccttggcctcctaaagtgctaggattacaggcatgagtcaccacacccagctcacataaactctttttctcttgagatgcaattgttgctttccttagagaaaaattttcgtatattaggggcatgaatgccaaagtaaaggatttcctgattgaaatttgctatttattaaccttgttaaatgcagttcctatcataaactcatgacagtattgacatcattattaaattataagagctttaaaaacagtgaatattcttaaataccgtgggagtcaaaataggaagagaacaagtagtaactctcttagagagagtgcagtaagactggtgggtggtgctggagataagtgggaacgcaagcactgcatagcaggtgtggcaggtaccacagagacacttctctaattcattctcagtgcagatcccctagacctcaactccatacagtgcatttatcacagcctcacggcactgtgcaggagggaagagggtgcagaactgggaaccagcctggataaggacagtgggagccacctgtttgaaagcagtctaggatctctgctcgttcttaggtcacggggctgcagcaggttgattaggcagcttgttttgagctttcttgaccaggctgtggggattagatcacagcatttttttcccactctccactttctttccagtgtatgctttgtggaggttgctggtatgatctctgatggtgaagggagttaagcgtcgtcctcatgctatcagactccaggcagtaaattccatttttgttctcctctccgcggctaatccagccatctccactccgcttgccccaaagagagacgtttccacatgtagttttaaaaactacatgtaagtaatgactcccctacttgacagggacttctgctgcagatcaaaataatattaacaacaagacctaactgaacacttggactgggtgtggtgactcacacctctaatcccagcacctcggaaggctgagcggggaggatcgcttgagcctggaagtttgaggccagccggggcaacataaggagacccctatctctacaaaaaaaaaaaaaacatatacatatatgttaaaaaattagccagccaggcgcggtggctcacgcctgtaatcccagcactctgggaggccgaggcgggcggatcacgaggtcaggagatcgagaccatcctggctaacaccctgaaaccctgtctctactaaaaatacaaaaaattagccgggcaaggtggcgggtgcctgtagtcccagctactcgggaggctgaggcagaagaatagtgtgaaccgcagggggcggagcctgcagtgagccgagatcgcgccaccgcactccagcctgggcgacagcgagactccgtctcaaaaaaaaaaaaagaaaaaaattcggcaggcatggtggcatgcacctgtggtcctagctacttgggaggctgaggtgggagaattgcttgagcccaggagattgaggctgcagtgagctgtaactgtgccactgtattccagcctgggtgacagagcaagaccctgagtgtcaatcaatcaataaatcaataaaacgagcacttgttacaggaccagcacttcccttgcattcgtctattgattcttctaacaatattattgtataacaataatagtgtccacactgttccgatgaataattaggtcttccaaagacttcatcaccagactgctaactggtagtgaagtcagaattcaaaccatggttctaaccactgggctacactgtcttctcaggagagacttgaggatttagagtaccattacagtgtcagcttcttagtcctttttggtgataggaccacttcaattcctgaaaataaggtagagtgggcaaaagcaattcagtcttatctcaagctttcttgaatcctcagaggctttgagttgggccgagcagcaagcttcctttccttcattggatattaccgcccctcagtctacttgtctcatttgtctcaaaatatggtgggtagacactgtaacttgatgtggtttctgatgaagcagtgccagcccccatcttgacaaattttatttcaattcatggtgtctgtggttcagttctgagaattgattttaatttactcttggacttgaatcccatgttcaggctctaactgatatggttgactttgaagggaacacagttaattaggatagattcaaatgctatttttatcccttggatttatttcacaggataatttaattccattcagtatacaggctgggaacagagtcttaaggataagactttgaaagccaagtccttggaattcacacacagtaaagggcacatttgggtcacagagggtgtggttttgatacaagagcccagtgagaaacttgggagtatcaggcagcctcttttatcatacatgtcccagaacgccctttatcagagctaaaataatcccccagaagatgcctctgacctatccaaacagagctgttgtttgtctgtttggattctttgagggaggggagggagagaggtgtttattttccagcaggttacaaagatgataccatatgcaagtcactgttaaagaaagcttcagaaggtagtaccttaggctcctctgacacaaatttcttctttagctgcctgtgcctgtgcaagaggacatgggccagttacgtttgcacgcattccgtcttgtgttctgaccctgattctcagatgtattcacttgtattttgtggaggaacagaagcccagttcctaggagactcagcaagggaagggcctgcctctctgcctttggttggagggtctggaacctgccatggcccagaaaccaagaagagtaggctgggaaggaggcagtcatcaagtcagttctcccaaggggaaaaaaagaagactattcattcttttgtcctgggcttcttggccgattggaaggccagacagtgctcatgaataatttactcatggtgttgacttttttccggagtcaagccctacagaaaagtaagggaaacaaaggggcatgcatcccattgaccagacatctttcagcatgtttcatcaactgtattaaagggaaactcagctgtcattgacatttcaaccccaaactcctgaagccagccagcacacatttgattggctgtttttgacaaagtgtggaatactgtatctgaaatatgttgggtgaggaatagtttatagaagggcacagtttaaatttcacttcctcctcaccatgttacccctgggcacacagcactttccaacacatgcttttcgactcatgagtctgactgctttgtgccttatgcagctgttggcatgctgggtgcacggtaattagtgtttaccctgaaagctccaaatgcttcccgtggtatttcgccatcccattttgcagatgtggcccacagaggaagcttttgccccacagaggctcactgccaagtctgacatgccgccttttactcccatgattacgtggcacatgaacttttcaactttgagctgctgatttctcctcagattgagagaaaaatgtctacttaatttgactcttttaaaaattcagaatttgggaagagtagcaatctcactcgcaagattaagccctgttaagctagtctctgaacatagttgggggatctgtgtgaatataccgatcaccaacatcatctagctcttgtttctcaagaatcatgagggtccacaggtgcctcgctgactccagataactcagctgggcatagccttgcttggcaagtggtctcctctgtgagcaccacttcctggtctaagaattcacaagtgatccgtttccaaatgaatttgtgtgttggggccaggcacagtggcctatgcctgtaatcccagcattttgtgaggccaaggtgggcagatctgttgagtctaggggttcaagaccagcgtaggcaacataaggagaccctgtctctataaaaaatacaaaaattaggtgggcatggtgtagtgcacacctgtgtagtcccagctactcgggaggctgagatgggaggatcacttgagcacgggaggtgtaggttgcagtgagccaaaattgcaccactgtactccaacctgggtgacagagtgagaccctgtctcaaaaaaacaaaaacaaacaaaaaaaaatggtgtcttgggccagtgatggattttacatgcctgagttactgtgcactctctctctctccctgcagttcttcccctctggaaaactgtggcaatctctctctgattcccacctcctaggacctctcttactcctcagtatttcttatcagcagactttgagtccccagatgtctttcatttgagcctggagttttgggctcttactgtcacctcacctctattggaattcagttctgtatttatattcattctactcattctagtgaggaaaatctttttagataaagatgaaagtaaaatttaacagctctcttttccctttgtcatctgctggcattattccttctgctgcaagaagtaggtctcttctctcttgatttgcatactgcagagactactacaaattgtcatttgttgtttgtatagtccttgtttattcagtacatgccagccatgggaatgctcagtatattagtaactttcacatcagactttggctgtgagccctcacctgggactgatactggctctttgagctttttagtcatgtgcttgtctcttctcttacttagcttgtcatgccttgctgtgccatggtggcctcattcagtgactgctcttcaactctcaccagaaagtgaccaccattcctgacttccaagatccttcttcaaggatatgatggagagctcagagctttccagcttcttagagtagctcagcatttccctcaaatggggtcttcccttttcccgtagtgaaactcatcagccactgttctgcacccttgcatggcctctggagatcttttaacaagtatttgttgagcgtcacccttctgccaaggatatggatgtaatggtatgagcaaaaacaaaaatactcgccagtggagggtatgatccagtgagggagaaagatgtcaatcaaatgattataccaataaaaagtagcaaccatgactagtgctatgaagaggagaaatacaatgcagtgaatgagaacctagaatagggtgattctatccagttagggaaagatggaagatttttataaggaagtgactcttgggctgaggtcacggtaaagagggaaggaaggaacatttgagacagaagaaacagcaaacgcagatagatgcccagtaacaggaaggagtgtggcaaggtcaggggtttttagagcaggccagcctggctggagtctaggaagcgcatcttacttcacttggcattttattatcctacagtgttcagtcagctgatgacttcaagattttattaaacactccttgtaaataatttatttgaaggttaggtaaggccggtcatgttgccaatccctggaggagccatctattcacagtgagttctctgtgtccaggtctgtgcatttatactcaacaatgggtttataaaatattagagccagaggagacctcaaacgttgctaagggccaagttatcttttacagatgagggacttcaggtgtgaaacgtccaaaaattgtttctcatagtggatattctcttcggatgactcatctgctgtttgctttccatctccaggaaaacaaaaatatggctagaaaattttgtttcagtcttcaacttacagctggcatgaagagcaaatcaagacattttgaggcattcaaccctgtttactccattgcagtgagaaaaatccagttgagatcagaacatatttcctgagctgccacctagtgccggatgttgcattaggaggtgtagatacaagatgagtagatgagatgtctgccctttgaggcgctttctgtggggtgagagagatagccattaataagtcatggcagctgggttccaaaattggagttttcccagggtatcttgggagcagacagaatggccacttgccctaagatggatgttcaggcaaacttcctggaggaggtgatgcctgagctgagtgtgaagagttaaaagctgaacaaagataaggagggtgtttaggtaggggagcaagtttgagcaaagcagagaagtgtggtgaatgtgtagttaaagtggaaaacgacaggaactttggtagcactggagcctgaagttggaggcatgggaagagggaaggctagaggaggctgcagaaatgaagtattaagcacttactgttcttgagatgtttgaattctgggtcacttaggactttgctccattgcctatcacaggaaacataaaaatgacagtggcttaagccagatggaaacatagtgctctctcacatgaaaagcccggaggtaggtagtccagccccgccatggaagctccgtggagtcatttgcaacccagatttctgtgctttctgttctgctgtagacagggtcacctccttgtctaaatggttgctgaagatctaggaatcatctctctattccaattccatgtagtaagaagggctagagggcattcctccaaactgagtcagctccctttaaggggcctcctggaattccacacagtacttaccatggaattggccagaacttgatcatatggctgagtctagctccagtgaaagccaagaaatacagtattacaagtggccatgttccagctaaaaatcagcattccattattaagaagggaaagaatcattatttgatagaaaacttgcagtgtcagacacaaattccatgccagggagtctgggctttatggagcaggtaacctttgaagaattctcagcaggtcttatgacatgagtggatttatattttacttttacgtgcgggtggggggcatggcatgtgtggacatacccatggtaagtagcagccaggttgcaagggagaggttcattttgaggcagttgcagagttccaagtaacaagataatgaggacctgaactaagacagtgatggtagggctgatgagaaaggcataagagataatagcaagtaaagctgataggacttagtatttgggtggattcagggtaaaaaagaaaccggaaatcatttccaggtgtttagctagaaggttgagtggatggcagtgccattagctaggagagatcatgtgcctaggaagaagtctaggcaaaagaggaagaagttttagaaaggttgtatgacaggtgcctgaggtatactccagtggagatgctccatggataggggcataggagtctgaagctcagtaaagaggatgggctgaattaaatatttggaagtcatcaggacatagctattagttgagaccacgagactgaatgagatcacccaataggagtctcttaaatggaacagtgtgagtcaaggacagaaccctggggaaccagactccattagaaatctgcctaaatttggctccagggttatagaaacaattggtatgttcatcatttagagtaagtatccccaaagtgccagtgtattaaaaatataattccataaaagtatagaaaaagatcacttactttagagtatgtgtgtgatgctacatatattcttcctactgaaagaatgctggacatggttttcagaagccctgcatgctagacccagccctggtcctggggatgtgggcaggttgctgaatgcccctagccctttggcccatctgtacagtggaggtgccattggcacagcttcccagcagggtccttgtaaaactcaaatcagatggaagtagaaatgcgaatgctttttggaacatgccgtgtcaatataagaggttatctttgcatatgtgctgtcacctgatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttgaaattgcaagtgattgatatacttaccatgaacttaccataaacccttgagataattttcttaggaagtcctagggcatatgtgacaggttgtacaacctgaagactatactctggcattttgtttcaatttcaacagtttctaatgtttaggggaagcagttgacctcattttgagtttacgccttctggtattaaagcagatgtttgatggttaatttgagaggagattcaagaaccttttcagaccattagtggagtgaacatcctgaggatgtaatcccagtaatgcagtttctcaaaggacctaactttataacagatagacatttaagccctgggacaccttgatcatttttctgtacttcatatattaaaccagaatgctgatcctggcatacctcctcagggtttggccttttcatcagtgaaggctgtgactatttggaactaattgataaatgtgttagtggctttcaccagctaatgaaaccaggccaccagttttgctcttcttcccaccaaattgaccaagcaaccaattgcttcattataattacagagaatcttggatttatttgctgaacaagaaaaatacagtcatttaatctttatgtattaaatgaacacaaccatttgtaaaaagtaattgaattgtacagttcaacaaatgtttatgaaaagtctacccaatgcaaacctttgtcaggctcttagggagtaaaagaagaataaagacaggtcctgccctcgagcttggggtgtttgttctttccgttaacaaataatttttttgttgttgggcactcactgtgtaccagacgctactgtgagctctggaaaaatacaggaaataaaacagacaaaaccccctcctctcagggagcttaacttctagcacaagtagtaggacaaaatatagaaagaacacaaaagtaggacaaaagacaaaaatatattgaatgttagggtgattcagtatatggataaaaaacttggtaagagcaatataaaattcagtaacaaagatttactgtttgacacagagatttttaaaagcttctctgataagggacatttgagcagatgaacaaagacctaaggatgggaggaggcagctccatgtgaatatctgggagaagagtgttctaggccaagtccttggagggagagtgcgcagtgggatcaaggagcagcagagggaccagtgggctggagcagatgaattcgggcgtcatgggcgtcgagggcccaagcctttttgttttctttctgcaatacagaatgctaaccacatgtgttgagcatttgtcctgtaaggataaactcctctgtttaattgtatcttctgtatgacagttgcacaaggtaagtggcattatccttattttgcagacaaaggtcagtgacattatcctatatttaaggctctgggaagtgaaaggacttgttcaaggtcacacagtatgtggtggaatctacaattccactccatgatatccttttgaatccatgcaggtgctgagttccctcacccatcaggcctttccacacgtttccctctgcttagaatgctcccccatctctttgccaagcttccagctaccaattcttgcagtctcatcttagtcatcacctcctctgataagcctttcctggactcccctaccctccagattccatctaggttaggtgccccctctgttcccatggcatcccatgaaacccttcccttagtgctttccataggctgtgcccctgtgcatatgggttcatgaaggcagggactgtggctgtccaagcccagcccctaggacaatgacaggagtgttaggtgttcttaggtgttcatggaattgaccaaggcctcaaattctacgctttttttattttaagatgacaggtcagggctgagaatatattatgattgctaccatttattgaacatctactacgagccaggctctattctgagctctctgcattaactcacctactcctcatgacagcgctatgatatgacactcagcttgggaagagctgcccattgattgtcttattctggcccaaacccatgattttctcataactcaaagcagtcttttttaaataagtgaaagccttctggaaagtttctctgattgaccgaaaaggatgtttgcacatctgtagtagtgatgcatttatatcctcatacatatttatttggatctgacttcgattctttccttagaacagattcctggaaaggcacacaaattaacgacttttagagctggcattgtggataagagctggggctcctgagtagaatggacctgggtgtttccagtcttggttctgccacttctctgttgtgggatcttgatcaggttactttacctctctaagcctcagtttcttcaatgataaaatggaagtcctggaaatactcacctgagggtggttgttagaattaaatttgtgatgtggaggtgcatgtaaagcctttagaccagagcctggtatgtagtacatgctcagtgatgttcacttttaaacattctgtttgctaccacttttgggaaaagcatcaaacacatgttccagtgacgggtattggtgccatttttctagttcccctcatagatcttaagtgcacaattggataaattttgacatatgtacacattgtgtaatcaatactccaaatactatatggaacatttctgtcatcctagaaagtttttagtgcccctttcagttagtccccaaacacccccataggcacccagtgattctgtgttgatattataggctgtggatatccacattgaaactattgagtgtcttcaaagtagaattgcttctcaggagtgtccttttcagtataagaggatgggctctttaaactgactacatgagtgtaatggcagttatgatcagaagagactacccaaagaaagacttcatcccatcagtcagttttactctctgtagagaaaagtaattacaggaggataaacaccagcacatcaacagttgttgtctgaggtaatataggtgatttttattttctttttgatggttttcaaatgttctgtattgaacaagtgttgtctttttatcattaaaaaaatgccatcctatttatttatttatttagagatggagtctcactctgtcacccaggctggagtgcagtggcttgatctcagctcactgcagcctctcctcccgggctcaagcgattctcctgcctcagcctcccaagtgcctgggattgcaggcatgcgccaccacactcggctaatttttgtatttttagtagagacggggtttcaccatgttggccaggctagtctcaaattcctgacctcaagtgatcccctacctgggcttcacaaagtgctgggattacaggcatgagccaccgcacctgggcagaaatgctattttagaagtgatctcatgtgatactatgtttttcaacatgatgtcagaaattggtaacctgctgttttatcagttaagttctgtcaagccccagcctcatgctgtgaccactccttgtctgtgaaacccagttctacagaagtcacaaagccattgtcttagtctgctcagtactgcttagtctgctgccataataaataccacagactggattccttgaacagaaatgtatttctcacagctctggagactgggaattccaagatctgggtgctggccaatttggttcctcatgagggctctcttcctggctttaaggtggctgccgtcttgctgtgttctcatgcggtgaggggatggagagagcacaggctttctggtgtctcttgttataaggtcacacattccatcatgagacctcacctttgtggcctcacctagccccaattatctcccaaaggccctacctccaaatgctatcacattagagcttagggcttcaatatatgaattctggcaggacacaaaacattcagtccattacagccattcattcatacacgtgtttggggttttcagttacattaagcaacatgttttgcagctacttggtttgatagtgccaaatctacccggaaatgatttcagccctaaggaaaacagctcctgctacagtggaacacacagtagacaggcacgagagaataaccaaggattagaccgaggcgttgtcatgcgtttggctcattaagccatgcatgttaggcttggagctctattttgaggtgtgttgagaccaaatccttctcctagatcccagtacttaagcctggcaggaaaaaaagctgagtacactgtggttttagagtgtaccttttgataaatagtttgcagcatgtccctgaaaggggaattttttcctttgtcttgcaaatgtcaaattgtacttttctgtaaactttgtaagtagaaatgtgaagtggtacaagtgctctgttgctttttggtgaaaatgctcacacatgatgaatttctcagttcagttgcaaagagaagttagtgaaacctgacaggcaaactaccccacaccctggagaacagtgtcctgggggtgtctggtttgctaggtgtgtggctggtgcagcaatgggaaggtggcgctttgactgcctggcccctcacatcttgctcctcccttttcactgctcctctggcctccagagtagccatgtaagcctgtgctttcacgtacagaattgctgctctaccctgttcttggcatttgcgtaaaaatttactgtgttccgctgacaaaattctagaatctcaaagctggaatggagttcaaagttatatacccttcttctttcaaagcatgaatatccaacatctgccgagcagtcatttttttctgtacttaaacacctataagcaaagaggaacttacttcctccactttcagggatgtacggcttttggaaatttcgcctttctgttgactcaaacattgtttcccagtagcttcagttcactggttctggaccacctataaggggtagacttaaaaaaaaaaaatacagctctcttacaagaaagctgtggagatatgtgaaggcagtctgggtctcccaatctagtttacctgttaacaaaggaaatactattagcctgatagtcgctcgttctagctgtttcttcaggattactgatttctcagtaatccataaaccatccatgttattaggcattctagatacttggatcaatatccggttgacttgtcacgttcttctcttacgaaatcagaactatctgaactagcagttggctaactgaactgagttatgttattatagctcatgttacttcttttgggtaagacttggtctttttttttgagacacggtctccctctgttgcccaggctggagtgcagcggtgcagctcactgcagcctagagctcctgggctcaaaccatcctcccacctcagcctcccaagtatctgggactacaagtgtgtaccagcacacccagctaatttttgtaatatttttagagatggggtctcgctatgttgcccaggctggtctcaaactcctgggctcaagcaaccctcccactgtggcctcctaaagtgctggaattacagcttgaaccaccatgcccatccttggtctttaactggatattgttgatgctgactatagagtagcaagcacggtggaaagttaattggtgtggtgatctcaaaaaaggatatttaaattttcctgttgtaaggatctcaggaatttaattcctgcatccatttgagagtatagcttcagcctgtatgtgcacatgaaaatagagaaggtagtcataaatcccagaactgaggatctctgtgcacagcccactctgcaaaggtggatattttcctctcaaatcaatctgtgacttgctcaagggtgaattaccaaagatgaaacatgggctgagcacgggggtgggatgggggagacaagaaaatcacctttgggtatgtcaaaatagaggtacctatggaactccttcaaatggtccatctcaaagttggaaataccaggataatgtttaagactggccacagactcaggttgattgcatggaacagcatgaaaatgagacagtattggcttacagttaagaacgaggctttgaagtcaaacttagatttaaaacttacccccacaatgtactgtaattctgtgatattgtaccaactctttaattctctaagcctccgtttcttaatctacatgaggataacagtactatccattccatggagttacagtgaaaattaattcatgtggcttgcttattccagtgtctgacatcagcaaatcctccatatacattatcagttgttaagaagaaaagtgatccagggaaggaaattaaacaatgaatttacttgaaagacagattccataaggaaattgttgaataaattatggttatacccgtactgtggaatattatgcaacaattaaaagaaagaatacattagatctacatatattgacctggatggtttgtccctgatagataaataaatgaaaaaaagagagatgtgtgctcattttaatcccattaaaaaaaaaagcagtagcgaaagctacaccaagagtctcatacgtttcctcatttgtcatggctacataagggcttgcatcttgagctcttttttgttcatttcatttgttatccctcaatttctggcacagggcatggcaatatttcttttttcttgtcttcatttctgttttatttctagcaactgagccaacatttgtctgcaggaattcatggtggggagtaagtgatgagaagatgggtggaaacacagtatcatttattgactaaagagcagtgtcactttaatttaattttaaaatgtaaattaatgcatatacataaaaaggacacttttagctgttctaaaatgattacagtgaatgctaaatcctcttcatacccttgtccccagtctctcaattcctcttcctcaagacatgtccttatatgtccttccagaaatggtctatgcatatgcaagctctgcatttgaatgtctcctgttgaaaaacaaatggtggtatattatctacctgaagaacagagattttttcctaagtctttagagagatgaaatctaaatccttaaagaaaggtagtaggtaggcaatcttttcttttcttttcttttcttttttttttttttttttttcgagatggagtctcactctcactcaggcaggagtgcaatggcatggtcttcactcactgcaacctccacctcccaggttcaagtgattctcctacctcagcctcttgagtagctgggactatagcacatgccaccacacccggctaatttttgtatttttagtagagacgggtgtcactatgttggccaggctggtcgcaaactcctgacctcgtgatccgcacaccccagccttccaaagtgctgggattacagacatgagccaccatgcccattcaatcttttcttttatcagaagggtctatgggtgacagttcaagtcctggaaataattctgctatctcttgttggagaaagtgctggttttttcagatcaggcaacaggcttataaacgtttattgcagttacaagctacaaagaaagatttctttccagcactactgctccaggtagagcagttgcaccagtcattatttataactggattaaagagtagcagcacatacttctaccgtggttatagagtgccttctgttgtacagagtggactgcttattcaccagggagttctcaaacacctttctctatgggcgctgtcccaaataatgtcaagagagaaaaaattaaaaatgagctcctgccctctaagaacagatgggagcagccccaaatcttgcaaatgaagcaagagggggtattcagtctttaatccaagcagctagaagcttgcctttcccaagttcacccagtgaggattttaacactcctttgacaaagaaatggggccgagcagcagaggaaggcaggtgacactgagtcatggaattcaccctttcgagcccttcctgggggatgtgtggctcttgggttggttcttgaaggaaaggaatgaatgtaagagaggaagggaagcaggcttttttttttttttttttttgactcctacacagaagatggaattgagaaaaatatactgtggcggtgaaatcaacttacaaaactgaggaggaaaattttgacaaaagcaaacccaaaatctgattactgtggggctgtccattttattgctgcaccaaggagcagggtagatactattttggcctaaagaacactgaaattttgttttctcatttgcaaatagacaggttcaaacccgtcagaggccgtaactgagtttccctgtgactgatttgtatgtgtgttagtggttttttttttttttttcctgtaagaatctggttgagtaattcagaaggttaaaaaacaacaaaacagaaataagtgagaaaagttaactgaggtctgccacatatgccgggaaggtgcccacagactggcagaatctgtgcagtctttgtctgtttctgcctatgcaaatactaagccacgctcaacagagcttgagcgttgtatctgttcaactgccatttaagaaataggactctgttctcaacagcttattccttggggtttcagaatgtaaaatattaagtgtgtataatcacaggccaggttcccagcatttctcggcatttcagctttggcaggaggaatgggaaaaactgaagtttttatgtccaggaaggctgagtgtaatctttgttctgtggcactgggaaaggaagtgaatctgttacaaagcgctttacctctgaagcatgtctcaggggcagctgtgctttgtgccatgtattctgttttcataaaaagaaagaggtagagtcgagggcttaccatgaagagtattttcacagtatctcacttgatatatcatccagggaaagtgacctgtgttatactttgtgttttaagatataactctagaatcaaaaacttaccagagaagctcaagatactttactttgcaagaattaattctcaagataaaaactcatcagagttcaagataagaagggttcaattaacaacacattttaaatggaagaattatttaaaaaattgttttaactttgaatgagcttagattaacttacctgttgcagaggtaggtcagaccccatgtcatcatttgcccagaaaagtcccagtttgctcccataatcccccttcatgacccattttactctcagaggcccattttgtttattgggttttttttcttgagagagtctcgctctgttgcccagactggagtgcagtggtgcgatctcggctcactgcaacctccacctcctgggttcaagccattttcctgcttcagcctcctgagtagctgggattacaggtgctcaccaccacccccggctaatttttgttatttttagtagagatggggtctcactatattggccaggcaggtcttgaactcctgaatttaagtcatctactcacctcggcctcccaaagtgctgggattacaggcatgagccaccgcacccagccgtctgaggcccattttgggcggtacactgcatggtcatcatacaaagaggtgtctgcatttctacttttttttctttaagatggtagaaccaaacaaaaaagggtgtttttacaaattgagaggggtccctctgtaggaggggaatttctccagcattttcctttgatggagtattctcctctcgttcagaaataggaaatttagtaactaaagcattaagaacagatttattttttaacatcagtcactaccttagtttcagagacacactgggggaaattgcctttcccttacgcctcttgttttatgtcctttatatgagatgttaatatatttacatgaggtataaatttgtctgtaactttataggtttgtattcatttattaatccatccatccattcatttactcattcaacaaatgttaattgagacctattttttgcctggagatataatagtgaccacaataggcctgctccctgcccacaggaagcaggcattctagtgtaagcacacaaacaagtaaaagtaattaccaattgtgaaagttacatggaaggaaataagtgagcttttatttgtggttttatttcatagagctgaaggaagtgaagagacagatacctctctccccacttctttcattgctgaatgtctgaagtatttcttactccattggactactatgacagaacactatcgattgggtggcttgtaaacaacagaaaattatttctcactgctctaaaggctggaaagtgcaaggtcaaggtaccagcagatttggtgtcgggtgagggcctgtttcttggttcacggatagctgccttctcactgagacttcacatggtggaagccgtgagagagctctctaggatttgtcttttcttttcttttcttttctttttttttttttttttttttttttgaggtggagtcttgctctatcgcccactgcaacctccacctaccggcttcaagcaattctcctgcctcagcctcctgagtagctgggattacaggcatgtgccaccacgcctggccaattttgtatttttagtagagatggggtttctgcatgttggtcaggctaatctcgaactcccgacctcaggtgatccacccgccttggcctgccaaagtgctgggattaggagcatgagccaccacgcccagccggatttcttttctaagggcgctaatcccattcacaagggctttaccttcatgacctagccacctcccaaaggacccacttccaaatacagtcacattgaaggttaagtttcaacataccaattttggggatacataaacattcagtctatagcagtattttatctggggtttcaaactcaaataccttcagagtagaggccaatggggacactcctgtctcatggttctaaccagaggggacttgcatatccattcacctaaagctccgttaagaaaggtgaggagccccgagccagacccacaggaagtgtccccaggttgcatttggctctggtcacatattcactttttccagagtccccaaggtatactttagttccacatcaatgcctaccaggcctggttcagtcttacatttcaataggtccccttgtgggtctcggagaaaaagagagcagcattagaattttactaccacagtgagtttttccacttcactttggaaacattgagctattcctacgcagtttggatgacagaaatactgtgctcagtgcaatctactggaaaatctgagtgcttggaaaaatgtcaggaatactctcttttgtcatggaatttctccatattgcggcggtacttcagtgtgagtcagcaggaggaacttcggtgcaccaagcaggcctcacatcagtggggttgtgcgtcccagctctgattgaagtcaggggggtgggtaagtgatgtcctggccagtccagggatgggggctatttctagtgtgcaatgctggccctcctgaaccaaatgtgaacccccctggactctcgcatgagtttctctggaaagctcgtcttctcttctttacccaacccctccccctaccactcttccagaaagttgctcttcagaattccatgaaggatggaagcagccctgaactaactgccctggggctctttattctcaggctaccaagaaaagaaaaaaatgctaagaagcagggacctggctgcctgatcttccctatggtcactggctcttcttgaacaggcatgtaatgaaatagtgtggaacagtaagaaagctcctacaggcagaggccatccatgaagcctcttctcaggcaatggagtcttcaaatggaatgaccacagactgttttctttgaaggtgaatgcacatgtctaagccctaaattgccctgctaaaatcgtcttcccttggacaccaaaagcatagctgacaaaagcaaaaataagtgagagggagtacatcaaactaaaaagctgctgcataggacaggaaacacttgacaaaatggaaaggcaacctatggaaagggagaaaatagttgcagatctgataaggggttagtatccaaagcatataagcaacttatacaacccaatagcaaaaactaataataataacctgattaaaatggacaaaggacctgaatagacatttctccaaagaagatatgcacatggccagtaggtttatgaaaagttgctcaacatcactaaccatctgggaaatgcaaatgaaaaccacaatgaaatatcacctcatacgtgttaggatggttatccaaaaacctgaggacaagtgttggcaagggtgtggagaaaagggaaccctatgcactgttggtgggaatgtaaattggtgcagccactaagcaaaacaatatgtaggttcctcaaaaaaattacaaatagaactatcatatgacccagcaatcccattcctggatctataaccaaaggaattggaatctggatctcagagatgtctgcactctcatgatcattgcagcgttattcacgatagtcaaaatatggaaacaatctaaatgtccttctgcagacaaatagataaagaaaatttgctatggaatattattcagccttaaaaaagaaggaaatcctatcattccggacagtgtggatgggcctggaggagattatgccaaatgaaataaggcagacccagaaagacagatactgcatgatctcactcatatatggaatctaaaatagtcaaaatcatagaagcagggagtagaatggtggttgccaagggtggttgggggacagagaaatgggaagatgttgatcaaagggtacaaaatttcagttatgcaggataaataagctctggaaatcctactgtacaacataagacctatgattaacaatgctgtactgtatacttaaaattttgctaagagagtacatcttaagtgctcttatcaccaagaaaaaaacacaaaggaggcaggaggaaacctttgaagattatgtacaggtttattgcactgacagtagtgatgattttacaggtatacacctctccaaacacatcaagttgcatacattaagtatctacagctttttgtatgtcagttattccttaataaagcagttatttttaaaaatcctcttccctttggtcccccagcctttaacatggcaattgacatggcaattgacatgataaaagctactgtatttccttgatttaaaaaaaccacagctcacaaaatgcccatgattgctgatttgattaaaacaactgtactagcagctggcaagtgtttttttagccactagttttaaggaacattcctgtttcagaagtatcaaaggggagggagcagcacagatcatagaatcaaagtgatacagagattagagttgtgttcccctctaggtagtgatagaggaattgtttcctctctaggcacagtgatagagggtggcttcgttaacagtattattaaggccatcttactgacagcaaaagggaaacaagacagagtcttgatagttgggtaaaaggatcagttaaatttgaaagcgcttccttttgtatgttccggtcagtcttctgcaggaggaggatgtataaagtccactgtgtcagaaaagcagtcagtctacccctccccagtttccatctgggtatctttgtgctcctggtcatttctttcccagaaattgggggatctggtctcagataagaggagtgggtttggatgtcccaatatcacatatggtaaggatgaaaaacatggataagatgattgagtttatcttgtatatgaggccatgtgttgtaaatggtctttttttgctaactttcttgactctctagatgtatcttgaggagtgaagcatgaggacactgttttactcagtcacaacctagagtcaagtttttttctgttattttctcaagacagtgctaccaattagattgtatgcatcccatttgtcctcatttgattcccatccatgttctcaccttctccaaggtgactgttattctgattaatgttcagattcctgtaatgcattgttagcattgggtgctggatctgagccagtccagggtctggagagctatgcagagatagaagtggactccagaaagaggcccccgaatcctgccattccctctccaaggtgccagagtttgcagtttccaggaattgcatgtgatgcagattgtaaattacgcgtaaatatgtatttgtgtcttaaatgacttttttagtttggagaatgcccttcaccctatgactggcataccgcaacacactcattagccctttgttggctgacactttgaaaacatgcagcctcaaagaccattgttaagtcatccatggggtttgtttgaccatgaaggagacttcttcaccattgagttaccaggttcaacaggtcctgggcatctgctttgtgctgtttacctctgaagatcaaaagataaatcagaatctttgctctcaggatttagtctactgggaattctaaacacacataaattgacgatgtaagatatggtaccataaatgctcagagtgaaatgcaaacagaatacagtgggtgcttagaaaaggcaactatgaatgttggctgggtgtggtggctcacgcctgtaatcccagtactttgggaggccagcgtgggcagatcacttgaggtcaggagttcgaaaccagccctgccaacatggtgagattctgtctctactaaaaatacaaaaataaataaataaaaataaaataaaataaaaactagccatgcatggtggtgggttcctctaatcccagctacttgggaggctgaggcaggaggatcacttgaatctgggaggcagaggttgcagtgagccaagatcgtgtcactgccctccatcctgggtgacaaagtgaggctccatctcaaaaaaacaaaacaaacaaaaacaaactatgaatgctgatggagaggttcagtggaggccttgaggagatgacacttgattctgatatgcaagttttccattaacagtgaaacagggaagtccatgctaggtagacatagcgacagggacagaggcgtggaggcagaaaagcgtcctgtgctaaggaatcatgaggactcggtatgatcagaggaccagagcctgggaaggagcagggcagagctggcagctgaggtagatgggggtgagaacctggaaggttttgaatgttgggctaggaagtgtgggctttattttatttgcctttcaatagaagccaacagaggtttttgaggaagagactaacaggaaataaatgcagtgtgttagagtaagtaacagaggagtaagcctggaagccaggagttcaagtaggaggtcttctcataggtcaggcaagaaacagtcacagcttggggcaagccagtaatggtgggaagagaaaggaaaagaggagggggagcgattcacatcgaagggagtctgatgatgtggttgggggaccaaggagtaggcgttaaagatgactccgagatttccagtgaaggagcttttaactgagtagggatagcaacagagtacagtttagtttttgtttttttgtgtttaaagaaacacttctggtagttttgcccataaagcagttagagatgcggcctggctctccggagagaggtgtcaggatagggatttagactggggagccatctgtctaagggaatacttgaactcacgggactcaactgcaaggtaaagtgtcaagcagggcaactgtgcacaactgggcagattgggccctgaacaaccctagggagtgccaccgtatcctagtcattgtagatttgtgcaatgattgaattttctggcagatggcagtcagatgtcttgagaaaggggcacctttttctaatgtgcacaaaggtaccatatggtgtggcaggaatgctggaagtaaacccaggcaagagccaagaacagaaccttagggaaccagctatcctataagggagggtggaggaggaggagcctccggaggagacacttaggggtggtgagagacttaggtaggatttaagtgtttagttgcctccaatttgcctgaaaatagagtcaccacacagtgaactctcatcttactttggtttaatgactcaagtagagcctctgctcatattatccatcagttcttccttttcacatagccggtgagttttccttggcactagcaagtgggatcattaactgtctccatttggttcggatgtagaattattaaacctgtggttctggtcttgagagccaatgcctggcaggtgactgtggcccagggtgaatacctgctgcaaagcctcctctagaaggcccactgcagagcctgcctggggagctcctaggagggcaaagggcaccctgccaggcaagtcacctgtcacacctggctccagccagctaggagtcagattggggcagccccccacccagaactgccagagcctctcggatggctcaagtcctcacctctgagggcctggcagggtgaagaacgctccttgcctcctgaaccatataagaaagaaaaggcatctccagagctatagcttggaggcttggctcctttatggcataaactacaaaggcgcacagcctccccgatgtgtgccaataagatggcataaatgcttcttgtggaagagaaggcttgtgccctgccttggcacatgatcctctgcccacacatgcttgtcattgctgcttcctggcgcttgtgacctcctttgcatcagtggaaagttacaggaggagagatagcaccacctttctagtcaggaatctgtcacgcaacccagatcaaaaacttcaagttcacttctgtgtcaatgggatcccgactctgtgggtggatagaacattgtgtggaaaggctgtaaaactcagagtgtaactgcagtttttatctgagtggctggaactctagcttgtttattacctagatcagacaggtaaaatgttctactttcaaataattcatgtttttcagatcttgaattttggtaaatttttttcatcagttgattctgtttcttaatttgaggaatagagttccttttctaatgggaaaatatatcacttgtcatgtctgtggtgctttcttgtgttctacaaactctacgtgagcataggctgtctggctctggggatcagaagcactcagggagctctgaggacaggatttcatatactacatcctgaaactgggcagatgatcacatgaccctttttttttttttttttttttttaaagcagggctcagaagcagagagagaaagagaatttttccacagcctcagagagaaaatccaggaaaatccaggagtagaactcatgaggctgaggttctggaactgtgttcccaaactgccttctctggaaaaaatgcagagggaaccagccgattcctagtaaaaaatttttgacttactgactttcaaaaagaaatgagttccatatgatgggaattgcattctttgatttggacttaaaggattttctgagcttttaaatggtttcctatgtaatattccatctcttctggtttgggagttttccatgaaatgcctttttaaaaaatacccaaagcatcaaatgagcttttcagcttgatgaagaacttaagaaatttcatcattccttttcttcctggctgaccttttaattttacgcaagatatacaggagtgatttgtcttgtctggtttgtaaggatttttaatcaccagccacacacattagtcactggcttttgtacgtacaagcccaattttctttgttttgggggttttttaaataagtttgtttgttcatttatttggagacatggatcctgttctgtcccccaggctggagtgcagtggcatgatcatatcctcaaactcctggattcacgtgatccttccacctcagtctcccaagtagctgggactacaggtacacaccaccacacccagctagttttaaaaaaaattttatagagacagggtctcactgtgttgcccaagctgacacttacagtaacagtaggatcagactgagagctggaaaaggaacagcgcaatgggattggtagcataaaagatttaccaccagatgcagaaagcagttctcaccattgcttcctcagttccttagcatccaccacgcgcagaactttacactttacactcaaggggtgtatgaataaagggaatgcaaccaaagtttaaggtaagaaactcagagcttgttcagttcagttagtacttaattggctacccagccttgtgccaggtaccttgttctggggctagagagctgaaataagcatggagaagatctgcagggaaaccaacagatgcaatcagtgcaagaaatgctgtcattagaagtgtgtaccaaacaccattggagcacaggcggagagacaccaaacttggcctaggaagggatgcagaggctttggagacagagaagcttcagttaagagtgaaaaagtcagcccaggagagaaatgagctcttccatttatctgtggtgataaatcaatgtgttttaatttttcctttttcagtccgtttaggaccaatactttttataaaatgtattaaaagtaaattactagaaaaatgaaatttccaaatacatataaaacagaagaccacatttttattattagattcagcggacttatattgtcatgtagtatgacagtatgatagtttgtcatactgtcaaatagtttcgaaaaactctgtgcctctacttttacctcaccatgggtcagcgccagtttgcagacgagcggcagtttgtggaccacactttgagtagcattgccctgggcagaggaggacatatgtgaggatatagtgattgactgatgtgagaaatgtggagggaatatcatcgtgtcccatcccatcgttttacagatgaggaaactgaggcccagaaaggtgacagagctaagaccagagtccctgctttctaactcgagacagttcttcttcttgtcctttgactaactcacctgaacagtcaccagatagcaccagcattccagcctgcctaccctgcttcacccacgcctactgcctctgaagaaagggaagaatctgtgtccatcagaacatgccggggataccaggacaccagcctgctgcccaacctggctgacccgtctgctcacggaccctgtcttaatgacagaagccactccaagagttcactgtgtcctgcagtagccagttaaattcatgtaaatcctgtttgggcagtcagtggaatttttaatactcttctcctttaaaaaaaaaaaaaaaaaaaaggaacaaaggtttttctcatctataagccaaacatgagcaggcagtcaccaagcagggcaaattgttatctcttggaatcagtttggttctagactggtcttgaaggattgacgcctggtctggggtggacttgagagccacagagtatgctgtcctggtcttaggtcatccccaagacaggggacctctgcaggcaatagcagcttcacgttggctgtagaggtcccagatgggtcccagggtcccagcacaaaccagaatccacccagctccccccacatcctccctaatccttcctcactgcggtctcctgggaacctggccaaacccaatggtcagggagggagttgctgttcagattaatagccatttattatgggcctggtatttgcaaagcactgtgttaggcactgaagggaaccccgaaatataaagatatagaaacgaaggcaatgagtctcctcatggatattgcattttaggtggagaaataagtcatataacagcccagacgggattttgaaatttgttctctctgcctgcctcttttggtccccatgaccaaggaaggcaaacaccagtgcagtggcattgatataaattcttaaatgtgaacatggcacttggagttgattgcttatttgtgaaaatacatgataaaaatattcatagattcagacatgtcaaaaagattccttcatttatcacagagttgtttataacagtgaaaaatttaagaagtctgcaggtggccttgcatggtctgggtgttatcacaccactgagtgtcaaaccagcatctgctgttgggtatgggtcctaagcaatagacagggagggggtgaagaacaaggactggctgtacagttgaattttatttgattacgttgtgaagtacagatactgtttcacttcctgggaattttgtgttttatttctggagatttgaaattctccagaatggaaataaagttctccagccactgtggtggtgtggatggcaacagggttcagtgacttcccttatcctcgttcaacttattctacctagcagaaccagtcacctgtggtgaattcagtggcgtttgacagtctaggatgaaccgaatgaacctcaacttaaaccagctttttgtcattgtactgacctgggcacttgacactaaacagagatcttaattcctgtatcttcatgcatcagaatttggtcttagtggagatgtcaatagacgacggtgttgtggctggttgggtttaaccagttctggaggcattttgctcgttgcccaaggtactggtgccagaccatgtcactgtatgacccatctggctttggctcctggctctattacccagagagcagtttataagccagatgtgtcacttaatagtaggcatacctgcccaaaatgcaaaagcttacagtagttatctagaatttacgaagcttgtttttactctttatcagtgttgattcttataaaaatcatgacagtaggccatgtagatattatctttcttgttgatgaataaataatagccaagggctctacagcacttaatgcattccaggcgctatgctaaacctaattcacattaagtaactcatcatttctatgaggcaggaactgttgttatctacatttcttgatgaggaaataagcccagagtggttaagtaacttgcccaagatcacacagctagtaaaactaaaactaaactcggctaatcaggctctaaagtctgtgcccgtagcctcacaatatgctgcccattgaaatcagacagacagatgagatgtggtatgacctccccaagccacttgggtaggggagggaagcagattgagggaggcaactgtaaaagcatggttgggaagttgtccttggctcatctctctatatggcacagggctccaaactgaaatagccactattgggtcaagattagtccagcatttaggcaagaagaatgttagtccagtcatctgctacttttgctagcatgtatggtggtgacactttttaaactaaaagtaacacacataggctaaaaaataaatttttcctggtttttgaattctgtttacttttaagatcttaggaagttataatgactcacacttgcacatttaataatgacttttattaagaatgctatgacacaaaattagaaacattcttcagacagtgtctccacgtgtaagtacttaaagaaaacaactaaatggctatttgggaaaactgggccctttggttgcaaaaccaagtgctggggccggagtgagtgctcaagaagtaccagtgagttctcccaagggaaatttcttaggggaaaatgtgatgtcttttgcacatgttactatgatgtgagtccagtattggtaggaaatcagtaaaattccctgaactttactgtgtgtgttgccgtcttgtgtctagcccgtgattgacattctagagataatatgagaaatattccagacctgaccttagagtttgtaatccagttgggagaaacaaagccttttatgcaaaacataattagagaaccaagcaatatcatctataatctaaaagtaaaatgtgaggtatgtttttaattccaagagcctgtgagtggttctgaagtgcaagtgtcttcttgtgtttttcagaggtttgtgtttagatggctcaggtttaatctctaatggggatagcagggaaccagatgagacctgctgaggtggccacagtactgattctagtgggcaggctgcctcccctctgatactgtgtaaggcattactaatgctggcaacagtttgcatatagccaattgccaaaagcagcctgcacatccctcctgaggctggtcccgtaaattcttctctttcctgtcgtaaagcattcctcatcaccacctcccttttcacactttatgcaaggccgtgcactgggacagcaaatggctgcaactttcactgcttgcttttcccaagtcgaagaaaagttccaacgctggcaaagcaaggacattgctattttctgacaatcgaatgtcttcgaggaactagcttcagtgctgatagggtctgtgttcctctagtaagaatagcactgtttccattagaggggaccaggatgggtagacaggctaagacgtctgattactctttgctctgtgtatttgtatgacagctcgggtgtctggcttaccttcctgaggatgagagccatagcattatccatttaataacagccacagtgacagtgctgataatggctagcatttacctagcactgtgtgccctagaacatttaatagtttcactctatgaactcgtttgttggtcttcgtgccatgtgtccaacataaagctagcaggacccatctgtccttgcccatgcttattctgtgccacagccacccctggttgtgattaagatattaatgttaaagagggaattgagttctgatttctcctcattcaaaaccattctgtcatcttcatgcacatgccctgcaggcagccagccagtaaggggtccttcatacctatcctgttcctggctggtggctctcagaatctgccatggctctttgatcctgtttgtcctcctgcccttgagtgactggctatcagaaagccttcatttccttgttggattctgcctccaggaagcaaagccgacccagtggtttctgtgggtcagctgcacttggctgtctgcactggggaagagacttggcttgttggctgttttatgccctttggactgtcaggtccaagtgtactgttggccgcagcatccagtctgtgctatcagagcaaggcgctatggtcaggagacccttagccaccaaaggtctgttgtctcctggtgtctttgcctgaagacttctggccttcttgtgtttcatcactaagtgcatctataagctgacccgctgccaggtatcatgtctgagcattttggcaaggagagtcggtgagagaagttttcttggcaaccataaaataaaagtactatcaggagctgctaaataaatttgcaccgcttcagccagggaatttcagctctcctgggtgggatagtgataggggatgtggaatgcaaaaaaaaaaaagaaaaagaaaaagaaaaaaaattatgaggctcagctgtcagtttgatggctcatttatttgatggtcctaaggagatgtatgattggtacactgaggatgtttatcaaactcatttcctcttgtatttgtccagagagtcagcgaatggggttttttgggtatttttttctaccgtgagacaaagtgaggggaaatctctgagtccctttgctcaacttaagttggtcctgtgtatctgcagtggtgatggtgggaacacactgcctacatgtcaagggcatcaaacacccagaacaggatgaagaccaacacctagtctatgggaattagtttgtgagtctgtgccctgtttgtttgtttctttgtttcattattgttttttgagacaggatcttgctctgttgcccatgctggagtgcagtagcacaatcatagctcagtgtagcctccaacccctgggctcaagcaatcctctcaccccagcctcccaagtagctggacctacaggagtgtgccaccatacctggctaagttttttaaaaaattttgtatagctggacacaatggctcacacctgcaatcccagctctttggaaggctgaggagggaggatcacttgagcctaagagtttgggaccagcctgggcaatatagcaataccctatctctacaaaaaatttaaagattagccgggtgtggtgatgtgtgcctggagtgccaactacttggaggccgaggtgagaggatcgcttgggcccagacggtcgtggctgcagtgagctatgatcacgctgctgcactccagcctgggctacagaatgagattatgaatgaatgaatgaatgaatgaatgaatgaatgaatgaataaataaaatttttgtagagacagggtctcactatgttgcctgggatggtcccaatctcctaggctcaagcaatcctcccaccctggccctgttttaaagagggtgaagtaaccagattcaaataggagtcatttttgtcatttctcatcccaggtagctgctgggaggaggtatgagggggtagtggggaagagcctcagaagagccttggcaacactttctgggctggaaattgttttactgactttcttcattataaaatgaagtattttacattcagcctcataatgatgaatgttcacatcttgtatacgtggtcttcagcaagatattccaataggtcagcctcaggaacaccagattaagtgtctgtgaggagaaatggcatagggacctcatttaataattaggaatgctgctgcttttagtaggaaattcattttcatacttaagttcattcagacttcagggacacattgtggggctattgaaaatataaatgccatccacgacaatcatagacacttagtagacattaagtaatttctgtggtaaaaaaaaaaaaaaatgagctgatggcaacaagttcaattctaagtctacaaatgtgcaggttctctaagcaaacaggatgtttttttccaacattcccttggagcctgggttccaaaagaaatcctttgcactctgaccaatgggtccttttccctgcacatcttccttgggaattatggccttaaatactacagaaaccaaaaaaaaaaaaaaaagaaagaaagattaaagctagaatatgtaaacacattttaatgactttttcctggttaacaaagtaatacatgattcctgtaggaaatttagaaaatccaaaacagaaaataaaaatcacccataaacatatcacctggaaatagacttttatgtttttcctcatctccttttttcctcctgtctttcctccttttctttatccctctctgtcacaattgtaacaaattaagagaatattgaaaatataattttgtatcctgttctttcacttagaattgtatgagcctataagtaagtcatgaaacccagaagctgtgaaggaaagattgataactggactatatcaaaacaaaacttcaaccaggcgataatatttacaacccatagaaccaatataaaaaattattactatcccataatatgagcttcttaaaaaaatcaaaaagataaacaactcaagtttttaaatggttaaaccatgtgaataggcaagaaaaaattcaaatggccattaaacatatattcttcttaaagcttaatctcattaatagtcaagaaatgaagttgaaacaatgagctcatttttcactggcggtttggcaagaattagaaggatgattccatctagcctgaacaaggaagccaaaacattgacactttcatgtgctactggtgggaatataaattgatgcaacccttttggaaaacagtttctctacatctgtttaaatttaaaatatttatgccctttgatatggcatttctacttctaaaaaaatgtatcctaaataaacactcccacaagtgtgcaaatcatgttcattactccattgtttgaagttgcaaaaaatttaaaacaacccaaatgtttatgtagaggaactggttaaattgtggtagatttttatagtggaattgtatgcaaccattatagagaatgagccagaggcataggagatataaatatgtccaagacaattgttgagaaaagtattttactgtataatattgtgttagtgtagcattgagaagaaaagtttgaaagactgaacccatcatcattttctctatacctttttcaggaatgatcaattttatataatgaaaatattacttttataatcaaaaaaacattttcagataacatttaaaaattctattataaacatttccttacatttttagtccttcataaaaatttggcagctttcataagattctgtcatagaaataccattatttatttagccattccacggttgatacataatttagctttttttcaaattatatatgatgcagcaaccaatatctttgtaaaataagattcttaattttacactcacaagagtatcatatcacatagcagagattgagaatttaacctgaaaataatccattgggtgattctgaatgtacaagattgatgtttttctaatctttttattttattttattaattttttttttttaagatagagtttcactctgttgcccaggctggagtgcaatggtgtgatcatggctcactgcagccttgacctcccaggctcaagtgatcttcccgcttcggcctcccaaagggctgggattcaggcgtaagccactgtgcccggccttaatctttttaaagcttacctggactataggtggcccatatggaggcaaaagatttgggccccactctctaggcacacagctctgctaccctactctaagtataatttgtcactagtttttgtagtctcagtgtaaaaaagagcagagatcttggcctcaggagatcctcttcccaaggctcagtcccaggctctctccttatttcattccttctcctgaggtgaactcatccacacccaggtaatgactctcaaatttatagctccgaaccagccttccctttgacatctagccatgtgtattcagctgcttaaatatctccacctgtatgtctaaaaaaagtagctcaatctgtccaaaataaattctgtgatccagaacctgctgatgcctccttccctttatcctttacatccttccattgctaaatcccattgctttcccccagtagttcttgacacatctagttctctttaccttaccaccctccctataccaggccaccatcatttatctcctggatactctagtagcttcccaaatgatctcctcatgttcattctcaactcctctgatatggagtcctgtaaaatcgaaaatctaatgccatccctctcctgagtcagagttttccatggtttattgggctaaagactgaaatcctcactggcccctgcctcatctggtccctgctctctcctgtctccatgctctcttctctcgccacccaggactccaaccacactagtcttcatttcttgactgaaccccctcacctctgttccttccttctgaaattctccttaccctcactttcccttctttctgtctcttcacttggttaataatcttcacagctcagttcaaatgtcactttcctgggaaatcttcccccagtgctaggtcaggccatcccttgatctattcccatgttttctcctcattgcactcatcacagttgataattgtaaatttagttgtgtggtgatctgtctgcttctcccaccagacattaacccccttgtgggtagagatggtgccccctttgcttactattgtatcccaacatcctggcatatggccaggctcatggacaatactaaagaatggttgggtgggtgaagggatggatatctcgtgtcaggtgatgcatgaatggcactactgtctaactcacgatgaaaccaaatgttatgcttttgctaattcagtgacttttcaaaagtcttttgcccatttaatacaatccatcttgctttgaaaaaactttaagtataaacccaggcactcaaaacacaagccagtcctaagtagttttattctaaaattaagaccataacccacattcactcacttggcagatgcccccttttcacacttacctacatgctagttcctcctcctcagtggaaggcagcaaatgatctgcacatttgaccacttgagagatttgctgtgcactcccctatgcctgtatcctcaaggactctgtaaaatccattgaactctatgcacaagctaagaaaaaaaccttgctttgcagtatttcgattatgcatttcatagtaatatgcataaaacatccctctatcatagtgccatcttagaatatttattgattccctcaggtggttcttgtttcaattaaagtccttttgggaaacaatctatccgggggattggccggtgacactgctacatagaagggattgggcctggtgtagtaagtcacaagcccaggccttggaggtgagcagaagtaaatctgaatcctgattttacccctgtctagctatataatcttggggtagagcctacttcatagagttattttgaggataaaataagaatatagataaagcacttagcatttgatgaacattcagtatatgttaaccactgaagacactgttattcttgttattcacaaaagcttttttccaggttttctagacagacccacagactcaccacccccaaatgagcaacagacaaatggcagtatgctgacaatcataaattgactgtgtattttatgataatgggtatcaaagttgtactctattaaagaattattatctttgagattcagatattaaaatgtgtatagatgaaatagctcatatcctggatttgtttcaaaataatctgataaaagatggatcagggagggagggagtcgatgtagcgagggagcatgtttggacgtgcattggcaggtgccgaggctgtgtgatcagtatgggagttgtgtcattctccctacttttgtctgttttgaaatttcccataataaaagttgaaaaatatgttaaaaatagttcatataaatagcctcctagattcattcttgttcaaggagccagctctcaactcgctttcctttatttcttttggaagagtaactgattctagtgatctaagcagtaagactcatgtcaatctgttttattactctcaggatagcttatggtggaaacaaaataaatccaatttctgaatctcctttgtcttcaatcacttgggaattctctctgaaactactgtgggcattttaagtaaccctgattacccagcaagaacaatgtagctttcagacaagcacagaggatagaataactctttctacccttctatgcttgcatgacaaaagctgtagctattaaataccggtgctcaatgagctaatgaatggcaagccggtaactgtggttttggcattttagtatttgagcctctgccctgtatgaacttgtaatcttcattgtgtagccttgttaagttcagctgctgagttacatgttggcataggaagctgaggtactcctaagccaaaaactgacctctgcatatttcaaactaaagtcaggaggcttagggtgacttcttttgctttaaaaaaaataaaggcatgatttccctttagagtggaagctgaccatgactgtaaatggctctataatctttggctttgtttgagtcaccctctccatgttctgctcttccgtttggatgcaagccaacacgaggataagtgttctgcttggtcctcgttgtttaataattgacccttcaaaaccactttctttctccagcttcatcaaagagaagaatttaaattttgatttcaggtttcttcttttccctcttgagtctatctttaaggggtaaaacatgtggctttttataagtttaagtactttggagcaaagtttatggagtgtccttccatcccctaaaaataagataggctctgagttggccagggcagtcccattggggtccatctgaaatgcttctgtttatccctttggtcagcacctcctgccaggaccatgctggagctgctaagaaggaagagaggtgcacagacagagccttctggaatacagtgcggggtatgctatcatagaagtataaactgggcaccctaggagcagagttgatattgctatgactgtctggggacatcaggacagacttcatagagcaggtatgagatacttgggctgagggcagcactggtagcctggaattacattatgctcttaattgaaccctcttgggatcccagtttgagtgatctgtcttattaaatagcacttggtatgagaacagccatggcgtttcctttacagctcatacagttctgagaatgcctaaaattagattgaaatcaggattaaggtgtctaacctgcctttgtggcctcgggcatcctgtgaccaggatgagtcacatccctgtcttgcccacttgcgtcttctgagagctgcgtcccaagacttccccatgcagagctgattgtaatagttgactgacaaaactgatggcccagcactttctctccctgcgcgattcctgctgcccatgacagcagctgagtaataagcagtcagacctcttacctgggacattagtcacaagctcttaagcaactgcgggtcagcgcttgagaccgttttggatttctgttagcacttgtttctgttgcccaagaagatcctttccaagacttcagcaggcatactggcttcgggaaaattcagaaactcagtgaccttgtttggaaatgtgagtgatagtgttctgggctcaggtccacacaggcctggcttgtcaggctaggacacagtgtcgataaagctgggctcatgggctttgtccccccggccgtgctctctcctggggctgcagactagtgtgtctaacctcagccaggcgcctctctactgtgtgcccgcagtcccagaggagccaggcacccaggccttatagtgcctcccaagtcagaaaacacttgtggaagaactgagagtggtggcctccttcactgggcaggaccacgatcatcctcacccctgctcccgtcctgcgctgctacgattgcaaccttttgtaggttaaactggctgtgctcatattgtatttatgtggtggggccaggggaggaagcagcttccacaaatcagcccactgaaaacagtcacttatatgggacatgggattctgcgtggagaagggctgatttggagccaggactgggtttgggttagagacacagaaagcttgcttcgctgaagtgggtgcacaggtactcagcatgcctttgccttatgcccctgacacccggggaggctgctactaagagcagagaagtctgttctatgttccattgatctgtgccatgaaagctttgctgctttaaccacacttattggggattcctggaataccagacttggtttccattcctgggcattttctagtggccattttctgtaagacctgtatggccaggctgtatcaactcacaggacaccgtgtggaaaccagtcatgccagttctgtcatcacctacctcctccaagccagcaacgtgatccaggctggacagagaccaaccttttgccttgggccatgcaggccaacagaccttgattctcacactgaggcaagaaaatagaacctcgagtgccctgacacaacccacagtgaatatggcactccagaaagagcagtcagctgcagccactgaggagacgccacagcgaggggggctccaggcggcccaaggccatggcagcctcccacaatggcagttaaccacaaagctccaggccacctagcatcccccccgtgacctgcagcctccttgtcactgatcagcctatgtgggttgcctctgagcatattgttcctttaaaaaccaaagtgtaaatgtctcacccaaaaggccaagctgttgctctgtccagtctagactgtgcctgtgaggctagcaatgccaccctccctctgtaacagtgccctggggtatgggtggcaacaggacaaccaggtgcttgtgctgggaagcgggtttttttaagagagcactgccttttatttacagacagctttatcagtacatggccatgttcctgccgaccttgaggactctttaccaaacaatcctgctgctgaatattcacttccttccacatgaatttgctcttagggattggaggaggggtggaaatgctttcaaccagtctccataatctactaggcttcttgtgcacctggggtacccacaaacaaaccctgttctcactctggttttccttttcctgattaacatccccacaaacctactggatttaagacaaacccagaagtcatcatttctgctgcttctctctatccgtctatctctaagtgattatcaagccttattactgattttgctttcaccgaagccctgcttcctttcccctgactaactccttattttccattccattcatcactgtcctggttcaggtcttaacatctcttccctggacggtttcagcctcccccaactgatcttttcttgtccagccaggaatctgttactcccttaatgagggagcatcaatgagttccttttgcctaatatgtaaaaatcaaaattccttcgtgtgacattcaggacccttcatggtttgaaggacttaactttcctctgtagccctgagatttttcatggccccagcactcctctgtcctgtgctgcccgcccctcagcctcctccaccatacccagggttctctgagtccacctgcacagccatactgctgggcttgctgccgtgtccctgccccatccgcctgtccatggcggccttctcactcccccttctctgcctgggagactctgactcatgctatcagacccagctcaatttctgcttctgctgtgaggctgtctctctctcctcccactagaaggaattgttctctcttatgtttctctcgtagcacttggttcataccttcatcgtgccactaggatgatacagcaattggtgtgttccccctccccacccctcctggtctatcctgtccatgtgtgtgtgtgtgtctgtctgtatatgaaatatatatctatttgttttacacacacacacacacacacacacacacacacaaagtatttctttcttctcttttcattttagagacagggtctcaccctgtcgcccaggctggagttcagtgatgcactctcagctcactgcagcctcaacctcctgggctcaagtaatcctcccacctcagcctcccaagtatgtgggactacaggtgcatgccaccatgcccaactaatttttgtatttttcgtaggttgggatgttgcccatgttgtccaggctagtttcaaactcctgaactcaagcaatctgcctgcctcagcctcccaaagtgttgggattacaggcacccagccgacaagtatttcttaagtacattatgccaggcataatggcgccaggcataatggtgaaccgcataaacacaatccccgccgtcatggagcttctagcctagcaaatatttgtctcccattacactgtgagttccttgcagatgaagatcagctgtactcctagtgcctgtcaccaccccgggcacacagtggccacctcccctatgggtgttcattctgactctgatgggtagagatgggtgctagagtggaggatggggtataggctgagtatgaggtaagtggaaagcctagaaaagccacattctgccctccgtttttacaggacagcctacattttcctgtggtcagcccattcttaatgggcgcatcatcttggagccatgaggcaagttctgagacttgatctaaatgtgtcatccagatagcacagagaagtttgttccttttgacgtgtgtacaggaagctcatgcggccgcatgtggccgcacgtgtgtgtgtgtgtgtgtgtgtgtgtgtgtgtgtgtgtgcccattctgagaggtggatggtttggggtctggctgccctatctcgtgctgctctttgtatctttcagagatctgaaactggacaatgtcctgttggaccacgagggtcactgtaaactggcagacttcggaatgtgcaaggaggggatttgcaatggtgtcaccacggccacattctgtggcacgccagactatatcgctccagaggtgagtgcagctgcttgatgcagctctgaaatctgagctctccagtaactctgaccagaaatgccactggctgcttttatgcactgcagctttggaggcagcattgaaaggtgtctagagccgacacctctagactcatttatggctcattgggtgaatgatggctgaaaatggcctaagtccctctaataagaatttgagttaaaaaagaaaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccatgaaaaatggtgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtgtgggggggggggagggatagcattgggagatatacctaatgctagatgacgagttagtgggtgcagcgcaccagcatggcacatgtatacatatgtaactaacctgcacaatgtgcgcatgtaccctaaaacttaaagtataataaaaaaaaatatatatatatatgtaaactttgcagttgctttgggctttagccctaaatgaagacaaagtgtacgccattcatggctatttattttcctttttgtctctacttagtgatttaatttcagcgtcatttagcagaactaaagaaaggctcttgaatccttgaatccttcccgtatgagtgagtgaacccagtccccttttttttccagactgatatatttccagaaccctttctgtttgggatctgcacgagcccatcacagtggcccaatcaggccataaatatttgctcacctagatgagaaggcacctctgagttgaccacagggaaaacagaccactctgtagaaatggaatgaaatacgcttgctagcacaggagactttttaaaaaaaactttgatatttcctaatgcatcaatttccctagttatgaagaacacatttgttaatctgatgtatgaaccaccttctcacgctgccccctttgcacagatcctccaggaaatgctgtacgggcctgcagtagactggtgggcaatgggcgtgttgctctatgagatgctctgtggtcacgcgccttttgaggcagagaatgaagatgacctctttgaggccatactgaatgatgaggtggtctaccctacctggctccatgaagatgccacagggatcctaaaatctgtaagtttggcttacccagctagcttctgatgtattgcaaaccagcttgtttcatgtgctgcttgagtcttttcagtacctcccaccagtaaaccactagctctaactaaaatttgtattgttctaatctaaagaatcaaagaaccagagttctgtcaggctgttaccctctcttatgcaatagaccctctcttatgcagtagttattttggggtcagtttcaatagcccttgataactttgtttgccaaatagcaagtatttctagcacttcgtaactttagttgagggcaggtgatgtttccccttcatacagtcaggccacaccagagttttgggtcaagtaaatgccattcccagcctgttattatatcaattgtgtttctgttggcatcttcaagttgcaggatgaagcggtcgggtctttctcttagggctgggagaggagaaggaaggttttccaaacctctgcagatctattttgcctccatgttattcttatgaaagccgggtgccacgcccaggctgcaggtgcaatgttgtaatggatcatgttgagaaagtcttttctgtgtgtgcatttaaggcactgtgctggatgcctttgaattgaggataaacatgtactggacgcctttatgttgaaaataaagtacatgtaatttgggtcagttctgtaaccacattagttgagctccaaaatcatgtattttcacctactatatgcagaggggttgtaaaggcaaataaaagatcagtttttcaagaagggataaatcagaacaatctatattctgttggatagtatctatggcataagaattactatctttaagttatatcctttcagtaatttgagacaaaagcaaaatgtgggaaatatttgctatcttgttgaaagacttgtttctctttagaaacttctagccctataatcagtgccatttcagggacattttttatgtgggtcactgtgtactggggctgaaggcttgattgtccctgagaattctctacatcgctaaaagagaaataatcacagaaatccttctgaggcaaatattaccaaagtgaatcataacacatagctcaatcctcaagctgaggtgtcagtaccctcctgaaactgagaaagcactaatttcacagaaataaaagcacagtactttgggattctaccaaatatctcctatctaacatgtttttgtaagaacagttcatttgttatattagtagaaattttagaggaaaccataaatatggcttttataattttatggaaaaaaaaagtcacagagaagggcttgtcttcgtggatttgtgccatgaagtttcttaacttcctgaagggaaatgtactcacctaggttggctgcagccaattttgataacataaaccatgataacacagcctcatcgtgctgcagacggaggtgtactttgcatgatcactttcctacttccatggcccagcacctggctttttgtaaaaaagcatgccagccttctgtggcctgcaacagccaccttcatcatactaatggttttccatgctccacatatttagtccaattactgtagctgatttagtagttttaatatttagatgaaggaccccacagttcataattcaaattaaaatactggttcaagccataaaaaaaatgcctgttatcagcattggtgtataaaggtcactaggcttggtaccatgaagggtaggaaataaaagtcagtctatgcctcaataaatttttatattctctaatataaacactggattagcaatccagatcagtgtttctctgatagataccctatgccttttgaatctaggtctagtagaaatcttaagaggccacatcaccatttgagttggacattcctaattttttgtctttacatttttagaagtcctcaacctcattctcgtgtttcagagtcctcttgagagaatgctttccaactaaatctgaaactaggtatcatccccttagcctagaacctaggacaagtactaagcaaggttaagattcctatggaatttttaagacttgtttctttttaaccgggtgagctcagttacttcaagctatatcttttatgtaaatatggatatttttggtaacgagcagatacactgtccagtaatagcctcatggtctttcctccaagaggaaacagcctctggtgcctaaggagaatcacatccagtggagactgagttgttctctctccttgcaggttcacttttgggaagctacaagtcccttcacttctctttatttcagctcctttctcatgccagctgctccactgatggaggcagcagctgcgattgttacatatcatgcgtctagcactcattttcctaaataacactcgacgctgtctctgggtatcttccacataggaaggagcaggggctctgggctcacagtgccgggcctgcctcccagtcctgttaccttctggctgagtggccttggtgagcctctgtgcctctctgaatctcagtgtccttgcttgtaaaatagaggtaataaaatccataccatagggtgattgtccagattatatgaaataatataggtaaacttcccgggcacataataagcattctgttttttcctccttcaaggcatgtaccttcaatgtaattttcttaaaaacacttaaatgttgtcagataaaattactaaaaaaaaaaaaaatcactaagaggatttctgggatttttttttttttgtgtgcattttactctccatgcctaaaaacaagaagcttaaatggtatagatgaaaacattcagctagtctttgcaggggactgagacatttaaatagaaatgtgatcaaagagaaaaaagaaatgttcagagcactcaagacttgaggagacacactgaggagggaaaggcatcagaattgggttggttaagaacctgcctccagagcagagctgcctgggggcagatcttggctctttgactaataggctgtgtgaccttgggcaaatggcataattcttgcatgccttagtttcctctccatttccttgggcaaatggcctaattcttccatgcctcagcaggtggggtgtacaacccacagggctactgcgtggttggcatgagataacatgtgtgggtgcctgaagcagtgcttggcacagggtacgtgcccaggaagtgtcctgcactattactgctgagagctgcatgcatgaaatgatttttttacactctgcccttatctctgaaaaagtatttgtcatattaggaggagggttcgagatagcaaggtgtgctatgccaaccactcaggctgctttctggctctaattgcaacttgatttaattaggccaatatagttattttactaccagaagaaaacttagagattgtcccttccaaccccctcgttttatagatgaggaaaccatgaggtactgagaaattgtgactcatcaaaggccatttaacacattacttaaatcaattggggcctttgtgcactgctgatgaggatgtaaaatggtgtggataatggtatggtgggaggttcttcagaaaattaagcagaattaccatatgatctagcacttctacttctggatatttacccaaaagaattgaaagtgggaactctaatagatatttgtacacccatgtccatagcagcattacgtacaatagcccgaaggtggaagcaacccatgtgtccatcaacagatgaatagataagtaagatgtggtacgtgcactctgaacaagcattcatttggctgcacagggccagatcaaggtatactgtgttctttaccaatattgacttgacgcctttttccagaattttgtgtccacctaagatcaggctttctgggagcttggtgacttcaagagttcctcatgtgaatagttgaatccattggatggtgttttgcatagttctaaaaacagtagggaaatcatgagtgctaagttttgaactgtaattatttgtctttgcccttaattttatagagctttgtgatcattagaagcataaacacagaattgtagagctggaaatagtttaaaaatattttgtccacatttcctcatctgtagatgaggaaacgggcccagagagatgaaggaactttacatgttagaatggaaagaacacaccctagacctcatgtgacttctgccactgattttcagtctataaaggtgtgataataacacctatagtgcccgcttcaaataaggcagtatacatgaaagtgttttccaagtggaatgcacgatacaagagtaagtgattagtattgctaacttgtgagtagtaatttcacaacacacttagagatgtcattatcctcatcttctccttgaacagttcagcaacatcatcaaggttattaagtgcttaattttacacaaggctgtggtaggcttttattcctaaggaaattgtatttttgtttttccaggagcttttaaatcttgaccaaagacatataggtggggtgtaaatagccaaatagatattgatctgtttatttatataataggcttatatcaatgcatatgtgcatagcaggcatgggttctgcaatactcaggttctgtgcgaggtgccaggaattcagtgatgagtgaggcaaacatgatcctgctcttgtggaatttacagtccagttggggtggggagggagaaagaaattttaaagagaaattaaacattaactatatacttacaatttaatgagaaaaaaataaaatccaaggttctttgaaagcatttatttaacaggcagatctaacatgacctgggccaccaaaggaggccatctggaggagatgacatttaataaaggctgaagagaaatgaggcttgaaagtgtgcagaggtcttgagaaaggagcagtccatttgagtagctcaatggcaggcgggttggagtgtgatgagcaaaggggtggggcagtgagagcttcaggtgaggaggctgagggaacagtgagagcccaaaggacatcctaggtcacgcgaaggagtctacactttatctgaagtgccaacgtaagtctttgaagaattccaagcaagcatgagtgatgcaatcactacttcatgtgtaaaagatcaccctggctattgtataaggagtggaccaacagactggagtatttgctgattaagtgacttctaggatttctttcaaattaatccaggagttgtggggaggaacagatgaaacaatattgggcatgtgtcagtaaccatcaaggctgagtgatgagtacatgagggtctgtgttactgtcgtctaaaatttccacatggaaaagttgttaaaaccaccatacaaatgaatatcttttataaacaagctcagcgtgtgtgtatgaagaaacatttctagcctgtatagaaaaagtgatctccatcttcacaaatgaagggaaatggtttacaatacaaatatacagaaagagcaaatgatgtgagccacatacaagctcccctgtggatcctggccacatctcttaaatccagtctcgggttcctggcctgggagtctatgtcaccctcatgattttttgccacagacaaaattaaccagtggttttagcacaactcatttcttcagcatacctgaagagtatctatgccttctcaagaagtgtccttcaacctccagggtagtaatgaagggtaccccaaagaagcatttttaacagaaaagagaccagagaaggagagaatcctcactgttggactttgccccatgctgcctccttgggaccctgggagatcctttcccggcctgctggatctgccctttccccctgagaggcaggaagagctgagatctccaagccagaccttcacagtgcctctctctacagtcttagtgtgggaggggcatctttccatggcttcctgagatggagatttatttaagaaggaaagcttgttgaattccctcttacctttttaaatgaaaggtattattattattctatatctggggaaactggtcagacacctgtttatgttacatgccatagagttacagatgttaaagacctcagggcttcatctggcgtgatgtcagcgagggcctacattcagggttggggagggtgtgtactgtccagcattcctctaaaagtgtgtgactggcaaggcaggctccagcatcttctgaccactaatctaatattactgtccccacaggccctccctgtcatcacctttaccactgccctctccacccgcaacacccccgaggttgtggacttgtgagttctttgtgtatagctgttcaaacatttcctatagacgtgggtagtggacaaaggacttgcttgtgagaacttttcccatggagtgcagaatcagtgggtgcgggggtagtttgagcacacttagtttttagcccaggatttctacttgaaaagaattccccaaatcattaaccagtaatcgcacatctaaaagtaactttatatgcacccaaataggcacactgggaagactatttttcttgcttccccttctgtctttctcatctttgcttcaaatgtttctgttcaatacttaacgtgtgcttgcctcaaaagcagcctgacctgcgactcgcagagaatggagtattcacactggcaggatcctcagaaattaacacaaaaaaggcatatgacgatgacacacacatttgtgtaaagaaaaaataaaaggcattccagctgttatttcttaattttttttaacttggtttgggaatatatactacctgttttctggtgtcaacatgccatcaggtttcttaggctgactaaatcatcccaaaatgctgataatgatgggacaaaagaaagtctatcatttttttagggcttctgaggttccactgagttttgccctcatctaggtccagaagggcttagggaagtcccaggcgagtcagcagagctcaggaagctgaatccttgtctcagaggttagtgctcctttgctgaatcatctccagcaagaaatcacgtgactcagggtctactcaggtgaagtcggcacccttgtctttgagctcacacaggtggctgagctaaataagtgctgaaaggagctgggtgcactctcctgagtcacctttgttgactctggaagcactgtaaacttggcatcagaaggagattataaagtgcttttgttcctaagctttataaagtgtgtgtgtatgcatgtgggtttctctgtcatccagcctctcagatttcatcatccgagcattgtctgcaggaatcctgtttgcctgtacgcacaaaggagggagaaccacagttaattcggggatcctcttttagccctgagtgtgtcccacatctgtcaccaggcagtgaattccaggagcattgactgtcttcctgttcatttccctactcccctcctgggagaggctggaatgttcaaggaagccagcaaaggtggtcagccaggagaaggctggggaagaggagggaaaaatgggacccgagtaacgcagaggatccaaccccagatcattagggctggtttttcaaacactgttaggggaaatccaaagaaagttatcaaaagatccttgagtaagaggagtggttaacatgcaacctggcagactgttgccaggactggaatacctgtctgaggaaaggaaggtgccccacaggcctcttaccaaaacccctagtgaggttaacacccttcagaaaaggaaccgtttgctcacagatcaaggccagtgtctgcagaaaacagaaaaacactgctcttcccagagattttgtatttgggtctttttaagtcatataattttactaaagttcttgatctctacttctttttccctcattaaattgtaagtttcctaaggttggaagtccttacattttgatagcagtgtaaaggattttttaaaatgtatttttaatagagtactcatgctgcatgtctcatttatctccatccctgccaggaagataaagatgtcaaagcttttgtaaaatgaccacggaaacttttcctgtgtggagatttgctaaccggtgtctgtgggtcagaaaagctttttgtttcgagttagaaaaactcttgtcaacaaaagtatttgactttgttgttttttgtttgtttgtccttgccaactatcaaaggtcagtaatttggggcagttgatcattagatttggtttggatgccaaagataatgcgcatccaggataaagaagggtactggccttgatttcatcagaggaggataaaggacattgtatagtccccactagagaatctttgtttagcactcacttctcttcagtagctacatttggggaatcatacctggaaaaaagtagttcgtatagcttgggcatgtagggtagcagcagctttttcttaacacttggaagtcattggagagcattgaaatccgccccatcagtcagagctgcttgagactggtttgtcaggaatagaagcatgttgtctaacaacgggcattggcacaactgcatgaccttgggtttccatctccgagacttgcctctaacctttacctacggttaatcaacattgtcccatgaccagaaagaagatacaaggaagcaataatgattataaaacccaggaaaggcagggtgttgggagccttggaaaggaattgagtatgtgcttatgaagggctgctggattccagtcacagacagcatggaaaacacagccagcaaacccaccacggatttgagcactgcccctgcccgctagaggaacagtatagggcatttagtgtactgagtttcatcgagagaaaataaagtacactgtgtagtgtgtctctggagatatcgcacagaatattctgatgctggtcagttacaacctgccaggtaaggcactgacccaccggcattctcaaatatacccacatgcccacttcctccatcactggctcagggagatcagcttgagcaagtttatttcactttatttttaataaagaaaagcccatttcagactcaaggaaaacaaagcatctgtagctgagggaaggacaatcttcaaaatgccagctttttttttttcctcccagagtttttagtgataaatgcaaaaatagaagaaagaaaagagtcccttgatatgggcacagactgtggaggccactggtgtggccacccacccacctgacgccggacaggccagtccggctctgcttcacgtgttttcaatgacacaatgctgttcctgccagggagcactctcatcacttaatggtactgagtattacaaccacattacgtgttttagtttttcttatgatgtatttagatatgctgcctttaaattccactccctgaacttatttctccctgaaattatttctcatctaatccctcttctggccgacagctctttgagtatttgaaaattttaagtgtccttctatcttttccagcaaaaagaccctcagtagtttgaaataaaaccaggtgtcaggctgaaggatgcctcggattttttccagccctattacttttctttcccttcacttaccacctgcactgtatgtacttctcagcccttctccttccatagaatcagaggaaaaagaatgtcacatgagccagcaaagaagtacaacacaaggaaacacacagagtgcgtgaattctcatcagatgaagtcctgagtgtcatttattaggtgaaagtaaagtaaactgtgtaatgattctcctcacctgtcggtccaagtatcttaacccagaatccaaataagaagattggtagcctcaaggggaagtctagcgtagggactgagagcaaaggcctgagttcaaatcctgactgtagcactcccaaactgtgtgacaggttacagatgggtctgtttctcagtttcctaatctttaaattaggaataataaccacagttgctttaaggattatatccaatgaatttggaacacttaatgcctatgcaacaaaggagtatgcagcatacatatatggcagtaatggctaccacttcttaagctgtaacttgtatcaaacggtatcattctctactctctccactcctgcagcttcccccttctcaaaccagtctggatacctggcagggtggtccattgccatgagtgtgcaggtaactagttccagccctccccagcaaattccatccagatccaatcttagcaggatagagcacctctccttctcttggctcgtccagtattccatagcagcaccattcggtataagaacctagacttgggaagattacagtttgtttccccagagagattcaggaagtctgttgtctgtcctttccaccctaccaagccccatcccacccccagtggactgtcatcagccccatcttgcatttaaatgtctgtcactgccttctcctatggaaaagtgacttatcaatgccaggtccaagcctggtgtctctcccatactgtgcagccacatccctgcatgaccactgccctgagctggagggtgctgctagcacagggtgtctccagatctccccaacagctggcaggaggggtataaaaggagaaggttggtcttcataactgggtcagaatctgcgtgtgccagcagcatccttcagacagacacgcgcctgcaacacgcatgcgtggtgtgcttctcgtcagccccaggtggccattagggtctatggtcatggcgaggttgggtgtcatggctgtgaaccgcactctattctgtgtcctgtgctctttctctgccctttctccccaggaccctctctagagccataaaatgccttttccccatttaggatcatcgctctggaatattggcaggaaggttctgtggcatagtttccttgccttctaacttgccagcattagctgctaactctctctctgccctttgtttaaggtctgaaattgaatgaatggagaaggtcattttgtttgcccaacagccacatccaaccattaggcagaaaatacagtgttctctggctcctggaagaaaatcttattagactaattgctttatttatataacttgtcctcttcctatgaaatcagacagattttgaaagaggaaaaaaatacttgtggccattacttatattttagtgagtaaagtacatttgggcccagttatttcaagactcataatgacacagcgttaaactctataatctggaacatccaacaactcaaaactgaagctgcctcctgtgtgcccacaagatgtgataagcaccatacctgacaccagatttgcaaagaagctgctccactgcacccatcttgctgcatttagtttctctgtcctattgttaatgcagatatagttgcacattaaaacctattgtttgtaggccgggcgtggtggctcacacctgtaatcccagcactttgggaggccgaggcaggcggatcacttgaggtcaggagttcaaaaccaggctggccaacatggtgaaaccccgtctctactaaaaatacaaaaattagtcgggcgtggtggtgcacacctgtaatcccagctactcgggaggctgaggaaggagaattgcttgaacctgggagggggaggttgcagtgagccaaaattgtgcaccattgcactccagcctagacagcaagagcgagactccatatcaaaaaaaaacaaaacaaacaaaaaactattgtttgtattctcgttttaagattgtcttagaaaaggttttctgtcaggaaaaaaaaaaaagttttccaaatagggtttggtggtatgtgcctataatcccagctactcaggaggctgaggcaggaggatcacttgagcttaagagtttgagaccagcctgaacaacataggaagatcttatctcagaaattaaaaaaaagcaagaaaaaggaacattattttccaaagaccattcctcccactgcactactggagcctaggacagtgaaggcagaaagagatcttgttctctcttacctggctgtagaggaacagggagagccagatgagcctcagggtcaaggctgacctcagagtgtagtctctcagcagctttctatctgtgcccctgccttttagtagaacaggatggacttacaagtttggcatttgggtcccattagggacataagcaaataatggaagtattctgcaaaagaattatgctgccactgttcacagcggtgggaacagagtgtttagggacagtctattcgagcctaggacggcaacaagatgttcattaatactatcatttcttgagggctttctttatgccaggcgctttacgttaattctctcattgactcatcataactttttaaaatataggaaaatcttcatgttagagttgagaaatctaaggctcagagaagttaagaaatttgtccacagtcacacagtaactcagtggtgaaagaatgatacaaacacaagcagtgacactgcagagcctgaccagccctccatgtcagagaagctgttagttctttcagccttccctggcttgcaggaggcctcccaggacattcctatacaaacttggcccaaatcctttacatgtccccttagaactagcgtcaggagggagcatgcctgcttgctttcccctgcagccacacctcctctgtagtctgggaaaaaaactgttaagtgtctcattctcggggccaggtgtgcctctgattccttgagtatcctctagttcagttccactgtaatgagggccacagcaggaaggggaacataaaatgagtccctgagttcttgacccttctctttcccctgctctccagtcagtttgagacttacacttggggtagaatccagattttccaccctggtcccctcactcactctgtgcagcttataaagtgcttttcttggccctagaaaacattctgcttcctttagtaaatgtgtgcagaatatttcatgaagtcacattattttcctctttggccgactttccctcttggatcacagtcagggagaaagtcagctgaggtgaggcaacttttcagtgtgaccttaaatgtggatgaaagtgatggccccgaggagcacaattgttaacttactggcatttgggtcccattagggacataagcaaataatgaaagttttctgcaaaaggattatgctgtcaccattcacagcagtaggaacagagagtttagggaaaggcctgtgcccagcctaggatggcaagctatccacctccaactccacaccatctgcaccaacgtgaactgtgaaagatttcaggcctgggactaatgttaaatgttcccttaactcctcatctccacatcactggacgggggtagtggtagaagggccaccccaccaccaccacaacacacaaagcttctacccccttagtatcaccccggaccctccttctcccggtcctggtttctgtttcatggtattcatcctcctctggcctcttcatggcatcctccagctgccactctggctgcttctcaccctacgccaggggtcaggagccatgaaagtccgtgagtgataccagccaggtgggaggtgatagggagtggtggggcatgtgactgactgggcatctggtgccccatgaaaagcagaagcccctgctcaactccaggccgtttctatgagaggagtgcaggcccagtgttcccgagtatctcattttccacgagaagttggaaaacctgacttttcatgtgatgtgacatttcctagcgtttaaatatttgagaagtaattaaaattatttcaaaacacactaggtaggccaaataaaatgtgtctgagacctagggctggtatcagttctagtctgtctctgtcactttccacaatctaacctgccctcccagcttcagtggttactcaaatttcaatgtctctgagcgttagatggccagccctggcctgcaccccagatttaccctagaattcatctgcatgtgggtgcccacacacctccaatgcaaagcggagcccatcagcctcccagatttggcagactgtaggatctcagtaagtgtgagctatttttgtctttgttccactaacaaaaatactactactactaacactgctactaatactcatgctacaaagaataatctcttgcccctcttttgttccatttctgttactcaacaccactgccccatcaggcagccagggaggaccctgtgatcttggactcttcactcccattcccggcagttagtggattgtgtttattcttccacggccctctagaatgtgcttccaactcttccttccaattaactagaaactctcctagttgctgaacttgtcatgtgttctcagctattgtctcagcctctaactgctcaccaccaggcgctacctctgcatttaagatttattcatcacgctgtggctagtgtcatcccctaaattgccgtgcagctctcatcactcacctcggatggatcccaccggctgccccccgcagttcctcagccatccctgcatgccagctgtaccaggcacttgtatgcctctgcatttgtgctggctgtgtcctcaggcgcattttcttccttcatgcctactatgttaattctgttcgtcctcatctctggtcaaatgccacctcttccacgaggctgtcacttgccttcccaccaccagccccagtgttatttgccccgtgcctcttccaagctctcacagcacttgatctaagtctcttttcatttcatccggctgtgtattatgaagtttgcttgattcttcccccttctcttgattagctcctggatgaagagacactgtctttgtcatctgcgtatccccaagaaacccctagtgtgctgccttacatgtagtagacaccttgaaaacctttgtcaattgaatcaaagtttgtttgtgtgtgtgtgtgttttgttttttcttttggtttgttttttttgtaagttgaggatggctgcatctaaagggctcaggccaaggtattaaaaacaaaactgcttggttattcaaaaggatttatcagaaccccaagaggctaagtatcaagctagtgaaagggttattctgcctgtccccaattccaagggtgcagtttttagaggacggacggtcgtgtttggtctacttgtcgtcaggcaaggcctcttccacagtgccccatggaagcttgggttcagtgccaggggcagggaggaatgggcaagcctcttggacactggggcttcagccaccctggcatatagagtcctgcactgtttgtcttgcccagaagaacaggctgtacccacccattcacaagatgtcctctctcacatcattggcaggcctgggaatttcccacaggccatctgggtgtgttctgccgtcctgtctcccaagttttttgcagcattgtttcttgttaattagctcttagaatagcaactgctcttccatcaggaattgtatcccgttgactttcctaaggcaagaatctactcatttcttttttgtaagcattttcccccttcctgcctgcattgcacaggcttacttagtgagagcccaagcagtgtgaactaactcctagctcttacagaactgagttacttataatatgcatctcctgaatcctgggtgaccactgtaagtgcctgaagtggcagctgctctgactgggcctgtgcagctctgaatgctgcatttacttttgggtcctgcctccaacccagaaccacctgtggcctttaattcctgttactaggagagaggagaagcgattaaaccctgtcagtatattcatttattagctgccctttgaagcttttttgaaagcattttacaaggtatatcccgtcaggttgcttaggaacttttgcagcctccttcttcaacattatcattttcatttgaatcaacactggcagcttgacacctctggacacctggcatggcagtgggaggtacctccaaacactgtctttccgtgtctgcaccttcaacaagattttctctgtaaattcagctccaaaacaatttttataaacacagcattacttttgtgttgttcacaaatcagatttggaaagaggtgcttggggactgtcatgagtctatttaaagataacctgatttaaataaaaacaaaaacaaaactttttatccaaggcaattttctttcaatatgggaaattaaattagcttcagtgtctttgaaattgagaaccacactccggccatgaaaagtgaattatcctgtactaatccttgctcaggaagtgatcaaaacacctttcctggctattttgtgaaagcagatttagcccagcatattttgataggagcccagcactaaggaagtttcccaactgatggaaatacagagaatctctatgcacacatcgcttagctgtgtggcagcgctcgttttagtttttggtctatggagcaatggaatctcagtcattgaacctacttcgaaacagcagtggtggggggaacatcttgaagaaaagcctttcatctagagctatgatatcttcgctgcataaagaaaagtggccaactttgttttttctagagccaggacacagaccttttcagtatgtcacctttgctgcttcttcacacagatcttcaaaaataacgactctctctcctctctgtggtctcgtcagagagcaggaatcctggccagctggtcaggtcactcagaaaaatggcacagctgtttctgaaagtagccccattcataagatgtctgctgcccacaactgcagtgttggggaaaggcacactgttataaagagcttcttttctttaaagaggaaagaaaaatacatggtgtttacagaaaagaaaactggaccctcctgctttcttttagtggccatgtctgaaatggaagtgggaaaagccataaatccacacaggcaatcgcgcctataaggcatgattcatactgactgtgctgcctgtgatggaaaacccagctagttaagcaagacctgccagaaagtctcgcacagctcctctgccatggctgatgcctgctgtcttgtgacgtgctggttgtatgtgaatgaatgattgacactttctctctctctcactcagttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcgtaagtgtcccaggctgtcacagagacattcctttcttcagatgtcacagcattccaccaaagtccgtagaagagctggatggcccctgtgggtgacagaccagaaattcagctggatactgcacagggcagcctcccctggggggaatctgggctccttgtccatgggacaacaatgtcttcatgtgcccacattaattcttaccaagtttcacccctcgtttacccaatctccaacttctctcaacctaaattaaaatcttgtagggtataagaggcctgaaactttccaggtttccccaaaagagtttggctaattgagaaagtcattgttctggccaatttcctcatgctccttggggcactttttgtgccttttctaagcccctgagaaagcagagtgggtaggagatgttgctcacttcactgagcctggcctcttggcttggagagcctgggtctgtaatagctgctgcagtgcagagcccaggccaggccaggcttctttgaccaaagaaatactgggatctccaggggctcctctccaagctctgcagctgaggctggtggccttcctgagcgtggtcccgcttgtggtctgagagctgagctcgtgctcatctgtgggtcaagagctccacaggaggaaggcagagaagcaaggctagcgatagatcaagagtgatggggagacctggcgtggtggctcatgcctataatcccagcactttgggaggccgaggcagatggatcacttgaggtcaggagtttgagactagcctggccaacatggcaaaaccccatctctactaaaaatacaaaaaaaaaaagcctggtgtggtgatgcacacctctaatccctgctactcaggaggctgaagtagaaggattgcttgaacctaggaggtggagattgcagtgagccgagattgcgtcatgcgctccagcctgggcaactgagttagactttgtctcaaaaaaaaaaaaaaaaaaagtgatagagaaatatcattgattaaggtaagagcagtgagatgtgtgatactcacttagaaatgatctttgcagcgtttgtttatacagatataaaatactcaacttttaaaaacatacagtgcacttaatcactaacagcctactaggctgttggacaccaggcacccagaggtaaagccgttccttcaatggtcagccccctgccagcgcccctgggattagggagagcatggccttcagaggctggagcctgtagtcctaactgcacagctggtccagcagggcgtaacgcatctacctagagagtaaaatgaccaacagttgttccctaagctcagcacttgcaagaaatcttttgggaagatctcttcaaatgtctagaactctgcgcaaacaataggtaggacaagtgtgaacctacccaacctctgttgacaaatacagctgcacacccctcagcgaggcctgctgtgaaatgccaccttggtgaaatgagaataaagggtgagtgagccagctgcttttggatgaccaaattaattcttagcctcccattaagacaggcctgctcagcaagattttcatgggattagtgaattggtggttgccaaatgccataataatgcaccatgcagtagacttgctgtaaagcacagtttcatcataacaataactgtaaataatgctactgaacaagctacagagcactcctctgaactcactggaatgggctatatcccatgcaagatgagtaagcctcaagcgcaaaaatctcacccttgtttcccttttttttttggcagaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaggaagtgttttgactagaatgatttgtctccttcccactaagacagtagatttccaatcaaaataaaaccttgagcagaatgggtagaactcaactcacagaaaattcctgagaggagaggttgatgtaagttcttctgtgattctctgaagtagatgtggcctgtctcttactgaccaaaacttctgtcctgaatgagggtgatgactgctaagcatagctgtaacagaccaaccctcaagatctcaggggctagacaccataaatgtttatttctcattcacataaagtagcatgtaagttcaacaatcttcctccatcttataactacactatctggaaaatgtagctttccaaagtctccagagcaaggaagagacatggagggggcgccggctgcctgcctgcctctcctaggagggacacacctcacctcttctcacaatgactggctaaaacatggcttccctctaactacagacgggataggggaattatagagcagctgaggagtagctggctagtactgacagtctcttctctgtcataggttcttttttttgcattccaatgcgaacacttacttttgaatgaataaagtagctaggaacttccctttccatttgtgtagcacttaccactcatagtcatcactctcacccacatcatgccactagatcttcatgacgtgcccactattcccactgatgatagtgtgagtactgcagtacatactacaaatggcaagagaggctcagagaagttgagttcattggtttcccaaagggttcaggcttggtaaagagtagatccagctctagggtctaaatctttgatgctgtagtctgggaaagggaaggatcattctgactttgggacttttttggccttcatagctcctccactttgggtcttctattgctctgtgggattgattaactttttgttatggttcactccactctggtaaacaaccacgaaaaataaagcatgcctcctgtttcattcacaaaactcattatcatagcc

SEQ ID NO: 13478 - DNA, 8279 bp, Human
agaggaccagcgccagcagcatgacgcccagaggggaggagcaagagacacccgtgggctcccacattcatcctgtggctgctgctccctctcctgacacccccactgcctgccaatgggtctcactgcaccttccacccggccccacccacagttaccatgagactccagatcgttcccttccctgctcacactccctccaggagcttcctcttcctggagcaggcatgcccagccccgcctcagggcctttgcactggcccttcccgctgcctggggctgtttcctgtctaggcagggcttctcacctttccagtctcatagagtcctccctgaccaggtccagtggcatcatctctctctatcccatactctcacttccaacagagagactaatttcctgatattaattattgatcactattcgccatcctcccacacaccctaatgctgggctgtgcagtgccacagccaccagccacatgtggccacagggtgcttgaaatggggccagtacaattgacacccacatacacagggaatttcaaagactcagtacacacacccaaaataaaataacctatgttattaatgattcttcttatgtgttgaaataatattttggatatattaggttaagtaagaaatattataaacattaccttcacctgtttcttttttactttttgaaatgtgtctcccagaaagttttaaattgctcctgggttcgtgtcacatttctgtctggcagcagccctgcaatgtagtgtccatggctcggtcacccaggctccgtctctagctcctagactacctggtgcagggggaagctggtgaaaagtctgtttactgaataataggagttgtgaaaggagaacccagagttttttactcaaataaaggttaattcttctgtttgaaaagttccctagcacagggcatggcctgagtctcctgcggcctctggaatcacacctctgccttagtgatttctagaccttgaccaaatgctcacggatactcaggacctccgaagactccggaaggccgagacctctatctttcccttttctgaggaaatgaagctagggggtcgtatgcttttagggcccagggggccttgacacctctctggagggcagggtgacctaagcttgggaggagggacaggtctttgggaagagatggagctgagggggtggagtgggtagaaggggggcataggtgtggaaggggtgggggaagaggggccaggagtggggtgagaagaggggaaagaagaggataggagggacagggacagggagaggccaggaatgggtaggaagggaagacagaggaggggcgggacgagggaggggcgatgaagaggggccgagctggggtgggggcgaagtgggagcaaggacaggagtggaggagggagatgaggggcatgggaggcggtgtctgggggttgaaaggggaaagggacagaggagaaggagcctgaagagtggcggcatggaggggcccgaagtggggaggtgggaatggtcggatggatggggaggaatggggaggataggagaggcaggggaggctggaagacagtaggagaggagggggaggggaggggaggggatggatgggaatggatagggaaggccagggagactggggggccaggggaggaggggagggagaggggaggcgggaagggagaggagaggccgggaggggctgggaggggagggaaggggatggatggggaaggacagggaagcctggaggggcaggggaggctgggatgggaggagactgatagggagggacctggaggcggggagaggcaggggaggcggggagaggcaggggaggcggggagggagaagggaggtgggagggacgaggcgttccggaaaagggagtgcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcaggtgcgtgccgccccccgcagggtccgaagccccggccccgccgtcccagcctccccccgcgctgctcccggaccccgtgctgctcctctccggcgcctgggcttctcacccggaccctgttcccggtcttcgctgtcacccccgagcccttggcgggcgtgtccgggaatgccctgagtctggcctggcctggaaccgcacggacacgtcaggtccgcgcccggcgcctaagatcagcttccaggagccagctcgagctgcgccgcagcgcgggggcaggcacaggacgtcccacacagctctgtcccgacctcctgggacgctgggctccgggtgcgctgctgaatacgcaggagaaggaaaaacagagcccctcatctggctgcctccttgttcttccaccaaataatttttaagcacttttgtttcttttaactttttattctcccgtaatttcagacttacagagcagctgcaaaatagcacagggcatccctgtagatctttcacccagatccctcagatgttagcacagatgttaacattttgccctgtttgttccccccagctcactttccgaatgtgaatatgggtgtgtgtatatgtactgtatatgcattttttgcctgaatcttttgaaagtaaacacttcagtgtgtttttcctaaaaacaagggcaatatcgcacataatcactattccattttgaaaatcagcactgacacattcatgatctaatgctcagactcattcagctttccctgtctgttgacggccttcgtgccctaggacgctcctgggccatgagtgcatgagttcagccctgtcctgtcccctcggcctcttttaacctgcagcagcagctgggtctgtgccacgaccgtgccatttcccagggtctagcaggtgtggatggagactatgctgactctgggtgggcttgatgctgctcaagatgagatctaggccatgcggctcatcctcctcccagaatactctccgcaggggccacacgtgagcctggcaccttgtcctgcagagccctgcttccctccccaagtcacacccctgggcacagtcccctaggactagcggccttcaccctcaggccggctgaccaccccctacatcccagggcagctgagtccctgctggggtggagcatgcctgaccctgcctctatcagctgatgcagagttagacctcagccagatgaagacacccagcagaccggagtagggggtcggatcgggagggagcttcagtagggctaccaggcccagcttgacctgcatcccatggcagagcagcgaacagtgacacagactttagagctcctccaccttctcttggaaattcagaggagtccagaccagccgcgtttctcccgcagccgtcagctggggccctctccctgcacaggagggccattccctggtgtagggtccccgctggcctgcacctctctctcactgggagtgaagcatggggcattgtagatcgttgggccctggagcctattttacagaggagcagactgacaccagagggatcacaggccttgcttgtgcttctacaggacttgtgtgtggttccacagggcaaggtctagcaccctggtcccagggtccctcatcccatgcttctccacagttctgacaagtcatgttttggggcggcactgtgcagggaaagcattcagttctcttctgaagttgcaaccctaagacatgcaggtgtgtgactcactttagaaatattgccttgaaaatcacacctggaatggaagcacgtgggaagcaatgtttattggcctaaaacatcaatgtatgtgagcatctcatctcctagtgagaaatgaggaaaaatacctctgggttaaatggcaggaatgagatgctctgtggactgaatgccaggaactggaagtttgccgaaatttcatcatcacatgagaaccttcctagaatagatccagtgtccctgccccctgggtcataggtagcggaattcagttaatccttggcattggcatagagaaacaagttactggggaggcctggggcatggcatccctgccagctggcaggaggaggtggcttgtgtgccttgcaggtgacaatgtgggcagctcatgaaggtaggcttgaagccccaggcaagcccagtgacccggtcacagtgaagtgcctgtgtgtgtaagaaactgacagaacgtgctgtccctgcctcctgctctttcacatgtgtagatcgtagctggggtgaactacttcttggacgtggagctgggccgaaccacgtgtaccaagacccagcccaacttggacaactgccccttccatgaccagccacatctgaaaagggtatgtgccttatatgggtccagggccagtcatacactgcagaggggtgtgtgtgtgtgtgtgtgtgtgtgatgcacatgttctgcagggtacgtgtgcatgtgcctgagtgtgtgtacacgtggagatgcatatgtgtttccaagtataggtttgtgtggggaagtgcacgtgagtgtgtgcaagtgggtgtgtggatgtgttggggaagtgtgggggtttatgcatggataggtgtgggtgtgtgagtatatgtgtgtgcacatatgtgtgggggtgtctgtgcacatacattcacatacatgggggtttctgtgaacatacatgctgtattatgaggaattacctgccctgtgtgtgtgtgtgcatgtgggtagatagatgtatgagggagtatgtggattcatgcatagatccgtatgggtgaaggttagggtgagttcatgtagatgcctatgtgtgtgcatgtagacggggtggtgtggagaggagtgatgaatttgatttgctaagagggctttagcttgggattggggtactgggagctccaccctatgtgctttggagtgttgcctactggactgcaggaagcagctgcagggctgggtgctgggcagggagaaagggctctgtctaatcccagccttaggcacctgcccacagccacggccatgctgagcagattagagggtagtagaggcctgttagcagccaaaccctcagacctgccccagctcacccaacaccagcttctccaaggacccaggatttcttgtgacgtctctgctcaggggagagccacactctccttgtcatctcctcaccaccccatgtgctatgacttggaatttccagttccctgggttcttccctctcgcccttcatagtgctggcctgagggctggaggtggaaggagctgggggcagtgagctgcctccccctgccctgtacccttagggctcccgaggccttgcacaggctgctcctcacagggctgtgctggggcaggaatcctgcaggctggggtgggggcccagtgccaccaggtagagttggagccctgggagagggatggagcagtcactgcccagtccagcggtgctctgggatcagcgggggtgggtggaggggtagataagggcccagtgtttcacctccatccttcttcactcccactctgatgtcccgtgcctgggcatcttctgctttgaactgtaacccacactgattgtcccctctgtttcctttcacagaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggctccctctgagttcttggctgtctggggatgtgcacacaggcagggtttccgcagttcctttatgaagcctccttgtcctgctggtgtgaagatgagaggagtacctgggagctgacgcggccacagcaaggccatcaggcaagctgctgctataggagtcctgagtctcagagcagggagagcagccaggggctgggaaacaaggcgttgagccacagcagcccctggtgagggggtcagggagaggaggggcccaagctgctgcccccagaagctgggctggtgatttggtctgagctgctggtcagaccaggaggagggagctggctgtgtccatagacaggggccaggcctcggtggagctcgccaggtcatagattccatctgtgcttgcagagttgagcagaccccagggactgagctgctctcatcaaatcccctagacactaaatagtgatcaatgcgtgcttctttccaagagacttaggcccctacgtggaaacaaagtccaaaaagcctgtctgtgtaactgagcaggagaaatgccagccagaccagagaccagcaagatcacagagaaagtggcacctgctgtcatccatcctgggaggctgtgtcctcccagagttttacaggctcatagccaccagccctttctctggacttggatttaaaacaagttgttagtccagcttcatggtagggatgaagttaaagcacaaatgagaccgacaatgcagtggactcttctttttccaaggaggattaagagagaacattcccttcatgtcagcattatcctatagaatagtggatctttgtgccacaagcaggaggctacagtcctaagacacagcccaccctgcacagtccttccctttgccattttaggacaggggtgcagcccttacagccagtgctgctggggcaggcctcccaggtaccttccaacctcggagctgcactgaccccctcttttggctgctgccatgaacactgaaggtgaaatgatgaaggaaaatccaccccagtagcgccaaggccagcaccccacatgctgtccctgcaaagtcagagcaggggacacggcagggagagtggggagcgtctgcttccttttcctctccaccctgacttgctttaacagggtctttggggtgagggaagtgtagcaccccctaggatgccatgagctgaggagatttgagtctgggcctcaccctgctgggggtgggtggtcttagtcactcagttttctgtggggggttgggggatagaagtggtggttgtggtcagtggtaaagggtccctgcagggaggtgctcctggttttctacctcggtgaaggatctttgacacaggcaacctccatccaggcacccagtggaaacggacagctgaccatatagcccagtgccttttctgacacacttcttccttggggaagttgaggttgggggcgggctgtgcacagggctccccagcctccctgtgtgtctgcttccttccctgccctccgcccggtggccccatggcccacagcccacagggaagcaagttggtgccacccctgcctcccctccgcagccggcgggcctgtaaatgcctcccttgggcccccatgaggccagtgagccagaagcccctctgacccagaggtcactgtgaccagcacatcctggagaggaggcctcgcccttgcacctttcatctgcaagagttacttttacatttattttaaatgttgatttaagtatatacttcatctacagttatccatataaatagattcattacagggcctggctctgaataaacacagtaagttggagaggctttttcattgatctggttctacactggtggctttataacatagtgctttgacacctcttgcattgtgttgctggtgaccattggggtgggatcaggaagggcccagtagcttctgagctccctagcattcttgtcctgaaggaagccagcctttgcagaagg

SEQ ID NO: 13479 - DNA, 7883 bp, Human
ttggagacgtgagtcttgctgaagttccctggccgaataaagcccttccttctttaacttggtttctgaggggttttgtctgcggcttgtcctgctacaaatagggggaataaaagccagggttgcttccaaagagagcagggagtgagtgttgaggacagatcatcacaactgtgcagttgaggagcatgatttgaacccaggtttgtctgttcattcaaacagtatttattgagcccttgctttgggtcaggcacaattttatatgctggagacacaaacctaaaaggaccctaacctaaaaggcagaccccacaaacctaaaaggcagaacagctgcctttcaaagctaaagtctcgcatttttaaaaggccttggagctgcattaatgttcttctaatttttctaggtatgaatcttcatacttttctaggtatgaatcgaccctgtgacaccaggatggttctttgtcagcctccttgtctataaaatcagaaataatggtacctcccccaataagttatgtgaaacaaattaaaggggcttattatacaggaaacaaaagcagcacagcatccaaactactgagcgtgcagtaaatcaacgcattcccacttccattccatccacgctgatttagatcaatccaagtatcactgccttggggttcaaaaggccatgttagttcacaaagccccgaaaatgctctttcacactctctgctcagcctccaacgtgtctttttaataatccaaactttccacctacttaactgaagtgtgtggggggagagggtgcgggggggaaggggtggcctatactaaatagcccaactgttttccacttgtcctgaaatctgagaccaagattctcttaggaatgcaagcaaagggagccgacgggacgccaagaaagcacaggttaaactacctcacttcatctagccccatttctctcctggcttttcaattaattattcagcctcagaccagcagatggagctgaaaatgttgtctaaagaaatgaggtttttcttttaatttacaagctatagtttctcatgcctccacactgaatggttacatcctgttgagcctgttcgtaaagttcagtaaaaatccagttctcattccagaacagctgaatcgtagctatgaacgcggaagaacagagtcccaaccccagccgggcccgggtttcccggggcccctcaagcctcagggcagtggagagccgccgtcacgcccccgcctcccccacgtcccaccctcgccccagtctcctcccacttttagctacttttcccatctgactaaaactggcttcctccgtgtccaccaagatgtcgcctctaagtggcctaactcctaaagagcgcgatcggctcaagcactccgccacgcggtttccacggggcgcggccggcgttgccctcgccgtggcctcaagcattgcggcgccccacatgttgccagacggaaggcctcggcggggtcaggcagctgctgctggccgtgactacatcactggtgacgtttcacgagacttttaactgaaatcactccaatacaggcgcatgcgggacgaggggaaagcatctcacccgaccccacacaccttcccctccctctccagcctagcggcctccgcgcagcggaaaaaaaagcagacgctactccccgctctaggtgcgggacctaagaggtttggcccaatcaggcatcccacctaaccagacgggccggagtctgtggcccggttggaccaacgaaaactctagggcggatttgccgggatttctgggaaagtgacactcccggaagctaccgcctcttataagccacacatgggcggagttagccttccggcccgcagtcccactggctgacttcgctgcccgtcacgggaatgcgggagagggcggcgccggggcgctcgcgtctgcgtggagaccggctggccgcgcgcgggaagccgcggaactgcgccggaaagtcccccggctctggggccccggtgacccagagtaagcctccaagaaggaggaggaggagagaaaggcggctcttcccgtgcccctaccagaggcttcggtgggcccaccttgtgacctccgcggccggcccctcagtggaactgcgtcccacgcggggggcgtcccgaccgtgggggccgcggcccgcgctgaccctggacgtcgccgcgcaggtacgttgccgtcccccggcggtctgacccccgagacagcccctagtgcataccccacgccctcctccattgtcgagaatgagacacggctgtgcctttgtccacgtggtagagttgccgccgcggtgaggctctcgcctgtgcaaaaagcgtggcagcgaattctcatcaacgaggggaggcgcgtcccctcacagcgcagctctcgggtctgaggagggccgggcagggcgtgcgtctgtctaggtttgaattaaaggcgactcacaggaaataaggccatgccactgtggtagcttttcccgtccatctccggacactcgacggtgtgggtcgtgcgaggaggcggcagtcttcacagcctcttactctagtcctcacggtcaggttctttttctgatttgacacagacagcgggactgacgacctcataggtagctgaaaaccgtaagtggagatggtccttctatggtgtgtgggggcgtggccagttgttagattgtgtttggaaagacagccaggggcggagaagaggggcatttctgagatgatggggggactggtgccatggagggaggaggagtgaggtggagatcgggaattccagccaaagagaaatggggtccctgggagaaaattcccactctagcagtcctggagttgtgctcatggagacttgcttacgcgagtacaaggacagcgttgtattgacaaaatttcagccctcagtctagtcttgtaaacgatagatcaggagtgtacttaaccgtcgttactttgatccagccctaggtttcccttttctcatttgtaaaattgttatagtaatacctttttcatccatttgtggtaacatttaaatgaggtaatttgtgtgaagcccttagcaaacacagcgcttcttagtcgtgggttccgcgtggggtggattcaaccaacctcaaatcaaaaatattcttcagaaaaagaaaaatgcgtttgtactgaacatgtagaggctttttttttcttgtcattatttcctaaactatacagtataacaactatttacatcccatctacattgtattaggtattataagttacctacagatgatgaaggtatataggaggatgctgcgcataggttatatcaaacagtacaccattttatcagggacttgagcatctgcaggtgttggtatcctcgggggtcctgaatccagttcctcacagataccgagggaccactgtactcagtccagagtacagttgaggcttaactatgaggtctgtggagggcgtggaaagacccacgtctgaaattggctcttaactgctcatttttaggacagcttccctcccagccagccctttaccagaggcaatgcaccatctttgcagccgttataagtacctggctctttccagccctatgtggaatgttttatttatttcataagctaatcattataaaaaaaaaagtcttttttttgaaatgaaaaaaaactgttcactaagtttgtaagtataaactattttagtaatgtcctctattttagtaatgtcctcttttttttaagtgaaatattttaattatggagaaaagaacataacagttgtacctgtaccctgaaaaaagtaaatgtcaattttttaaatgcttttggacttttttatttgggggacaatgtgacatttcagctatagttcatattctgtgtccacacacccaagagctttgaaatctaacatgcctttctgtggaggcactgtgactccacaggacttatctggtggatgttagtacctgtgtaagctgggtgtcctcccttctaatccccactcacccaagaggtttgctgcttctagcttatcatggggattatggctgccattttgattctgtcctcatgtcatttgtgtttctaccctcttaagaaacctgccttctctgccttcccagttcctcctgagtgagctcatgatagactttcctagactcagcagctgacgagcatttcattggtttggttggcctttattgggccagtgaccactcttcccttcaacatggtccactgtctttaccaaggggctgtcatgtctgttgcaagcattcaggaaagagtggccttccatactcaaatgtactctattttataaaatgtgattttaaaaattcgtggtccaatcaggcctccttatcctctgggaattgattccagcagcccccctagccccacaacagaccaaatctgctgatgctccaagtccttgatataaaatggcgttaaggccgggcatggtggctcatgcctgtaatcccagcactttggggggccgaggcaggcagatcacctgaggtcaggagtttgagaccagactggccaacatggcgaaaccctgtctctattaaaaatacaaaagttagccaggcgtggtggcgggcatctgtattcccagctacttgggaggctgaggcaagaaaatcgcttgaagctgggaggcaggtgttgcagtgagccgaggtcgcgccactgcactccagcctgggtgataaagtgagactgtcacaaaaacaaaatggcatagcacagtcagcccaacgtatttgcaggtttcgccctgaggttggctgaatctgtggatgcaaaaccctcagatatggagtgctgactataactaaatgtttttaaactaaacacttaaggtatactatctcagtttgccacagtggtaatcccatcttaacagtgagcaaactgagtcttagtaaaattaggcatttttaggcattgggtactatttgagcctacagtcattgttctgcagtctgtaactattttgccagtagtagaaaaggaggaatgttccattgtcagggcagaatgaactttggcattcacgtggcttctcttcaaccttacttccctgcagcccctggttccccaaggcagaggaaataccctggtggagccctccttccatagaaccagagatggcatctgtggatttcaagacctatgtggatcaggcctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctttccctgtctgatgtgtttgaccaggttgtgagggaggaggagggctaaaggcagaaagcataataggaagcacccgcacaggggtgaggatcagggcttagtacctaccccaggcaccagtgtgcacatagttggcccacctggagctgtgattcacagccccatgcacactagaatcccttgggacactgaaaattacctatgccaaggccatactccagacccaaccatgcttgagtgtgtgtgtgtgtgtgtgtgtgtgtgtgtgtgtgtgtgtgtgtgtggtggtgggtaggggggttggttttgttccaggctggagtgcagtggcataatcttggctcactgcaacctccatctcccgggttctaacaattctcgtgcctaagcctcctgagtagctgggattgcaggcacatgccaccacacccggctaattgtttgcctgaatctttgaggatacggctgggcatgggcagtttctaaaagcaccctaggtgtcttttaggatacatcaccttaggatatagcagaatcacctaacagatggctgggccctaccttagcaccttagctgagaattaaatgatgagaacagatgaaatactagagttagctaattgcttataaatgaagccactatattaaactcattgataaagagaaagtgaatcagcactgattctgagaggaagaagcactgaaactaggatggaggacatcagaaccagaagctgctgttactgatcctaaaggccaaacccaattgcatttcttcaatgtaaagaatagaaaaccctatagaagttggaccaatagatgatgtgcctgccatgctgcagcttccccagttaagttgtctttggtaaaagtgtgctaggtttgggatagggtagtcaagatactgcaatgggaaattttgagaagggtaagaatcctgataagcacagtgacacaggtagccgtttcctcttgacaccccttcccttctctattatctgaagcccagtgttttgagagataagggacccaccttaaatacttgactttctcattcaatttgtagctaggtctgacatgtgattaagttctggccaatgaagtaggactgaacttgggggaattttccttcaacagacccttctttctttcccactctatcctgctgcctggaaaggttatgctgacctgaccacgggctctggctcagtcttggccaagagaacagctcagccataccctagacgtaggatagtgctgagctaaaaggagcctaggtcccatgtggaaacaccaaaatagccccagctcactcaaccaaagacttctttttaaatgagaaatcccatcttaagccattatcaatttggggtgtgtgacactgacacacagcagtaatcctaagtgaggaaaaggatttgaatggggcagactgtattcactacagggcccagaagacgcggggacggccccaactactgcccttcaggtccgggccagacccgcaatgggcaggatgggtagggtacagggcgtgcgtccccacctacactagcctggttgcaggcggcctccaagggcacagcgggaagctccgcccttgccatgcccccgccaccggggaaggcaagacaaatgtgcgtggcaccctcctccttcggttctgggacacatctccaccaagcggccgttcggcaggtagggccagatggtcccggctcgtccctgcgggtggggtttcccaccggcggaaagcgcaagcccctcccgttctgtccagcgcgctgcccgctgccttaattataaggcagatgaaggtgaaaagtttactggtttttatttttgcaactttttgtaaattttaaattattctaaaaagtttaagaaatgaattgtgctgaggagtataatcagcacgcagtgcgagttcttatagtggccacgtccacaaaccctgtgttgtg

SEQ ID NO: 13480 - DNA, 11425 bp, Human
caaacctttcctcgattttggacagatgtgtatccggatgatgtgtctctgaatccttatacatcctcagacatgttttttgccctaacaagtgaattatatcttaatggggtatattgagttacagtgcttttcttctagtcaatagacgctagtctactctcttctagcttccagattgcagatagaaacttgctgggcacagtggctcatacttgtaatcctagcactttgggaggctgaggcaggaggattgcttgagtccaggagtttgagaccagcctgggcaacataatgagacccctacactacaaaaaagagagagagagaaagagggggtggggaaggagggaaggaaggaaggagggagggagggagagaaggaagccattttttttaaccaattgtgagtaacttattctttccacacttgttagaacctgaaattttataaaatataggcatgcatttttgttcttatgaatccatcctttagtgaatgttttcaatccgtataatctggtagaatttaggaaaactgtattcttttatttggttaactattgaatcttcttcatccattcctcttcctccttctaaaattccttttttttttttttttttgagacggagtctcactctgtcgtccaggctggagtgcagtggtgcgatctcggctcactgcaagctccccctcccgggttcacgccattctcctgcctcagcctcccgaatagctgggactacaggcgcccgccaccacgcccggctaattttttgtatttttagtagagacggggtttcaccgtgttagccaggatggtctcgatctcctgacctcgtgatccgcccgccttggcctcccaaagttctgggattacaggcgtgagccaccgcgcccggcctaaaattcctgttattctcatagcagggtctcctgaatttttccttaagtcccatcattttattatttccatctctataggcttttgctctgttgtgttaaagaaataattattcaatgatacttgttaaagcacattaaggaagactttatttagcaccatcgctacaggtttagggaccactgcaatgagttcttgcagtggaggagacaggttgggatcaactctgaatgcatcacggacaagtgggaatgtatagccaaggagcagtgtagggggtcagtggatggaaaattggtaagaggcatcaggggtaagggggattctatctaaactgacctaacaggattctcactgaagacaggccagggtggtcggatatcacttgggggatggtggaggatgagatattgagggtgatcagatgtcaaggatgggaggttcttactaaaacaggaatttacaaggagtgctacggatatgtagtggggggaggccagggatgctgctaaacatcctacgatgcacaggacgatctcctacaataacgaactagctagtccaaaatgtcaatagcgccgagattgagaaaccttcatgtagcttacggatacagcttttacccaatcgccagcatccttctcctggggctgaacctctcccccaggactgtcaggaggaggcgagtgataaggatcccaggactgcgttttgccttccttccccacccccactcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggagtaagtaactcatacgggcgccggggacccgggtcgggctgggggcttccaactcagagggagtgtgatttgcctgatcctcttcggcgttgtcctgctctgccgcatccagccctgtaccgccatcccacttcccgccgttcccatctgtgttccgggtgggatcggtctggaggcggccgaggacttcccaggcaggagctcggggcggaggccgggtccgcggcagaccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtcctgtcctgccctgccctgccctgtgtcctcagacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcaggtacccagggctcagccgcgccggggcgggcgggactccagagcctccctctcaacagcactcagtggacattgaccagacgtgaaggcgtgcaccgctccacacccagcaggcagctgcgctggggcttcccagacctaaacccagggcgccctctttgttcatgcaaaacaagggggagtacttgtaaagcagaatccaccccgagctaatccatagccactcaggcctccagatgagggcggaactaacattgttgtggggtgtgggcacacttactccccaggctaccctgttcgccatcttaattctacagataaggaaactgaagttcagtgaggttaagcagtacgcccaaggccgtgacactagcaatcagaagagctgggattcaagctgaggtctttgtggctccaaagacctcttaactctttccactctgagagtcccggagctgacagcgggcagtactcttaagaattttcttctgtctgatgctgatttactgacctgggccagctgcattggttggggtcattcagaaatgtgcatcagaatcccccggggcacaaaagaaacgtgatgggggcccaggcacgtgtactttgaaatactcctcaggtggttctgccacacactcctggttaagtccctctgctctacagcttctgaggactggggtgagtgagcacagagcctagcgcttgatgcatgggaaccatcgtcaaggttcctaatcccactactattatttcccgtctgggactcagtttctccatctgtaaagcaaggggttcagatgaggtaaatagctaaggactctaccagttataacatccactgatcatgtgacctccagtttatttgcataaaactaatggcctctcctttttcttctccttacttacaaaaacctgacttcattctgaaatttatttttgaaaaaaaaaagaggggatcttggaaggggggccaggggtagtgacatacagatttctgatcatgctcaccacttagtgcacttctttctctgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggtgaggaggcctccatgctcactccacacaatgtggctcaacaccttcataaatcagccaacttgaatcccagcaatcccccagggcactcccaggccttcctgtatcacctgtattgtcaggtcctcaaaccatgttagaagggtttaatgttgaggctgagaatcatggttagcagatagagggtctggataacactagataggaggcctatgtacatgttaacaccggacgcccagcagaagtcccagcttcttagaatcatactgagcttctctctggggtcccagtgcaacagaagggaccaattgactcatttattcctcctcaatcccacagaggccagtcaagaactcacataagggaatctaagaagacttggtccttgcctttagacagtgcagtgtaactgagaaggcaacatatgcataagatcagatgaccatagagtttagaaggatagccctgtctatgatagaagctggagatgagtaaagatggtgtggacaagggtagtcagaaggctttttggaaggctttgaagggtgggtagacttgtgaaggacataaggcatgccaaggtggcctaagaaagagtatcagccaggcaaggtggctcacacctataatcgtagcactttggaagacagatcacgagcccaggagttcaagatcagcctgggcaacatggcgaaaccctgtttctacaaaaaatacaaaaattaaccaggcatgatggtgcatgcctgttgtctcagttactcaggaggctgagttgggaggatcacctgagcccaggaaggtcaaggctgcagtgagccatgatcatgccactgcactccagcctgggcagtagagtgagactctgtctcaaagaaaaagaaagagtaggctgggcgtggtggctcacgcctgtaatcccagcactttgggcggctgaggtgggtggatcatgaggtcaggagatcgagaccatcctggctaacacggtgaaacttcatctctactaaaaatacaaaaaattagctgggcgtggtggtgggcacctgtagtcccagctactcaggaagctgaggcaagagaatggcatgaacgcagggggggtggggcagagcttgcagtgagccaagattgcgccactgcactccagcctgggtgacagagtgagactccgtctcaaaaaaaaaaaaaaaacagtatcaaggtgagaccagccactgcactcagtagtgaaggatgactattgtgatttgtgaaaaatgaggctggagccagatcatggtgtccttgaatatcaagctgtctggactcaatgcaaaagccaatggagaagcactttacattttgaggaggaagtaacataatgcaagtgccatcttaggaagaggagcctggtggctgtgtgttgcctggatcaggaagaccagctggaggccagtttcagactctagaaggactggctttcggtggtgaccatgggaatggtagttgttcttacttattcaggtgtaggtcagagatgtgcattttggtgttataggtaaaatagagattatggatgtggctgcttatagccctgtttcaaaaggctgttttccactttagccagaggcaataagacagaaaaggtcgtcaatatgctctttttctttctccaaagaacaagatggtttgtatttgagtcacagcgtcccacccccaccagcccacccccaccccaccaaataaaaaaggaaaagcaaaagattgatttggcatttggtgcaacggccaggtgatcttgatagaatatgcctgtgtggggaatgtgtagcagttgcaaagtaaagagaaccctgtactttctgtcacaggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtaaacaactgcttctacagttcagcaggaatttaagagatgattaaataaaagccccaccagtctcaaagttgccagtgctgtgtatcagtcttacctctgctaagtgcacaacagctgccctggccaaattctagtactatggtatttgaccactggagacaggcagtcatatttaaatctaagatggtttccatgtgcattcttgcaagagataagattcatccacactttagaccatgcagacttggtctggaattatccagcaccttttcttcccaaccagccattccacacttagttaacaggaggcttggaggcagagaccagtttggagccagccatggtagggttgggtggtagcaccctaaatgagtaagtagatgtgcacacctctgtattccaaagccagacgtgtctatttttggctcatccctttccgtttctctttcttttttttttttgagatggagtctcactctgtcactgaggatggcgtgcagtggcttgatctcggctcgctgcaacctccgcctcccaggttcaagtgattctccagccttagcctcctgagtagctgagatcacaggcgcaccaccacgcccagctaatttttgtatttttagtagagacgggctttcactatgttggccaggctggtctcgaactcctgacctcaggtgatccacctgcctcagcctcccaaagtactgggattacaggcatgagccaccatgcctggcctccattttttatgtgagtagaaaaggagagatgaaaccaaagctagaaagcctatgattccaataacctagtgcggacacttcctaacttctatgtgaacaactagcctaggttgggcctcctgtattctgttctcaatcgtgcctgggtgtcagtgggactgtacttattttggcatgacaggagacgctaggtcatggtgccccatttccctcttgctgtagctaggcctcataaatggtgaacttcatacatgctatcatagagttctgctatctaaactccatttacaacagttcttcaagcagtgtttctaattccaacctatagatttaccacttgcatctgtatttatatccataatccccaaatataccatggtatcttatttagcaccaagctgactagcatcacaaatctgtttcctatggaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataaggtgagtgatgaatgaaaagaaaacatgtgatttaacccagaaaagtgtggttcatttacattaccccgagaaaggaagctctaccttagattacggaggttagtttctatgaagaaacctccccctctgaagataaagagggaacccgatttcagagaactgattcagattggttgatagaagcttcagtatcatgaaaagaagtgtagctgatacttcacaggttatctgaacattctaacagaatgaagaaagcactgactatattaggaagtatttcgagtagttccaagactttgttttcaaaggcagaattcatctcagtgtgctagaaagtctcttaggtgagtaaaaaaataagtaagccttggccttcaacagattataggttccatgccgggcacagtggcacttgcttgtagtcccagctacttggaaggctgaggcagaggattgcttgagtccaggagtttcaaggctgcagtgagctatgattgcacctgtgcatagccactgtaccccagcctgagcaacatagcaaaacctcatctcaaaaaaaaaaagattatatgctcctgaaatattccatctggcagtctagcaggtaccacctttgggaatgtttccaccatagggttttgcaccagctgagggacaggagagcttaagcatccttttttcactaagcctatatgagtcctatctgtggctgcctcctgggtaaagacactttatttaaaaacaattcttaggctgtcagtgacactaacattttactccaggcttcagtctttatctggtacagaacagaagttacacatttggaggtacaagggagccagagatcacctgtaacccccctttagctcctatgtggtctcttcagctggctctagaaaccaaattgataccagcagattgacaggagaaaagcatgtactttttttttttttttttttttttatggagacagggtcttactctgtcacccaggctggagtgcaatggcacaatcagcctcctgggtagctaagactgaaggcataccaccatgcctggcttgtattttttatagagacaggttttcaccatgttgcccaggctgatctcaaactcccaggctcaagtgattcggccaaagtaagatgcttttgtaatttttagacaaagaacaataaatttgagaagaaataagacaaaatctggctagggatagtaaatttctagggaagtcactaggagatatatgggggtggggggtgtaaaactagtggaagataagggttacttccttaagtgtatttattcagttccattgcagccccgtttccagtctctggtgataagggctttttgccctagtatggggagggtacccctcccagaggaatctttatgacttgctacatgcaagaagagacaggtcagctagccttttctgaaactacaatttctccaatgctttcacctcaaaattaacaatatacctatcggacatattctgagatggcacatgactccttcaagggtatttcacacacatgctaggaagtgaggggttaagtgtccctgtgtgctttttcagatacgtggcttcagagagagcaagaaggctgaggaggatgaggagggcagggtgaggctctctccccaggctgatgatctcctttcccttgtcttagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaagggtggcacgcggactggggccgccgcggcggggttgaggtgggagtccggacgggcgtcgcagcggggattactgaggcccgatcagctgacgctcaacctgagggcccctccagggacggagattctgggtatagttacagcgtcagccgtgacacaagccgccagaaccccacatattccgccttgcgcacagctagaggcccaggcccaccacctccggcacctgcccgcgcgccccgcaaccagtgggcaccacagcaggccccagccctgcccgctactcacctgggccccaccccacctctcgccgccctcctcaggccccaccacctcccgctacacatctgagccccgccccacctccaccactttcctcagccccaaccacctcctgctacacttctgggccccgccgcacctccaccaccctcctcaggccccgatcccttccgctactcacctgggtcccgccccagctcagtcctcctcaggccccgccttcgcccgctactcacctgggccccaccccacctctcgccaccctcctcaggccccaccacctcccgctacacatctgggccccgccccaccgccaccaccctcctcaggccccgccccttccattactcacttgggtcccgccccagctcaccgccttgctcaggcccggctccctcccggatactcacttgggccccaccccagctctccgcaccctcctcaggccccgccccctcccgctactcacctgggtcccgccctacctgtcataaccctgctcaagccccgcctcctccgctccccagttactcacctgagacccgccccagctctccgccctcctcaggccccgccctctccacccgggttcctctgctcagggcctccccgaccggaacatctcgccttttggaggctacgccccgccctttacggtacagagcccggaagtgtcttggactctcgcctttccatcttccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacgtgagtatcgggtgttctgcggagggtgggagaacttcgggtttgactttcttagcggcgtggatcggagcattcttgctcctcctccgtccccagagcggagaactccagaattcctatcctgtcagcgaagacactatccggccccatcctcagagatatgctccttgagccacatttctgtccccaccccttttgagagttcctcagtctctaccctagtgtcagtgatagtgttacccctatagcctctttgcttgacccgcacctaaggacctggcgttaggattatctccttgacttaaagtcgatatctcagaagagtcctcaactaacttaatggttcaccaacaactaggacctgggattcccctcagatcatggtgcttttcggatccttcattaacacattaattaaaacaatattttttgagcacctactatgtattctgcttgccatgtgggacataattcatcaattatatttattgaatagctactatgtgccagacactagtcttacgtattgggaatacagcagtgaataaaacaagtccttctgcttacattctagtgtttgagagtacagtgttacggaaacttttaaaaaaaaaaaactcaaaaaagagattagtcaacagtaaaacgcttagaggtgtaagatgaagttaggccgagtgaggtggctcatgcctgtaatccccgcacttttggaggctgaggtgggaggattgcttgagcccaggaattcaaggctgccttgagc

SEQ ID NO: 13481 - DNA, 129127 bp, Human
attatgcagagttagaaaatgcattatttgcaatagtgggttttctcccatgttttaaaatggtctcagccacagaaaactaatgaataagggcccttgctactgcatatctgttaagtagatagtttgttttcagccatgtagcttattttgggttaacattacttatgatttaaaattgaagaagtaaaaatgttatatttgtttgcagtatttctgtatttgaggaagttgcagtcataacttgattgatgggacttccttctgtgttcattttttaagctagctataaaatggtgagaaacgttgaccacgatgtatgtactacttaatgccttctttgtttaaaatggctgtgcaaatatttttcttaggcttctaaaaatattaatatttaaatgatttgggtaaatagatgagatacggcatgatcttttaatatagtagtgttttcctgcaatattatgatccatggttttaattactaagtgcattgctataaatttgctaggccttcacttcctaactggtcctactctcaaaattcatggaacaggccggacacagtggcctgtaatcccagcactttgggtggctgagggaagcaaatcacttgagctcaggagttcaagactagcctggccaacatggtaaaacctcgtctctactaaaacaaacaaacaaacaaacaaaaattagccgggcatggtgatgtgcgcctgtagacccagctactcaggaggctgaggctggagaatcgcttgaacccgggaggtgaggttgcagtgagccaagactgcgccactgcactccagcctgggcgacagagcgagactccgtctcaagaaaacaaaacaaaacaaaaaaaaacagacccacaaaaagattcatggaacaatttttgaatttattgacagctgaataatgaattcagggttcaaaatgatactgcactctccttttctggttgtttgcaaaatagcagccatttgttgaacaccctatgtggcaggcagtttactggattatgtttaacactttaaaaaatacttctgcaaagtattttttatagatgagtaatctgagtctcaaaaaaggttaaataacttttccatggtcacagctgggagaatagcagagctgggtttgaacccagagctgtgaatttccaaagtcccttctcttagagtgcttgcccagcacatttagttatgttatatatgtattttaataattttgtgtgttttaataattacttttagactattttataaaccccttgagctcatttaaacagctgcgctacatttattttgaatatttttcttgtttgggagtttttaaaaaatgatactatgggctgggtgcagtggctaacgcctgtaatctcagcactttgggaggctgacgtgggcaggtcacttgaggccaggaatttgagaccattctggtcaacatggcaaaaccctgtccctactaaaaacacaaaaattagccaggtgtggtggagcattcctgtagtcccagctactcaggtggccaaggtatgagaattgcttgaacccaggaggcagaggttgcagtgagctgagattgcaccactgcactccagcctgggtgacagagtgagactctatttaaaaaaaaaaaaaagtatggatttccatgttattcttatatacttaatttatacagttgatttatttttttctcttccaaattaatttctacaagaatgttggttcatgccaagggtttctttattcagtatctactattaaatatgtgactgtttttctgtattaaggcagcacgattacccaacaaaatctcttacccttcctcaaatgtaaattctgcctgttcagcagcagcagaagctctgcattgttttctgttggaagtgtgagctgaaggggacagacattcctactgcttagcgggtgcactaaactgtgatttgcccttgttgtattatcaacggcacaatatttttatgttgcagatggctgagagctagcaaggaaaactcaggaccatgatggctcagtttcccacagctatgaatggtaagcagctttgtgcttgtggcaagatgaggttatggatttttttttttttggtagaggtttaaaatattcatgtagataattttccttaagtgtataaatacaaaacttgaagtattcttggaaaatattttggaacactgcatatgtcttctgtaagaatattatgttgtaaatcccatgactatattctggaacgtgtgtttgccattgagcagttaggaataaccaaaaggtatattgtgtttgatgcataaaactggatgacaaatagcagagtgctataaggtgactattaaaggtattttgataacataacatgattgtaaaccgatgaagccaataaagattaatttagtaatatttatgtaagattatgttttccctttagataagattatgtatgcctgcatacataattgtttaatatcaaacattttaaaagaaagtgctggccgggtgtggtggctcatgcctgtaattacagcactttgtgaggctgaggagggagatcacttgaggtcaggagttcgagaccagcctggtcaacatggtgaaacccaatctctactaaaaatacaaaaactagccgagtgtggtcatgggcacctgtaatcccagctgcttgggaggttgaggcaggagaatcacttgaactacccgggaggtggtggttgcagtgtaccgagatagggccactacactccagcctgggaaagagtgagactccatttaaaaaaaaaagaaaaagaaaaagaaaaagaaaatgcttaggtaatttgaataatgaaaagtttttaaagttttgttctgattgtagctttaattcttttcccaaatactaattaactacccttagtaggtattaagttactgtgtttgtcatttataattaattgaaaaacatgcattatatttttaaatcgctaaagaaatctagattctgaattcttaattttatgttaaattgtattagctaattgtagataaatatcaggaaatagagaataaactcaataattctttattatttaaattgaaaacagtaatattaaagagcatttaaaaaaaggagggaagaatcaccattctaccatcttcacaaagcaattctgttttgatattaccgtctagtgttaatcagttgttttttaaacttgttttcagacataggaccaaatcattacattgttaataacgaaaatacatgttgtatatctaaagttttatgtctcaggatttaggaaaatcttggagaagtgaattatttgtataaaaagtaaaatcaaattctgtgtggtgaggtcatgtgtcatttaaggatagacttgaagtaaagattttgttgtttcgtgttttaccttttcagaacctattatttaaggattaatgtgagtattgctcctattgggaaaatggtgtgggattataaacattgatgccacagacaatttttaataattaaataatttttccataatgagtgatacatgtaagtttaaaattagggcagtgattgtagtagtaacatgctctactcaagtttgaggatttttatgccccatacaaaggaatttgcattaaacagttgaattgtaaacttcagccaacatgttaatcagttttataagcaaaatgaacataaagcagtacagtcccggtccttctttattctgcttcttccattccataaacatttatatatctactttgcagttcattgcattatatataaaatataacattgagaacaaatggactattcaataacaaaagaatgattatgtgaataatcatctaaaatgttggaaaatgcatttagaagtgctatataggcatacagatagtaattttttttaaacttctgaagaattaattgcatatgtagactgtggtaccttcctacttagaagattgacgataacttagacatatctaatttaagttcaattcagggtttaagatgttactgagagcagcattcatgtatagtacaaaactttgctcctctagtaatcctgacatagattgttaaattgttttgatgcccattgctattgggacttgtctgtaagtatgcctgtgtgtgaatgtgtatgtgtgtgtgtatgtgtgtgtgtgtatgtatatacgtgtgtgtgtaaaaactgagatgagactacttactgaatgagatctagcctatagtagatgttctgtaaatgtgaaaatttttttcttcactgactataagaacttgtttgaaagagccagcaagtgagatgagaataagcaacagaaatgtttatgaaaatcccatattttcaatatcagtgatgagttaggggaagcggatagaattttaatgtatttctaacacgattattacatattgtaaaagtttgttagctttttagggaaatattagacatcaacccctaaacttagatttttctgcctcttcgataaggcttacagataaatatagactaagattgggagatttttacttgaagttcaaagtaacaaacttttgccttttcaaagggttctgttagttgatatatttaaataagaaagccaggactgaattaactattttaaaattggctttgaattacacgtattgcccagttttcttattgcagtgttttgttttttgagacagggtctccactctgttgcccaggttggagtgtagtggtatgaacacagctcactgcagcctcgacttgctagattcaagcaatcctcctgcctctgcttcctgagtagctgggaccacaggtgtgagccaccacacccagctaatttttagattttttgtagacatgggggtctcactatcttgtccaagctggtcttgaactcttgggctcaagaagtcctccaccttagcctcccaaagtgcttggattacaggcatgagccatcacacctgaccagtgttatctttttgttcctagaaaattcttggtgcattaatactttatgttttaatatgattaattttttaaaaggttatttgaacactacttaaaaattattccttgttaaaatgccttagaacatttttattctcttggttacattaatcatgataatatgtaaccgtgattgttgtgtgtgattttcttggctggtagagtctctttaaaatattagagtctgtgagttcttttaaggtgttcatttttttttttttttttttttttgagacagggtcttactctgtcaacccagcctggagtacagtggcatgaacattgctcactgcaatctcaacctccaggctcaagcagttccttctgcctcagcctccagagtaactgggactacagacatgtgccaccaagaccagctacttaaaagaattttttttttagagataggggtctcactatgttgaccaggctggtctcaactcctgggctcaagtgatcctcctgccctagccttctgaagtgctgggctgtgcccaggcaagtggttcattttattcatctttgtaccccataaacatttactgaatgaatgaatatgaaggtgtcaagattactgattggagacatgaggaactaagcagtaaacaaacagatgggttgagtttagcccctgtgaaaacacatagccaaggaaatgtcaggagatagtaatatatataagaaagcatcatactgtgatgagcattggtgcatcaatcttgatgcagcagaactctcttttgtcttaggatagcagtagagtccatcactgcccggggttatatatacccatgtatgttagagcagctttttaaaaaaaatttaatttaatttaatttaatttaatttttttgagacggagtctcgctctgtctcccaggctggagtgcagtggcatgatctctgctcactgcaagctccgcctactgggttcacgccgttctcctgcctcagcctcccgagtagctgggactacaggcgctcaccaccacgcctagctaagtttttgtatttttagtagagatggggtttcaccacgttagccaggatggtctccatctcctgacctcgtgatccacccgccttggcctcccaaagtgctgggattacaggtgtgagccaccatgcctggccgagcagcttttaagccttcttaaccaaactcttcagacttaaaatagtcttaaggtttctaactaaagagccttagtttcaggctattccctgagaaagatttgaatgctctgacttctttttaattatattgttccctgggattgggttgaataaggaaactaatttattgaggactcctaatatggcaggcatgtattagatgctttatatttttgttttagtttattttaaagttgggtttattgggggtataattcacccttttaaagtatacggttcgatgagtttctaaaactatatatagtcatataaattaggatataaaacatttgcatcacctaaaaagttctctgtacccttatacctccacctttagccatgtattattggcaaccactaatcagatttctgtccttacagttctgccttttccagaatgtcatataaatggaatacacaatatgtagcctttggtgtctggcttctgtgacttagcaaaatatctttgtgattcagtcataatgttgcatgcatttctcctgtttactgctgaatagtagtccattgtataaatgtgtaccacaatttatttatccattcagccgttcaggtgcagaacatttgggttatttccaggttttagtgattatgactaaatctgctataaccatcagagaacaggtttttatgtggaaataggtcttcgtttctcttgggtatttacccaagagtcttttgttaatactcaagagtctattgttgggtcatgtggaaatatatatttaacttcataagaaattcccaaactgttttccaaagtgactgtcacatttgctttcccaccagcatatatgagttgcggttgtttggcatctttatcagcactccgtgttgtttttttttttaattttcagacatgctaatagacatgcagtgatacctttttgtgattttaatttacatttccctgatgatagtgatattgagcatcttgtcacgtgcttatttgccatctgtatatctttgatgtgtctgttcaaatcttttgttccttttttttgaggggggggattattttctaatttttgagttgaatagttctgtatatatgctgacctatatttattgaatatgttttgcaaatgttttctctcagcctgtagtttgtcttttccttttcttaagagtgtcctttaagagagtggaaattttagatttttataaagtccagtttgtcaaaatattttaatgatttttgccttttgtgttccaaaaagtcattgcataatccaaaatcacaaacattttcttccatattttcttcaggaagttttatcttatatctagttctgtgattcattgagagttaattcatgtatatgctggaaggttgaggttcttttgttgttttttcatatggatatccagttctttcagcaccatttgatgaaaggactgttttccaccttgaattatctccacatgttgttggaaatcaatggacaatatatttgtgagtgtatttatgtttaattaccaacaagacagatagtttaagactcttaattaagcctgagtagacgctagtcttgccttcaacacttaccaattttattaccttgggcaaattatttaatatctctgtaccactgtttccttctctgataaacagtgatagcaatagttacctcatgggattcttatgagacttacttgaagcaatacatgtaaagctcttagaaaagtacctgacacagggtgagtttcattaagtgttagctataatggaggtatattacatgtaatctttacaacaggcctgtggagttatataatattcctagtttatagaggtggcatctgaattagaaggaacatgagcatcttacccatatatgttggtacatagttagtgctgagttcaatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggtgagctgcttccatctttgtcatcctttgttgttgtcatttttgttgtttttaaaatcagcatcataatttttctgaagtcatataatagaaaatcagttctgtggctatactacttgccttcctagtgacaggaatcctgacaggtttatttatttattttctgataaactgataacccaagtaggatttttactacatatgtggtatttctttatttagaaagtgtgtaggtttagctattttaggtccttagttcttcagtacatctgtttctttatttttaactataatcttaaaacttctctttaagagaggatatttatagattttttaatccagtcatttaggactaagaataatttgttaaatccatattagtgttaaaaattacagtgagcacctacttttcaatgatatacgttcctggaaaattgtctttgtaaggcagatttttatacaatacaagcaggaattatgtatgagtttatatacctaaacgtatttgattccttattggcagaaatggaataaattgtaaaggtagtcagaagtatagatggtgattagtcatgttgaatgtgcagagctttacaaaaacctcagagagctggcggacaacaaaaagctaatcccaagctcgggaagaaacccctgtatttgcaatgcagacatcctcagagatagtctggaacaaaagctatcaatcctttgctttagaagatgtacagaaacatgagaaactcatggagaattgtctcccaagggttcctctcccttatttctccattgtcttgacttctagcaaattttctcatgagtgtacataccactaagttggccactccgattaatctgacaaaacgggctgggactaagtctgatttattttatgcagcatttgattaagactaatcaacaggactccaagcagcaggttggtctcagcttgcagtgttctcagctgtgctctgcagggtcccagctaaacaaatcctataaatcatcagtgtctcccttagaaagccaggtggctttctccttaaaaaacaatgtttttttgtttttttttttttggtggttgttgttgttgtttgttttttgttgagacagggtcttgttctgtaacccagacagtggtgtgatcagtgctcactgcagccttgatctcctgggctcaagcaatccttctacctcagcctcccaagtagctgggattacaggtgtgagccaccaccactggctaatttttttttttttttttttttttttttgagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccaccctcctcggcctcccaaagtgctgggattacaggcgtgagccaccgcgcccagcctggctaatttttttaagttttttgtagagatggggtctcactatgttgcccaggctggtctcaaactcctgagctcaagggatcctcctgcctcagcctcccaaaatactgggattaggtgtgcaccaccatgtccggcctctccttaagttttattttaacttttctacctggcctgaatcagtaatctgggtacagcagagtgtattcataattgcacacactttatcttagcctgcaaaaaaagaaaatctaggataaatctctgacaaccctagccagtgagttgaggctgacctgaatgccttccaggactgaggaagtgtttttttaaacacttgaagatctcttcatgtacattactgtgtttttggagggaggcaagttaatgcatggtttccacagaagaagtagaagatcaagggtgtgcatgggttatgcttggaaagaaaatgtttacagttattccccctgcaacccccactgccgtgggacctacatcagaagaggggcacaggttgatagtgcctctaacatagcctcctggatgactggcaagtctgagggtttccagtggagtttgagtaattgagtctagtccttgtttttggagggattgcccaaattagtcccacttgttttgtttgtcctcgccaccagctgggtggaattcatccattactgagattgggggtgggggaagacctctggaagtgatatggacaggagatacattttctggggtcattcctgatgttcctgatagactcttgataaggctcctgatgggggatggcagactcataaggtgcttccaacaatttaggagagccataccaaggcatttttcttgcagaagaaggctacaggggcagttctacaagagaaaatatcattaattcctctcttaataccatacctcctggggtctaaggcgtttcttcctcaggtgccttcttgttgctctactgccattaaacctgggtttctcatttcagagccataactttaccatttcctagtgatccagaagagttagatgtaagagggacattttcataaaccctaaccagaattaactttgaatcctctagatcactggtccccaacctttttggcaccagggaccagtttcatggaagacaatttttccacagatttgtggtagggtggtgggagggggttggttttaggatgaaactgctccactgcagatcatcaggcattagattctcataaggagcatgcaacccagatccctcacacacacagttcacaatagggtttgtgctcctatgagaatctaatgctgccactgatctgacaggaggtgccgctcaggtggtagtgctcacttgcccaccgctcaccttctgtgcggccaggttcctaacaggccacagaccagtgccagtccgtggcctgggggttgggaattcctgctctagatccccttttacctcagtggcccagctggagggtttatgaaccaagcctgcctacagttgctgttaggggctagaaagatgcatcatgtccaggagcggtcagagtagaatcctgaattttcacaataggtctgtatatctcctgtgataccccaccctttagccctgatcattagggaggaagcagctaataagcaatgaatcctttctggagacagctacagtcagtgaccacactatcttactttaaagtatgtggaccaggaggaggtgatggaaatagagtcaggctgtcagtgcattgttgaatggcttttatgataaaagtgcatccatgtcagaatgcatatggtccagaaaaccaaaaacatgacacagattatgggaggtcaaggcaggaggatcacttgagcccaggagttcgagaccagccttggcagcatagtgagaccccgtctctacaaaaaatacaaaaattagccagctgtagtcacacgtacctgtagtcccagctactcaggcggctgaggtgggagaatcacttgagcctgggatgtcaaggctgcagtgagccaagggtcactctgtactccagcctgggcaacagagtgagaccctgtctctaaattttttaaaaaagaaacatgacacagattagtttcaagggccatgacagtgtgggcatcgtgggctgattggtaacctaaaaaagtgtcaacaggggaatgttttaatgggagggactatgtgtcagtggggtggaaggtataggagaaatgtttgtaccttctgctcaatcttgccgtgaacctaaaactgctctaaaaagtctatgtgaaaaacaaaaaaatactgtcaatagtttgaggcaccactgatagcctgagagagggaacaaaggtccaatatagtcagtctgccaggagtcaaagggaacaatgccacctgcaatgagacctcccccaccatccccaagtcacagtttggcatgcagtggtatcctctgcacattagtcatacttgatttcagtctaaatcagaggctgggcccatactgtaggtgtctacataggtgacacagacaattcaattagcagttgagatttgttttcaatttgtagccccaggagggtgtctttaatctgtcaatctgtaattttccaagtggcaaaccaaacagctgggtcattggcagcagcccaagaatccaggttctgcccatgtctcctttcagttcagcatagctgcctctgaggctgaatagccactgcagcccagtgaacaccagcaacttgcagcttctctgatctgagccttcattgatccagtagctttactataagcagtggaatgtgcataaaggtttccctcagagggatagttgccgctttttttttttttttgagattgcgtcttgcccttgtcggcgcaggctggagtgctatggcgtgatctcagctcactgcaacctccacctcccgggttcaaatgatcctcttgcctcagcctcctgagtagctgggactacaggcacccaccatcacacccagctaatttgttttgtatttttagtagagatgaggtttcgccatgttgaccaggttggtcttgaactcctgacctcaggtgatccgcccgcctcggcctcccaaagtgctgggattacaggcgtgagccaccgcgcccggccactgccactttttaacgtaaagccaaaatactgttggggccagtgtctatatcttctttgatataccatttctatttgacaaacaaggcttttcaggttattcccaccttgtggaattcaagttgaccctccccaaaatgggactatcaggctagagaatcactaggccttcgtgggtcaagctttctgatcccaaggattatctctaggtgaaggctacttccttttgctagaggctccgatgggcagaatcatcagtcacagtgccttgtgctgtcttcactacccagagtttaattctgttggagtttaccagccaccactgcaggtggaggtattaatttagccagtagttatataccagactgttaatgtctttgttttgacaaatgtactatggttgtgtcagttgttaacatagtagaaattgggtgaaaggtatataggagccatgtactatctttgtgaattttctgtaaatctaaaattattccaaattaaaagcttatttaaaaactgtctgggcgtggtggcttacgcctgtaatcccagcactttgggaggccgaggtgggtggatcatgaggtcaggagatcaagaccatcctggccaacatggtgaaaccctgtctctactaataatacaaaaattagccgggtgtgtggtggcgcatgcctgtagtcccagctacttgggaggctgaggcaggagaattgcttgaacccaggaggcggaggctgcagtgagccgagatcactctgctgctctccagcctggtgacagagcaagactttgtctcaaaataaataaataaataaataataaaataataaaaactactagatggctctctataacttccagggtatggggtcaggctcttgaggatggtatttaagacctttttacagttaattccaccctacctgtttattattactaactctagttattagtctgctcagtgcacttaacagcaccttgcacatgccttgacttctcatgctgtgcccttatggtgtgaaatgttcttatccctcctcttcacgtggcaaaattcaaaccaagcttcaaggctctgcctcagtgttacctttcctgttatctcatccttggtgcttctaactcagaattggcacagctgttttggtatctgtattagtctgttttcacactgctataaagaactagctgagactgagtaatttatgaaaaaaagggtttaattgactcacagttccacatggctggagaggcctcaggaaacttaaggtgtaaggcgaaggggatgcaaagcacatcttaacgtggcagcaggagagagagaagcagcaaggggggaagtgccacactttaaaaccatcagctattgtgaggaactcactcattatcacaaaaacaacaagggagaaatcaactcccatgatccagtcatctcccaccaggcccctcctctgacacgtggggattacagttcgaaatgaggttctggtggggacacagggctaaactatggcagtatatagttctgcttaggatttttcacaggtgaatactgtaagtactgttgttttctagagcatgaattccttgagggtgggaatattttcttcatctttttattgccagtatttagcttgatgcccatttccagtgagtgtgatatagcacttgttcaatagacgttaattgagccaatgagtgaaaagccttagggctgtgctatgtatggttatgatagagctctactctttgtgtcactcaaatattaaatactgtcatacaatgaacacttgtgatttctatttacattttagaattgtattttaagcattctcatgtatacactatagtttcttccacttatgtttcaggagggccaaacatgtgggctattacctctgaagaacgtactaagcatgacaggcagtttgataacctcaaaccttcaggaggttacataacaggtttgtatttataattagttttattagtgaattatggtccttatgtgatatctaagaattagttttaatttgactgccatcaaatttgtgttaataaacgataaaattcatatcaatcagaattctagaaattaaagaaatgctaactttatttttcctggaactgtcttaatttgttgttttaaatttgggatatggaagatttttcctgaatcctaaatgatagtcaagaatttctgtgtaattgtctggtttcacattttaacattatatctagaaagttttcagtttatttcttagattcatttcatggaaaatctagactttttttttctggaatctgttttcctaatgctagccctctgtctttgaggctacaccaagcactgattgttgatgctagcccttgttttgcagaaagaccaccagagccaaaatgggattaatttaggtgtgcctttgaaatttttttctattaattaaacttttttctgtgccaaagtagcttagtgctttacatacaataatagtaactatgagaacaatgatatttattgaatttttactatataccagatgctatgctaagtgcattattttatttaacctttacaacaaccctgtaaagtaggcactgttgttgtctatatttacaaatagtgaaactgagactaagagacgttatgtaactgcctaaggttacaaagatggttagtgttaatctgggctttgaaaccatttgggctgattttggaatccatctacttaaccatgttatttgtactgctatgatagtaattaccttacctggtatcaggatttgattaccctgcttacaggttaataactttgtccattacgggtggaagacccaagattcctgagtcagagacaaagaaccttatgactaacagcataactagcaaaatgagcattggcatctatctttctgtttcctttagtgttccctaagtcccacagagacaatgcagagagcccaggagaatagtacacatgctatgattgtgttacaggagaggaacactgaatttggggaacccacccttttgtagcaagcagtaaagcaagtttgtcccttgtctcagtgggaaacgttaccggattcgttaagattgctcattacaaacccaattctgagaagtgacccaggcagagagcaattagggtcttacattattggtatacagagcaagacacataggagtgtgaagaaactcatggaggactctctctcctaacacctggtactttttatattgaaactcttttagggaatagtgtttttaaatataaattttactaagtggaagtatttttaaggaagaccccaattgtggaaaaactgagatgaatcatctttcatcactgattaatatacaatagaagtgcagatgtgacttttgttttaaaatatctgtcttattaaagttatgtaaataatttttatgtgtttctatttcacttattctttaatgattggtattaaaattataataaatcattaacatatacccattattattcagaagcattggaataatttcatttactaatgtgctgcttgggttttgtttttattacctccaggtgatcaagcacgtaattttttcctacaatcaggtctgccggcccctgttttagctgaaatatggtaaagtgttttgtagatgaacctaattttctgatagtattttgtttttttgtaatatagtgttaacataaaattgtttttagttgcattctattggttattaagaatatttctgccagcactttgggagtctgaggtaggaggattgcttgaggccaggctgggcaacatagtgagaaccctgtctctacagaaaattaaaaaaaaaattagctgggtgtggtggccacacctctagtcccagctactcagggaggccaagatggaaggattgcttgagcccaggaattcagtgctgcagtgaactatgattgtgtcactgcaccctagcctggatgacagaatgagactctctttagaaaaaaaaaaaaaaaaaaggtatttcttcagttttttggaaaataaattttattgagcaaattattgaaaataattcaggtttagttctctaggacaaatttctaatttcattagaattttctaaggaaagatatatacattatcattgagaaaaatttccttataatttggcagaatctcaaaatcctctttctgttattttgtagtttcatttatttcataatctataaaccccaaattagtcctcgcttcccctgctccttctttaaagaaactattctctataatatctgtttttttaaaaacgtttacaataagtaacaacccctgtcccatctttccacttggaatattctcatgcctggtagagtacgaggcacatagcaagtattcagtaaatatttggacagatgaataaattaaatttagaagtattataatcttgaatttttttctacctaaactggtggaattcagcccaaaggtctctagattctgttttgacaggcagtgttttattagttattatctctggtcagtatttcttaaagtgtaggttttatctttttgttattatatattttacatgttagatattttaaatttagtgatgatgtacacgtgaatgccatatcatcatttttactttgtcaatccccaaaataacgttagttttcccaccaccacaccacatagcaatctacctacctcatgctccttttagggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggtaagtatgtattaatttaaatacctgtatttgctacttaaactttatccctaggcatatttgagtattagaaaaggatttgttagcacaaaatgacagtccccagattccaagttaattttcatgttagagataataaatattaaattcactgtcacaggtaggggatccatgtgttctggttttctagggacagttctgatttatgccttttgtcctggcatctggtccagttagtgtctccttttacaactcctagttgcgtgatgaattatatggtctccctaggtatagccaatcccaaatactattcttagtttcctctctctctatatatatgtgagtaatacagaaaaaattttgagcagttttaaactcacttgaaatggttcgatttgggagataatttaaaattttatgtaagttgaatttttttaaaggttaattagccagctaaatttagggccaaaagttgcagactttgggctaataagttcacgtattcatcagcgataaccggttggtatgttttctgttaattttgatcaggcaatttcttataattatatgtgagaagcactcattttgaatggaacattcaattaggtatgtctatgtatctgaaacatgttccttcactacagatcttagaatatagaattctagagctggttataggggtgtgtgcctgtagttctggctgcttgggaggctatgggtaggattgcttgagtccaggagtttgaggttgtactgtgctatgatcgcacctgtgaatagccacttcattctagtcggggcaacatagtgagacccccatctcaaacaaacaacagactccacaaaattatttcactattttagtgaattctaaagataaatactaaatcattgtgtgaccatatttataagtattctgcagttaataaatgaataaaagtcatcactttgttccttttaagaactcgtccttgaattcataggaatgttacttacaagaaaagtaaaatatgtgacacactttcttgcaaataatgcatatgcataaatggatctcataaagtatctactacttagaacctttttgtttggggggagtatgtgagagagagagagaagaagaatgtgtgtgtgtgtgtgtgtgtgtgtattagtcaagtaacttagtagcactgtattatcctttcacaaaaacctcatttgatctggtaatgtattctttccttgaggagactcatattcaattggaaaaggctgcttagttttattcatgatgagagaggagaatatttaactctttgctaggtgttttcttagttcatacagatcagagtattagtattaagagcagcagtttacctccctcactgctgggtcaaagtagtgagttttttaaggataattcatctgtgtgttttggtaaacatagagtctgcccactgtactgtaaacttgttttttgcatgtgttttataattgattttctagcactggaaaaaatgttttcttttgactttaggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaagtgagtactttgtttctaaagagtcattatttcatgtaaagaaagaaactatttgtgtttgaacagatacaaatttctttcatacttttccttctttttcttttttagcattgcctcatgggtcatcttatagtctgatgatgggaggatttggaggtgctagtatacagaaagcgcagtctctgattgatttaggatctagtaggtatgaatagctaactctgacaactttttatgctttcagtaagaagtctttatttaacaaatgatttttttaaagctttgagcttacctaagttttactttataatggccaagtacaaatacttaaggtaaatttactacttacaactcacataaaataaattttttatttttagaattattaagtgtctgtggcattttacttttgaaaaaataattcatgtaaactaaaaatattctatattttaattttttctttgcctaaagctgtgtacttttcctttaaaaaatgtgtatatttcccaagatgtctcatactcattgtacattgttaatttctttcttgagcagattctactaattggatatcttttaaattttacaaagcacaaatgcatcagtattcattacattaatcacccttcatataaatcactattatactcttcagggtagtgtacggagagtgttagatttgacccagaagaacaacattcatatcctagcttgaacactcactgattctgtggccttgttttttcttaacatcgctgagccatagtttacccatctaaaagatggggactgtagtattttttaagtttgttgggaggattagaaatatttgtaaaggccttagtacaatataaggtctggcacagagcaggttctttatatgcggtagtctcatggagttctatacttcttatggtctttgctttactaagaatagtgataattgcttaaaatttaaaaaaatgtaaaatgcaaaagcagtcaccattggccaggcacagtggctcacgcctgtaatcccagcactttgggaggctgaggtgggcggattgcctgagctcaggagttcgagaccagcctggggcaacatggtgaaaccctgtctctactaaaaatgcgcacaaaaaaattagccgggcgtggtggcatgtgactgtagtcccagctacttgagaggctgaggcaggagaattgcttgaacccgggaggtggaggttgcagtgatccaggattgtgccactgcactccaggctggcaacagagcgagactctgtctcctccccagaaaaagagaaaaggcagtcaccattatagtatgtaacagcgatcctcaacctttttggtaccagggactggtttcatagaagacagttttttcacagacttgaagcaatggttttaggatgaaactgttacatctcagatcatcaggcattagattctcaaagggagcatccaacctaggtccctcacatgtgccattcacaatagggtttgcactcttatgagaatctaatgccactgctcactggacaggagctggagctcaggtagtagtgctcactcacctgccactcaccgagccccgctgtccagcccggttcctaacaggtcggtggcccgggggttcaggacccctggtatataagattcttaatgccttggtcttataaaatttaattaaatatattttatttagtaacataaaaattttaaataaatttttttatagctcaacttcctcgactgcttcactctcagggaactcacccaagactgggacctcagagtgggcagttcctcagcctacaagattaaaatatcggcaaaaatttaatactcttgacaaaagtatgagtggatatctctcaggtaagcagcatacagtgctgaagagcatgaaaaagggtcttttatgtggacttccactgaagaactgtcatttgaatttgtattgtgtagctcatctgacattttaacatccaaaaaatttagcaggcatttgataaatacaaatacctgaagttgtataaggattcaaagatggattcaacttgattgctttcttcaaagttcttactgtcaagtcgggcaccagatatacccccaactttttggcaaaagacctgtcccttaagatcagacctcatcctctaagctttgcagtgaatggagagccacgggtcacaagagagagtgtgtggaacttagcctcagctcacttttcctgagaatcctcctctgcattgggctttttctctgtttatataacctcaagtgagcattgctcaccctttaatgctctaacccaaatgtgactgtaaaacttggccttagttcactgtaaaacatttgagtccaggccagaacatcatctgaactgtactaattgagaacagcaaaggagacataaacagagggtaataggcaagtagagttcccaccttctaactttcccactccctcttcactcagcaagaaattatgatttaggaccgagtaaaataagtgtttaaaaataatagagctttaagtgctaaggaacatagaatgagatatattgaagctgaagagttcagatgaggtatcttttaggaagggagcatttaagctccatgaaaaagttaggatttcgacagagattgaacgtgggggcatttgatggtgacaaaggagaaattaagagcaaaaaatacatggcctatttggagaatgaaaagtagtctgtgaaataggagtccagggtctgtagttatgcagagaggcaagggaacgagcagtaagacttttggaatcgattggacaagcaaaaatatacagtattttatttaaagatacatacctatgtgataactattttttaaagcaagggaattatgcatacaaaattcaggatagtggttacctcttgtggaagcatggggataagtcaaggaacacggatagattcaaggcatttagtagtaatctagttcttaagatgggtggtaggttcacgggtgacctattatacttcttagcttacatatatactttgtatttttacatgtatttcatattacataactaagattttctgtaattttatcaaattgcatgaaacaaggtatgcttttttgacacttttttttttttacattttaatgtctctaaaattaggatgtgtgctacaattagtgatgtcttagcactgtgtcatagttttattagcagtgctttctttcttattcataaaataatagtatgtcttatagccagtggaattttagattctgtgaaatatggtattgaaccatactggagattaatataaagtcataattcctattctttgaaaaaattaacttctttgtaccctacattttgcatttaaaaagttaattttggccaggtgcggtggctcacgcctgtaatcccagcactttgggaggctggggcagacagatcatgaggtcaagagatcgagaccatcctggccaacatggtgaaaccccgtctctactaaaaatacaaaaattagctgggcatggtggtgcacacctgtagtcccagctactctggaggctgaggcaggagaattgcttgaacctaggaggcggaggttgcagtgagccgagattgcgccagtgcactccagcctggcaacagaacgagactctgtctcaaaaaaaaaaaaaaagtttatctttgctaggcatagcggcatgtgcctatagtcccaactacttgggaggatgtggcaagagaattgcttgagcccaagagtccagcctgggcaacatagtgagaccccatctctctaataaaaagaagttatttgttttcaactgaacaaaagttgatgaaaaagacatttacaaaaatgttcacaacctaaatgttcatcgacaggagaatagataaatgacagtatatttacataacagaatactttaaagcgataaaaccaaatgaactgctgatacctgcaacaacatgaatgactttcacaggtatggtattgaatgaaagcagcccaaaaggaccataccatttaacccatttatatgaggctgaagaacaggaaacctaattaatggtgatagaaatcagaataatgtggttactgtgtggggaaggggccatgtgcaaaccttctgagttgctggaaacattctgcatcttgatacaggtgtgtatgtgcatacctgtgtaaaaattcattaggcaggccgggtgcagtggctcacacctgtaattccaacattttgggaggctgaggcgggcggatcacttgaggtcaggagtttgagaccagcctggtcaacatggtgaaaccccatcgctactaaaaatataaaaattaaccaggcgtggtggtggacgcctgtaatcctagctactctggagtctgaggcaacagaattatttgtgcctgggaggcagaggttgcagtgagctgagatcatgccactgcactccagcctgggtgacagaactagactacgtctcaaaaaagaaaaaattattaggcagcacacttaagagtagtacgctttgtataagtactgtaactataacagtataaacagaggtgattttgcattggaatatgaagggcagtgaatggggagccaactgtggggaagtgatccctaatgttacttcattagtatatgtcacattgtacgaaggttgtgtattatggtgttttttagggaatgtcattattattctgagacctacaagggtaaagctatatatctgtaggtaaagacaaggttttctataaaaagagtagttgctgctggtgtccttaagctgagcatgagccccaagaacatgaggatgaggctaacctggacttatatgtttgttttgttcaataagtgtaggagttggtgatcctttttttttttttttttttttttttgagacagagtcttgctctgttgcccaggctggagtgcagtggtgcgatcttggcccactgcagcctctgcctccccgggttccagcgattctcctgcctcctacaggcacacgccaccacgcccagctaatttttcttagtagagacaggttttgccatgttggccaggctggtctcgaactcccaacctcaggtgatccgcccgccttggtctcccaaagttctgggattacagacgtgagctaccgcgcctgtccactggtctgtttttcccttttttacttctcttctcctccccctaaacatagtttttaaaaatttatttagatcaagtcattgatgtaactgtttcctgaatcacatactttctgggcactctcttaggcacaggaatacagacaggggcaagacatggttcatatctttgaagagcccatataatgaagagctcatgtaatcaaggtgtttggttacttgtttaaaagtgctgtgattaatatagatgagaaagtgactaactccaaggatataagagagaatgtttcacagaagaaaagagattagagccagatttcagaggatagactacaaagtaaagaattgagggtctggcattctaagcagaggatataggatatccagaggcttggccgactaagagtgtacatacatgttcaaatgagttttacttagtaagtaagatactctgttggctctctatggccctttgtattactcagactttgcctcacacatataaagccctccacgagtatgatttttaaccatttacattcctcctccttctctcttctgtttgctctattgcctgatgctaagggatcttctttcagtccaaaaggatcttttttcggtccaaaagctgaaatagtagttttgaactttttttcaggtttgaaatagccttccatctctcttatttagaagaatcttccttttaacacaaagacctcctcaaatcaaatttcctaagtgaaatctgaggagtaattaatagggcgaggctgtgagtttaatttccagtgtttttatgtgatttatgttaaatgtccagattaaaaaaatagaatgaaaatattttaaaagttataaaatataaacatttagctgcatgttgtaatacatggttgctttgattatcaagtcctatgttgaaagcctagtgggacaataaatctagctgcatttggctggcttttgttgtagttggagctgttgctgaggcagtgttggcagatgtaatctcttgtgtaagagttgttttggacaggccttgactcaggctgaacccagagtagcgcctgactcttctgctactcacggctcagtcacgtaggagtgggaagtgctgcacctgctgggagtacaagagggcccacagtcttggcctctgatactctgtgtgcctgatatcttgttctttcacgttagccacttgtgtgtattattatcttgctgaaaagacaggggacagcacttgatactgctaattctagatttaaaattccttggggcagtgactgggtttaattgctactgaatgcttagcacctagcacgtggtaaaaacattttgatgttaaaagttcccaggataccctggtagcattgttattttacagatacagctaatttgttatgcataactttaaagatgctaaagaattcctttatgattttccccacttaatcaggttttcaagctagaaatgcccttcttcagtcaaatctttctcaaactcagctggctactatttggtaagtttgtcccttaattacatttgattaatttaactatgcattaattaattaaactctctctcccctattacaagaaagatactgtttctgtaaaagtttgtgactcagagatgctctataaaagcagccatttgaaagttagtattaagcttggaggcaaatgtaattgtgcagaatgttgttgtacccttaagctacaccaaatttacaaaaaatattttcttcaacaatagattaatcttggcatacaataactttttaactttgtaaaccttttaattttttaaaactttttgactcttgtaataacacttagcttaaaacacaaacacattgtacagaaagatatttatatcctattctttaagctctttcttgtttttaaaatttatttttactatttaaactttcggtaaaaactgagacacaaagacacccattagcttaggcctgtagagggtcaagatcatcagtatcactatcttctacctccacatcttgtctcactggaaggtgttcggggcaataacacgcatggagccattgtctcctatgataacaatgccttctggaatttctcctgactgacctgcctgaggctgtcttacagttaacttttttttttctgtaagtagaaggagtatactctaaaataacaataaaaataaagtatagtaaatacataatccagtaatatattaacagatgtttattgttattgagtgtatgtactgtagataattgtatatgctgtacttttctacagctggcagtgcagtatgtttgttcagactagcatcaccacagacacataggtaatgcgttgctttatgacagctacagtgtccttaggtggtaggaatttttcagctccattataatcttatgggaccaccattataaatgcagtccattgttgactgatatgtcattatgcagttcatgactatattttactagaaaaactgttgttttctttcatctaatcccttctatggagaatcagagaatatcttgtttttaatataggtaaatgtgatttggtaggtgaattaaccatggagtaagacaagccactttctcagaaggggtagttacttctctttctgtttcaaagtttcttccctctcttttatgtcttgaaaatcaacggtaaaaaattaattcactattgaagtacatacttacatacttacattcaatagtgagttacgtaaatgtacgtatttacatttcactaaaataagtgtacccagcagttttaccatcattatccttcttttaaaaataaaaaattggccgggcccaggtggctcacgcctgtaatctcagcactttgggaggctgaggcgggcggatcacgaggtcaggagatcgagaccatcctggctaacacggtgaaaccccgtctctactaaaaatacaaaaaattagccaggcgtggtggcgggcgcctgtagtcccagctactcgggagactgaggcaggagaatggcgtgaacccgggaggcggagcttgcagtgagctgagatcgcgccactgcactccaggttgagcgacagagctagactccatctcaaataaataaataaataaataaataaataaaagtaaaataaaaattgaacttttaaggcaatattttactccaaatagactttattaagttgtgaattttaacattttctttaggactctggctgacgttgatggtgatggacagctaaaagcagaagagtttattcttgcaatgcaccttactgacatggccaaagctggacagccattaccactgactttacctcctgagcttgttcctccatctttcaggtgagtgtgcctggaggtggagaactatggttttgataacttggcagatgtgatttagaagagagttaaatatttgcactgccattgattttagtattcaacaagttatacttgaaaagggtacatattagaagtaggtgtgggccaggcgtggcagcttacgcctgtaatcataacactgggagccaaggtgggaggatcacatgaggccgggagttcaggaccagcgtggacaacatagtgagaccccgtatctacaaaaataaaaataattagccaggtgtggtggtgtgcgcctgtagtcctaggtactctggaagctggggcaggaggatcactggagcatagaagttcaaggctacagtaagttgtgattatgccacagcactctagcctgggcagcagagcaagaccctgcctcaaaaaaaaaaaaaaaaagaagtggatgtgttttcattatgttatacataaggaggctaatgactaaagagataaagaaaaacttgcccaagaaccaaaattagctgaactgtgatttgaatccagatttctctgtcttgaatatccatatactactgtattttgtaacgacataccaaactgttttaaatatctttaatactgtattcccaatatcaaattgccataatcactggtagtctgtgtaatctagtctgaaaatgtccagactacatgatgctaactttgttgtttgatttttttagaggaggaaagcaaattgattccattaatggaactctgccttcatatcagaaaatgcaagaagaggagcctcagaagaaattaccaggtatcactgagtgtcaaagttgtatatttatactgagttcttttaaattctacctttaaatgtaatggaatatttagaatttttatatttttaatatttgatgtgctatatgagaaaaaactatttgatagatgggatgtattttggtattgataaaattaagatggtcaaaatgagaagagtgtgaaggaagaagagacagttagatgtatttgacaggattatagacatctgagttaaagtatttctcctaatttaggctgagttattagaggaaactttgtaatgaaatctttacctttaaaaacatttaaatattggttgaaagaatacatttgtagctgttttaatatattaggatgttaatgacatcaaaacaaatgtataaccacacagctttgattgtccttgaagaagagaaaaaagttgaaaaagttttttttttttttccttgttgcccaggctggagtgcaacagcacaatcccggctcactgcaacttccgcctcctgggttcaagcgattctcctgtctcagcctcctgagtagctgggattacaggtgcctgccactatgcctggctaatttttggtatttttagtagagatggggtttcaccgtgttggccaggccggtcttgaactgctgacctcaggtgatccgcccaccttggcctcccaaagtgttgggattacaggcatgagccaccacacccaaccgaaaaagtatttttattggcaagtttataaaaattatttctctcttgattggattcaaacttaaaaatttgtttttctaaaattgaatatccttgaagaaagtagatatttttccacttagatttgagttaaaattatccttaggagaagtattcaaatactgatagcactcaaatgatcacaaggcataagtatatagaaactagattacaggttctgtaggctgttaatgtgtgtggatgctgataggcataccttgttcagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggttatttttaagttttttacttcttaagaaaatcattacatttaataagtgactatatttcatttgattaaaaaatgcttatttttgaatttttgttttgccttttgctctgcatcatttcattcttaccctatacaaatctgatcattccttcccttgaggagggaaagaggcttcttgcttataaggagttttcagaactggtacgtggtagagaaagcatcctctgcaggtgatatctcaatcaaaggaggatcgactgcagagctaagttgagtgaggagctaaggttagttaggcaactgagcaagtcattagacgaaagcaagtttaagatccagattaagagtccaaggaattggagagacagaaagatgagagctgggcattgaaagtctctctagagaggaatcaagaggatgggcttgcacaggcctttgggatagtgttgctgggaaagaagggtccttaggaggactggctgtgttttaaagggccagggatggagcacaggaagttattgcacactgaaataatataaatagaatttttcccccagataccagaatagagggaaaattattcctgttaacatttatatttatgaagtcattctgtaacttattaagagaaaaatgactgtaacaaaaggatggtcttccaacctgggcaacatggtgaaaccctctctctacaaaaagtacaaaaattagccaggtgtgtggtggtgtgtgcctgtaatcccagctacttggtggggctgaggcaggagaatcgcttgagcccaggtggtggaggttgcagtgagccaaggtggtgccactgcactccagcctgggtgacagagcaagatgctgtctggaaaaaaaaaaaaaaaaaaaagatctcgtgaagaaatgagaaaatatgatagatgaagccactttcttggaagtctttaagcccattaataaaactagatttgcctagctacccttaggcactaaagccactaagtgctaaactctgcctaacttttattgttgtcttcccagtttttgaatcgtgcaaaatttttgatttaaaaattaagtataattccttttttttttcaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactggtatggctgaagtttaagtgaaatttatctgaatgatgatagagctacctgttgaaaaatgtaattgtgggccaggcgtggtggctcacacctgttatcctagcactttgggaggccaaggcaggcagatcaactggggcaggagtttgaaaccagcctggccaacatggtgaaaccccatctctactaaaaaaaaaaattagccagctgtgggctgggcatggtggctcactgtaatcccaacgctttgggaggctgaggtgggtggatcacgaggtcaggagttcaagaccagcctggccaatatagtgaaaccccatctctactaaaaatacaaaaattagccaggagtggtggtgtgcgcctgtagtcccagctacttgggacactgaggcagaagaattgcttgaacctgggaggcggaggttgcagtgagctgagatcgcgccactgcactcgagcctgggcaacagagtgagactccgtctcaaacaaacaaacaaaaattagctggccgtggtgggtggtggtgggtgcctgtaatcctagctacttgggaggctgaggcaggagaatcacttgaacccaggaggtggaggttgcagtgagccaagatcgcaccactgcactccagcctaggtaacagagtgagacgccatctcaaaaaaaaaaaaaagaaaaatgtaattgtgttttaaaatctctcgtgaattagttatgtcttaatgtcattagtcacattttcatataaacagactgtacaatatggtttactgagaaaaggataatgactcaaaatgctgagaattatgttgtagcatcagttcagacactgatgaaccatgtactcctgggcaagacatttcccttctctgtgcctcacttttcccttgtctgaaataaagagttgtgttagttgagtgattttcagttttcagattggtctctgtaagatggtctgaggaggactaagcagaggcaggagaggggaagctcgggcagcagaacagtgattttctctccctaattcttcccatgcttcacaacagagaagcttgacatttatgtgctttatgtttcttggggtttcactcaagatttgcttggaaaaaaaaagattctactattaaaaagacaactgatttgaaactgctgacctaaatgatctcttacagttccagttctgcaggattgtagttcttagctaatactggccactaagcagtttttaccaatcagatgttagagggtcaagttgttaaaagactttgtttgaaatgtgtggtgagaaggtataaaagatctggcactattctgccacaaccctagaatcccatgagcctaccctgatcatatagtagggttttacaaaaatgcatacctagtcatgtagtagagccagatttagatcttgtgtgatcatagtctaacattttatttggttgatgacttgaattacattaaaaattatttttttaatcatcacaatatctttagtcagaaatatattattttattccttcaaatggatagacatacataccacaagtattaatcatgccagagtactacaaaacagttgtaaaaaacttttaactctcttgcactatttttatatatatatatcatcttgactatatataatgggaagagaccttaagattgattgtttttccctcaagaactggtgcaacacatgaagcacagtaacacaggtgaatgtgcagagtctggaaaggtccagagcctatacgtatcccatgttgaggataagaatgtgagctccagcagagatacacatgttcctttcagtgtatgtatttcaaatatgaaacagtcttcagtaaaacttttcatcatcagtaagttttaacccaggatgtcatttcccctcactccactgtattagtttggtagggctgctgtaacaaaatacgataggctaggtggcttaaacaacagaaattaattttttcacagctcctaagatctaagaccaaggttagttaggcttagtttcttgtgaggcctcttttggtggcttgcaggtggccatctttcattgtgtccttatatggtgttttctctgagtgtattttatctctggtgccttttgtgttcagatttccacctctaataaggacaccagttagattggattagggtccacctgtatgactttgtttaaccttaatcacctctttaaaggccctgtctccaaatattgtcacattctgaggtactggggcttgggactttaacatatgaattttgggggacacagttcagcccataaccccccatgtcacccttcttcttaggtcccattgagaatctctgctatttgtttgatttcttcacagaagaagaggaaaaaaggagaagaatattagtatagaacagaactgttgccaaaacgttcctcctgggcactgttttaattagaggaaattagatggccatatttagggtagaaatagaagttcagagaaggtaatgccgagcatcacatgcaaacatttattcctcttcatcattctttgagagtgtctctgatattaatattgttaattaatattgtctaatgctgaattcagaaaaaaattcaatgtgttatgtttctgctttcccatactaacatatgggctcttgcactctgagaatgatgtgtttcccactaataactcgagttaacagacacaactctgaaacacattccacttggttttaggcatttatttcaggatgaatatgaatgataactgagattttaaaatttaactaaaaatattattctccttgtagaaacattttctattagcattttatgttactatatatttatatgatcttcctatagaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggtaagtccttcactgctaaattgttcttaaacatgtacaattaatagttcttctgggctgggcacggtggctcacggctgtaatgctagcactttgggaggctgaggcgggtggatcccctgaggtcaggagttcgagaccagcccagtcagcagggcaaaaccccgtctctactaaaaatacaaaaaaattagctgggtatggtggcgcatgcctgtaatcccagcaactcgggaggctgaggcaggagaatcgcttgattctgggaggcagaggttgcagtgaacccagatcgcaccactgtactccagcatggatgatagagcgagattccatctcaaaacaaaacaaaacgaaacagttcttctaatagagttttgttttgggggtcaataaccttgagtctttgataggcttgtgatctaaatacacgcaatcctgtatacaatatcaggaagtccatagacctactaaaactctgctagacgtctggttaagttttgcttaatatatatacgtaagtggacatttatcactttgagttttaactctttaacaatgtttatgcattcttaattcattacttgctataacaaacgaccttagactgggtaatttataaacaacagaaatttattactcatagttctagagactgagaagtccaagatcaaggtgttagcagattcagtgtccgatgagggcttgctgtctcctttaaaactagtgccttcttgctgcgtcttcacatgcagaaagggtaaggcagtcccttcaacttcctttataaggacagtcatctcattcatgagtgtggagcctcctaaagccctacttcttaatagtactgcattgggagttaggttccaacatatgaatgttggggacataccaacattcagaccatatcatacattaaaataaggttattgctactaattttaggaaattttgacttaaagttattctttttaaaattatgatgagaacttgaatatgtcccttggggtcctggtaattctcttccttacttgtgcagtagggtctggttcaataattactatttgcagaatggggctgtggaagcattctgcatctctagagttctcttacccaatttctcttactgcatggactggcaattaatcagtctttttgctttgttacaggagagataaacaaaagccaaaaatattttctgtctgatttaaacctgctttcctagtttttagtcctttttattttttcctccctctgtcacccaggctggagtgcagtggcatgacctcagctcactgcaacttctgcctcccaggctcaagcaattctcctgcttcagccttctgagtagctgggattacaggcacccaccaccacgcctggctaatttttgtgtttttcgtggagacggggtttcaccatgttgaccaggctggtcttgaactcctgacctcaagtgatccacctgccttggcctcccaaagtgctgagattacaggtgtgagccaccgcacccagcttttagtccctctttgatatacacatattcatcctgaagtatcatggcatgcttacacataccatctagcgcaggtctgctgtcattcatcagtaagctgaaaattgtaggcttctagacacaccccatttacaaaggctttcttcactgccttttaatttcagccagtcactcaaaattgattttggcttaaatatttcttggcataattccattctagttgattcataagttgtaagcagtttacaactatgtattatttctaaaataagtttcaaagatgagtaaatcctgttttaaagttttcaaaaaaaactcttggacaatattataacattgtaatcaggtactattttttctttttataaggaatatcagaataagcttatctatctggtacctgagaagcaattattaaatgaaagaattaaaaacatgcagttcagtaacacacctggtaagtctctaaggtttgtctgattacttttatccttttctgaatgactgtatcagtcacattgttacttttttaaaattaaaaaaagtattctgttataaataacactttttgcctgtaagtttaaagtttcaaaataaagtgaaaaatatcccagatgttagagcatttttagtgataaaaagtagataaaaataaaatagtaatgattgtggtatgacttcatatcttgatgatatttttatgtatataattgaaacatcaaataaagtgttagactataagatataaatttggctctaacacaagactacatgtgcattttgaaaagtcctgcactgattttaaagaactgttcaggaggaggctttatggtggggccgcacctgggattctagggtgttagcgtgcagcagtcataggcttaagcaggatggtatgctctgcccagaccctttatattatctaactctgtgcttcatacaaagaattttaccatcttggccctctgacacctgtggaacaaaacattccaggataatttatgggatagtaactgtttttgtttttgctcaggtcccaatgagaaaactgaaaaaaattctctgtattggatactataccaataaaagcatagcagaaacaaggtttatttaaagaaaagtaaatctgcagatgttgtgttacaactgactaaagtatcctaaaatgtcactcattgagtctctatcaagtcaattattccattgtaggtctctttattatagttttggctgtttacaaagttcaataaatagtatccccttctttgcgcaagttctgaacaaattaagaaataaggcaaaggagcaagacaaatgagaaaccaaatcactgcctcattattgatgaagctgattctaggcagtgtggtttatctgtgggtggtatagttgcacctataaaacactggatgcatgaacaaagtagaatgcaggtttcctgtgggcagttaagtctctagagagtgagggcttaggaggagcctaggctgtacattcctaggtctttaacttgagctcactagttagtgaaaggaaggaaagaagctgggattgttgggctagtgcagggcccttcacgtggaagaaatatcagaaatgaagttcactcttgtgaactatttttattgtgtctcctgccttccattgatgtggtctatccatgtccctgctcagacagtgttccttatacttggttctttcctgttcaaagtatattagccccacctcacccctacacaggcattccagagtcagggtgagctaacccacctgatatgcacagtggcagaaatatatctttattattgtcatcattgttgtcattgttcctatttgaattgtgaataaaatgtagaatatgtcttattgaggacgtgatggggctattctttctctgtggaatgtaattcagtgcagctgttacctatttatttatttagccatagtccaattcaaaataggaagcttttgtttgggctttgaaaagtatcctgtatcccttagatgcctctctgtataacaattgccatttaagattaccagccatgtgccaagcactgtgtgagtcagttttgatgcattctttcctttaatctttacaataaccctttggtatagttattattcccattgtgagctcaggaaaactgaggttcagagagattaagtagttacccaggatggtacaatcatagtactcaaattcatgtctaactgtaaagcccactgtactaccatgttgtttctttgtcttattttccagttacccaacatagtgctcatatatgtcatcaaatttggtattaaaacatgcattattagtaatatacattgttatgaataaagcagaaatatgggccgggtgcagtggctcatgcctgcaatcctagcactttgggaggccaaggcaggcggatcacgaggtcaagagatcgagatcatcctggccaacatggtgatacgccatctctactaaaaatacaaaaattagctgggcatggtggcgcacgcctgtagtcccagctactcaggaggctgaggcaggagaatcacttgaacctgggaggcagaggctgcagtgagctgagatcgcaccgctgccctccagcctggtgacagagcgagactccgtctcaaaaaaaaaaaaaaaaaggaagaagaagaaatatgcagctataacacttcgctaatagacgtgaaagattcctgaataggctggacactgtggctcatgcctgtaatcccagcactttagggtgctgaggtgggcagatcacttgaagccaggagtttgagaccagcctggccaatgcggtgaaaccccatcactgctaaaaatacaaaaatcagtaggggtagtggcacgcatctgtggtctcagctactcggaaggttgaagcatgagaattgcttgaacgtgggaggcagaggttgcagtgggccgagatggtgccactgcactccagcctgggtaatagagtgagactctgtctcaaaacaaaataaaaaaaaaagattcctgaataattagagacattttatgttcctaaatgaactagcttaatattatactatactatacatcaatactatgtcagttctctcctaatttatatattcagttctttttgggtttcttaaaatgaaacttgggaagataactgacaaattcatctagaaaataaattgtacaagattaggcaaaacttgaaaaagaaaaactttggtaggggggaggagactaaccctatcagatatcgaaacataagatatgaaagttagagtgcctaaaatagtgtgttattgatcagaaatagaaaagtagaacaatggaattgaatagagtctagaagaaagcccatgcatgtatggcaacgtaggataagataaagttggcacttaacatcagtggggaaaggatgggctttcagtaagtgatttgagggacagtggattatctgaaagagttgcagaggagctctttaccgctctctatgtacagaaataaattctagataaattaggaggctaaacataaaaacaacttaaaaactattataaaacaggaaaatattttataatcttggtatgaggaaggtctctttaaacaatacatagagtcatgaagaaaatacttacagatttgatgattaaaaatgaaaacatcataatgaaagacagcataaacactaaaaaatttgaagtacatgtaatacaagaatttagagcttctacaaatcaaaaattaagacagcccaatagaaaaatacggcaaaggataagacctaacaattcaagactctggccagaaacataaatagatgtttctttgacatcactggttatcaagaaaatacaaattaaaataacaatcaggtttcttttttgccaattagcaaaaatgaaaaaagattgataatatccaatatagatgagggtttgcagaaacaggtattgttggtggcataagttgataacagcttttttggaatagtagtttggcaatttctgtcagaatttaaagtgtgcattaacagaatgaaagacaaaaatctacgagccacgtgatcatctccataaataacagaacgagtatttgacaaggtttaacatcttttcatgataaaaactctcaaaaaaaatagatatagaaggaattttcttcaacataataaaggccatttatgaaaagctcacagctatcataatcaatgggggtaaactgaagacttttcatctaagataggggtgtctaatcttatggcttccctgggtcacattggaagaagagttgtcttgggccacacataaaatccactaacactgatgatagctgatgagtgctaaaaaaaatctcataatgttttaagaaagtttatgaatttgtgttgggccacattgaaagccatcctgggccgcatgtggcccatggcctgcaggttggataagcttgatctaagatctggtatgaggtagggatacgcactttttaccacttctgttcaacgtaatgctggaagtactagcaggactactcagacaagaaaaaggaataaaatacattcaaattgtaaaagtagtagtaaaattatccctgtctgcagatgacatgatcctatatgttgaaaaccctaaagactgcaataaaacttagaactaatacatgaattgagtaaagttgtaggacacaaaatcagcatacaaaaatcagttgcattttttacaccaataactattcaaaaaagagatcaagtaaacaatattattcatgacagcatcaaaaataattaaatacttaggaataaatttgaccaaggaggggaaagatctgtaactgaaaactaattgatgggagaaattgaaaaagacataaataaatggaaagatactccatgttcatgtattggaagaattaatattttaaaaattatctgtactacccaaagcaatatacagattcaacacaatatcagaattcaaatagcattttcacagaaatagaaaaagcaattttaaaacgtatatggaatcacagaagacttcaaatagccaaagcaatcttgagaaagaaaaacaaagttggaagcatcacactgcctgtttgcaaatattatgaagctatagtaatcagaacagtgtggtactggcataaaaacagacatagggacaacatgaacctgcaagatgttacattaagtgaagtaagccaagcgcagaaagacaaatacggtatgatttcatttatttgtggagtgtatatatttatccataaaagtagagaataaaatggtggctaccagggctggtgagagaaaaggggatcactgagagtttgctcaaaggaaatcaacatttcagttagataggaggaataagttcaagaaatctattgtacaacctggtgactatagttaataatagtgcattgtattctttaaagttgctaagagaatagattttaagtgttttcaccacaaaaatggtaagtatgtgaggtaagtatgtgaggttaattagctgaatttagccattttacaatgtatacatatttcaaaacaacatgcgtactataaatacaagtttttatttgttgattacaaaagacatagatttacagaatagagagcctagctaattaacatacacattatgttaattagctaaattatgcatatgttaattagctccttagccaatttacaatgtatacatattttaaaacaacatgcatacaatatatatacaattttttgtcaattacaagacatacagacttatgaaatagaatagagagcccaaaaataaacccaagtgtatatggtcaactaatttttgacaagggtatcaagaagacacaatgggaaaaggtagcctcttcgataaatggtattgggaaaactggatatccacctgcaaaagaatgaaattggagccttataccatactcaaaaatcagctcaaaatggattaaacataagacatgaaaccgtaaaactcctagaagaaaacattgacaaaagctctttgacattggccttggcagtgattttttggatattacaccaaaagctcaggaaacaaaaataaacaagtgggacttcatcaaactaaaaagtttctgcacagtaaaggaaacaatcaagatgaaaaggcagtctgtggaatgggagaaaatacttgtgagccatgtatctgataagtggtttatatccaaaatacaaggaatatatataactcaataccaaaaaacaacccaatttcaaaatgggcaaaggacctgagtggacatttctccaaagaagacctaaaaatggtaaagagatatttaaaaagggactcaacattattaatcatcagggaaatgcaaatctaaaccacattgaaatataatatcacctcacacctggtaggatggctgttatcaaaaagatcagagataacgagtggtagtgagcatgtgggaacaagggaacccatgtacactgttggaggaatgtaaattggtatagttgttaaggaaaacagtatgaaggtttctaaaaaaaataagatagaactcttgtatgatccagcaatctcacttctgaatatatattcaaaggaaacaaaattactgtctcaaagagatatttgcgctcccttatgctaaatgcagtaagtcagttacagaaagacaaatactgcatgacctcagtttcatataaaatctaaaaaagttgaactcctgtacagaaactgagagtagaagagtggttaccaggggttagagggaggggaaaatgggtagatgttgatcagtgggttcagaccaacatctacccataccagtcagaaaggtagttatataaattatgcagtagccataatgtaaactactatggagcaatttaaaagaatgaactagatctgtttgtcctgattgataagatatcttactaaattgaaaacaagttgcatagcaatgtagacaatatgattctgttaaaacccatggaaataaaagttgagtatgtacacatctaaatgtaaatgcctaaaagggggatgaacttgcagttgaaatggaggtgttttaattttttactctgtatgtttcattttatttaaattttgtacttctgtacttcaaaaatatgataaagttaaaaacagacatttaaacagataatattgctattttaatttattgtaatgtattctgcattatatatttccatctggtttcttcatccctgcatgaatatgtaaaaaaagataatataaaatgaaaccttctgttcttacctcctaaaataatgttactaaataatccagttagtaatacttactgaatctttgctgtgaatatttccctgttcttgggagcactaagaataaatggaaagctactttaactatagtttctattaattgagtattaactgtggaccagagtgtacaatggctttatatccatcacctcatttaatgtagcatgatgctcattgtatagatgaaaagcctgaggattcgattggtgaagcatctttcctaaagtagaatttcacttcaggtcctagtccttttgaatgcagaaccaaggcttacaaccatttcctctgatgctctttccagcatataatctgggaagtggaaataacaactgaatgttttctcttgtactggtctgcattgtgtatacatccttcgtattggtctagttacatcaatctgaccaaacagtaaatgacatgctggtaatgacatacgaacttctgcaaaatgtaaactgtctgatgtttgtttttcagattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggtatttatttttgatactatttatttttaggtaactgccttcttaccttcattattttgatttaatagaataaatagctaaagctattatatgtattacattttcataatttattttataatttcaactatacaagaatttcaagattgtttttaatgttctagttatatgacatagtgtcatataactaaacatatactttatcacagtttccaatttttgatgactatgtgctgtttgtcttggcatctatacatttccagaacaattgcctttgtcagtattacagaactgatctcagccagcgttatcctaggcaattttcaaaaatgagaaatatggaaaatttgaaatagtttaggtgttagtggctcttttaacacagtttttattttgtttccttgtgaagtgtaatttaattaacctttgttaaataatgcaataatcagtgaaatctagaacagaatctggcactataaactttgcacaaaaagcaagttaatgattcattgtttgccgcagtggcagagcagatgtccaaaacatagactgtctgcatatcattcaccacagtattcattgtacactgaagccatacctatgaaagaaactaaaaacccaggctcatggcatagaatgtaaatttgggaatagtctcagttattcctttgctaacaatataaagtttccagagcataagctattctctgtaagaaataaagcttttcataaagcttttgtataagaaatctctctcttcatatggcttttatcatgctgacttatttagaataacattaacagcaaatatagagtaaacagcatgctaaagaaaggacaacatggtggcttcaggtaaggaaagggaatttgaggtgaacaatgttaataatacactttacacaagcatatgttcagtagaaaaaaattttatagaaaaccaaatcatttgtcattgctggttagacaagccagccaacttatcttccctatattatttctttaaaaaatctacataactgggcatggtggctcatgcctgtaatcccagcactttgagaggctgaggcgggcggatcacgaggtcaagagatcgagaccagcctgggcaacatggtgaaaccccatctctactaaaaatacaaaaattagctgggcgtagtggcatgcgcctgtagtcccagctactcgggaggctgaggcaggagaatcgcttgaacccgggaggtggaggttgcagtgagctgagattgcgccactgcagtccagcctggcgacagagtgagactccatctcaaaaaaaaaaaaaaaaaaaaaaaaattctgtacgtagtttaattggctttttatctgccttatcttacagtgtgggaatatggatgactctgttcttcagtgccttttgtctctgctaagctgtctcaacaacctcttcctcttacttaaggttattttctaatatctagcttcttttctttgagttactttgctgttttatttttttaaaactagactattctttgcctttatctgagtatctttgtttgaaataacatatacaatataagcctttttctttctgcttgcttgaatatccttctgctatctgactgcctgtttgagtctaatgccagaagtcagtaaggttgcctgtcacagtaacctttctcaaaagaagtccaggacacttagaaatataacctggttcctttacaacatccctgtgagtgggttaactgataaagatgattactaactcaattcaaaggaaaatgtgagattaaatcacttacccatatcactgaaaatcagtgtttaaaataaaacttaatactttatgaaatctagggcaagtttatgtcatatatgcaccaagctgcttcctaatactgttgtaaggacaattttaaagaaccaataatgcaggggcaactttagtcaggtctagttaccaggctcatatttagacatgcttgcacatcagataaaaatgtttaaattatataaatatttctctttgccatgtataacgtagattattaaaaatattttaatagagcttaaagaaatgtgctttatgtttactgcttgctgactctagtagattttgactacacattttactcagtactaaaatggatagcaatagggcagttgcctatatgcatatatattccacagtgaagacagaaacatgataagtagagttcatttgttacctgagcgaagtagggcaaattggaaagatggtagcagcaggggacccatattttagcctttatggttatggcatgaatggccagattatatggtttttagaacttttgctacggattgcatagaaactaaactaagtttcctcatctgtaaagtgaagtttaatgatgatttgtggactgttctccctcacagagtctgattctttgagttagcatttgattctccacaggccagcagttattcttgtcccttgttttactttgttccttctgcttcctgccttccagacttacactgcttattgatactttcatcagagcaatttaggaaactaaagagatatgaaatctatactgtcagagcagtcaggagactgtgttgtcacagaaagcaagaaaagaggtcttctgtagttactagaaaatgatacagagttattagttaacatagtgctaaaaaatattggccaggcgcagtggctcacgcctgtaatcccaacactttgggaggccgaggcgggcggatcacctgaggtcaggagtttgagaccagcgtggccaacatggtgaaaccccgtctctactaaaaatacaaaaaattatctaggcatagtggcggatgcctgtaatcccagctactcaggaagctgagacgggagaatcgcttgaacccgggaggcggaggttgcagtgagccgaggtcgcaccattgcactccagcctggtcaacaagagcaaaactctgtctcaaaaaaaaaaagaaaaagaaaaatatccattgaatttgtcaaaaagaaaacttttgaagaccttgctaaaagtgccatttcacttgagtgataagcagaagctggattgcagtggatcaggaatgagtaagagttgaggaagggttaagtgagtagcaacaactcttagaatgaaaagaaaaaagcatgggggtcaaaggaaaatcttttttttttttttttttggtttaagaaagacttgaaggaaatagtaaagagaaaagaaaggaggaggcagggggaaagagagaaagattgagattgtggtaattgatggagcaaagtccctgaagaagcagattaagatggaatggagagcacagattaaaggattagataaaaagaatactttcagtgtaacatacggggagaagatggttatgaatgcagttaaatttgttggtagagagtaggaagttgacagtaaaacgggaaaggttcccttgtcccccttgaagggcaggtgatggggatgtggctcacttcttcagtgctcccctgctcaaacctctaggggagcatacagatgggcaggctgtggggctctgaccccacggcagtgtctaggggtgaatgtttacagctgaagccccagtgggggtgtgttacagagtgctcttttagtttgccgtctataggcggttcgtgttacccagctcagttagacccccttccttatcacaaggacagaacagagggatttctgtatcccagggtttcttgccttggtgtactggaagaattggatcacacgtgggcttggagaatgaatgcaaggttttattgagtagaagtagctctcagcagatgggggagccagaagggagacggttttaccctggagtcgggccgcaacctgatttctcactgctctggccaaactccgcattgttcctctggtcagtggcctgctggcctgctggtgcctgttgacatgctcttccaccggcgtgctcttgatgaccagctgcttgtgtcgtcttctgccgatgtggtcctcatgacgtccagccacttatgcctctgcctttttaggatctcgggtttttgtaggcacaggatggtggcgtggcaggccagggtggtcttggaagatgcaacatttgggtgcaaaggcaggagtgcctgtcctcacctaggttcatgggcataggcccgaggctgaagccctagccagggacccgcctttctctacccagtacttccctggcccactcccatatcgacagcttcaagacttaaaatcagaggtaagttggaccatcagaaagaatcttcctgggtagaggaggacatgatataactcagcctaggccagaagaagaggggtggagatgcagaaagtgctattggttttttgagatggaaagttgagagggctgcagtctgatggcctaatgaggcaaggtttatagctggtagtgaggagaatggatggaagattaggaagtttcaggagagaaataggcatgaaatagacatctcagtgcagatatgcaagcttagtagaggaaaacctaagtgtgctgagcaatgttgaatgtctttttgaagttggaggtgatgtatttaaattgaaaacagtatgcctaattgtgtgattttgcctcaccaatgttcagctgtttaggtataagcacagagaaagctgatgaaataggttcatggttcatacaggtttgaggttttaatagacatgcacaaagagagagggacagaagagttacagatcttgacaaaagcactatgatcaagatgagctctgaaacatgaactagacatgaaggatgtgaagagaggaaggggtgttaataaagaaagagaatgatgggagtcaacagaatggtctcagtgaggttgaaaacctattgatggctgggcgtggtgtctcacgcctataatccctgcactttgggaggctgaggcgggttgatcacctgaggtcagtagtttgagaccagcctggccaacatgatgaaaccccgtctctactaaaaatacaaaaaattagctgggtgtggtggcacgcgcctttaatcccagctactcgggaggctgaggcaggagaattgcttgaatctgggaggtggaggttgcagtgaggcaaggttacaccactgcactccaaccagggcaacaagagcaaaactctgtctcagaaaaaacaaacaaacaaaccctattgatatagatgtaccaggtataagaaaagttcgaagggtaagaacttacgtttgaagaatgggatatttggtcaatggtagttctgtttctgattagtaagactcagggtgtaataatgggagtgatggattaagtagagttaaaaaggtcattgatgaagagatcagcctgagacttgaggtttggattgcatcatttatgtggatgtcaaagacttagagaatagtgaggtgagtgaatgaccaggtgactaatagataacaataaaaaggaaggagagaatggtattgctggatggtaggagccccagaaaagcatggagttgctaagagtgagggggaaataaccatctgaaagtggcagtgaagagcaaggaaaatactgtagttatcctctgaccctgatgtaaatggagtatatgataataaactgagagaggactagcagaaaagtagtatccggagggatcagccaagaaagtgacgagggaagagaattttcgttcagagaagattggtagctgtatgatagtttcctgatcacatagaggaagttccaggagagtggagaggtttgaggagagaatgagtaggggattgggtcagattaagggataaacagcactgtagagataagaattcaggtgataaggaatgagaagaaaggctgtgtcttatcagtaggtgagatggaactggtcctggtagtgttggagcaggacaggcacttagttctgatgctgtggtcctttgtgatagtagagcaccggggttaaccaccactcctttaggctacttgtagtgacaacagaagtaaaatatttcaattatttaatttagaatgttatgttttactggaacctgcaatatgcatgtacagaattaataatttttactcttttggtcaagttatactaagacaaagccagtggattcaaaagtgagacatttgacaggccattataccattaagaaaattcacacatctggccaggtactgtggctcacgcctgtaatcccagcactttgggaggctgaggcgggtggatcatgagatcaggagttcgagaccagcctggccaacatagtgaaacctcatctctactaaaaatacaaaaaattagccgggcatggtggcagacgcctatagtcccagctacttgggaggctgaggcaggtgaatcacctgaacccgggaggcggaggttgtagtgaggtgagattgggccactgcactccagcctgagcaacagagcgagactccgtctcaaaaaaaaaaaaaaaaaaaaaaaagaaaattcacacatctttagcagtgaagtgcaacgaaaactcctggcctaggaatctaaaaaagtgaactctagtcttatccatgccacttgccagttgtgtaacgatctgtcatttaccctccaaatttgctttcttcctttacaaaacatgctgacattatctgcctgtcttctttgcaaagtcttgtgattaaatgagatcgcatatagatggaaatgctttgtaaactcttatatacgaatatacaaatatttttgttatttgtgaaaaaacaaaattactttccctcactcttcttaagaaaggggttgtcagaatctccaaaatatctttagtattttggaaagtcaaccagtgttgacttgagataatgattggggaaatgcttgtccatagagggaaagtagaatctgttaatggtagaattgtggtttccttcaaggagttaggtcttaaccctatgcttccaaggatctggagtaatctacgttagtaatacccctgcaggtggcataacctgccatgaccaagttggatttacctcagccatacaaagatgatttaacatacagaaaagtttaatgtaatttactatataaacagactaaaggagaaaaagattatgctcatctcattagatacaggaaaggtttttgataaaatttaatatccatttatgattttaaaagtaaaacttattagcaaactagtaatagaagttccttaacgtaaaagagataatctatcattctgttaagattgagaacaacttggctgggtgcagtggctcacacctgcaatcccagccctttgggaggccgaggcaggtggattgcctgagctcaacaattcacgaccagcctggccaacatggtaaaaccccgtctctactaaaaatgcaaaaattagccgggcgtggtggcatgagcctgtaatcccagctactcaagaggctgaggcaggagaattgcttgaacccgggaggcggaggttgcagtgagctgagatcgcgccactgcactccagcctgggcgacagagcgaggctccatctcaaaaaaaaaaaaaaaaaaaaaaaagattgagaacaactcttaatgaattctgattggtttatttttttcttgcttaactattatgtgtagcaaggacctcctggaagtagtgacttaacccagaggaataggtctaaggataggaatttttacatcaccatagtcaaatagaggaaatacttggcaagctttgtggtgctctttaaatcttactaatttgcatagactattgtttatgcatttttcatttgtccaataaatatttattaaatatccatgttgtactagactctctgttggctggagacaccttgatgaaagacagtcttgtcaagaaactcacttcagtggaggaggcaatcatatagttggaagagaagacactatgatagaggaatatacagaatggcacaaggaagctcattaactctgacactgcagggaatagggttagtaaaggaatacttagagctctattttaaaggacaagttggagggctaagcctgcagccttgttgagatcagacattaatttggctcctttttactctccttttagactgagtactctcctcatttttgacttcatccaataataataactaagatttactgagaacctaggtgctctgcactataataagcactttatatgtattaactcattttatcctcacaacaactctgtgaggcacgtatcataacaggcttccccaacccgtggtccacaggccacatgcggcccaggacagctttgaatgcagccctacacaaatttgtaaactttcttaaaacattatgagatttgtttttgcaattttatttatttatgtatttatttttagctcatcagctattgttagtgtattttacatgtggcacaagacaattttccctctttccatgtggcccagggaagctaaaagattggacacccttgtaccataattaacctcattttactgatgaggaaactataaaataactttcctaaggttatacagctagtatacagagcctgagtcaagccttgttagtcttattccagacccatgctcctcatcactaaaccaccttgcttctctatatattgtaaccactatattcttctgcttttcaatagaatttagagaaaggtacaacaaataaaaccctagaagctgagagctgtggaaattctgctataaaagcagtatgcattactattggcttaagttgtaaatgttttgctcagacatgttggacatagtctctggacagcatgctgtacttagatcaaatctactatttcaatcaagtaaaaggttcacttataaaatagttatctctgaaaagaaatggagtttggagttgtgttattgtgtataggttgataccaaaaaacattttttaccaaaacattctacccaaatattgtccagctctcacctttgccatgaagtttcttttgattactcttaagtccccccgcccccacttctttcctccagcctcctttttctactctctcgttcaggattctgtagattccaaatgaaagaaatctagttcaaaatagttaagctaatgagtgattattagaagcatcctaggaccactaactgaatccatggaagggctgctggacaggggcagttcctaggtctccgagccatgatattgaacattcagcttctatagtaccctttctctccagctcagtctctaatctgtacttctcttttttctgagttgattttattcctatccccaggtcttatttggttgtgaggcagctccaggtttactttatcccagtttaatgagctgcagaaaggtttctttctccccacttcaacatatgtgaatcccaggaaaatattctgggccagcttggattatgcttatgtcctttggaccagtcgtttctgagcagggaagtaaggtgctgtgattgtttaggtcaggagtaaacaattgtgcctgatgggaatgggaggagctctgagtttggcagaccttttaaaaccacgtaagatgttgggaggaaggtggaaagatcagtttcctagaggaaggcagggtgctgttgaagaagaggaagagaaaatgctgaacagataatcacaagttcctgctaaggaatttacctctgccctgcatgttgacacttgcctctacattgagattgtgaactctttaaagacaaagtctgtagacgtgggagtcagccttgtattggatcctcttggaacgctttatagcacttagcatacaactagatgttcaataagcagttgtttatttcaactcctgtttggaatgcttttcattattttggctcatggtggtcatgattttaggcagacatcttttccatttttagttttgaactaaattatttaataattctgtgtttagttcaagatgatattggataaaaataacttggttaaattacatatgtcaaaaacatgactgaacaaaatttctcttcagatgttataacaagcaaattattcccccatatttttaatggattgctttttttaattgaaaatgatgtaccaaatcaaagcatcggcttgttaaagattctgtgttccgtagaaatgaactgatggaaaagtagattattttaatgtgtttatctcaggagctatatggtttaaatacttaaggttttttttatcatctagatattttttaaaactttaaatcttttaaatttagttcaacttgctataggatttttatcttttaatgcaaatgccacattaatacatatgacaagcatatttaaatcattcacgtattgacttattttctttttctccttaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggtaatatagctgatatatttattgtgctatattgccattagaattgtaattttgttgctcatatctttagtttatgaaaatttaaggaaaataaagggattatcctaatcagattctggatctcataagttcagtccttttagggatcaagtttgcagtaactgattttattttctactagtgaaaaataacagactttggagtcaaacctgtattagaattcttgctcttccacttactacctgggtgaccttggttaagttatttttatctttctgaacctcagttactccatctgaaaatagagacaataatgcatatctcataggtaaatgtattaaataaaataatacagctggaactgggcgtggtgacacacgcctgtagtcccaagctatttgggaggctgaggcaggatgatgagttgagcccaggagttcaaggccagcctgggcaacatagcaagaccttgtctcttaagttaaaaaataaaataatatagctaaagagccaagtataatttgttgcacatagtaaacactcattcattccatctttccttggtaaatctattagtttcctgaaagatcataaaagcagaatacttaattgtatatagtaatactgaatgtagaatgccacattgatgcatttctctttttatcacttgagatatattaattgcctccatttatagtaaggagaagtaagacatttgtggtatctgaagcctagaattattcatttagaaactttgcatggtatttttctgccattgagattctttttctaatacattcttctctttcttccaagttttctagtatcagaaagtagtataattagttaacaaatatggatgaaccagtatttttttgccttggtaaagagtagatgagtaatttctatgaaaaagctaatagttactagggaggcaaggaagacacattaccatttggcaggcctctattcttaatggtttcaaagtagccacctccaacacatttttttgagtggctattgttggctgtgatgctggtagactttggattactcctcataattctaataggagattcagacagttaaacgaataactataatattgtttactcctagacccccatttctttattttgagacagggtccttgctctgccaccgaggctggattgcagtggtatgatcagggatcactgcagcctcgacctcccgggctcaagcaatcctcctgcctaagctcccactgagtaactgggaatataggcatgtaccaccactccctgctaattttttttgaattttaatagggatgaggcctctctgtgttgctcaggccggtctcaaactcctgggctcaagcgatctgcccaccttggccttctaaagtgctgggattataggcatgagccactgcgcctggtgatctagacccctgtttttgtggcctcctaacgagataatagaataatatagaagtagagaaagtaaagttcaaacgaagtagctcttacagctcttatttactgcttaacttgtaccacttaattacataagggagctgtgcagtggttccacagctaatccttatgtcagaactttctattgacatatgcagttaccttaatctttcttcatcgtgttcacaattcctttcaggccaaaagattatactagttatatgcatttaatttcattcatcatccttgcacattaggtagtagagaagagaaatcaaagagagcggaagtgcatataggacctactcagtctgaagctgggtcttagtaccacatcttggtttgattggccatttgcccaggtatattcccttcttttccccaaggtattggtaataggttttcacattttagttgtggcctctttgccctttgcccagcttctgaggcatcctgtggcactggaccggtttctcaactactaactcttacataaagtttaccagaattctggcatgatttcctgcaggttgagctcagccaagtaccacccctcagtaagcctagagtagaggggcctgacatcctttccttaaattaaacaaggagccttatccaggttgtcctagtctcatacttatgtggccatgattacctggcaggaggagttgatggaaagaatgaagagcttaaaaaatatatagaaaattttaatttaatgagccctctggtttttttgttgtgctaaatatgtgctaagtactctgatagtgatatttataatgctataaaaattcaaatgaaagctaattgggtattaattactaggcttggaaaagtgtcctggaaagttacagaggaactgagaaaggggatattagttgaaattaagtgaggactgcaagagaagcattttcctcacaggagaaccagaagtccgttttgaaagttgccggaggaagcattctatgacatgatagaggatgaaggaggtttggaaattgttggaaggaatctagtaaatgggctagtgaaccagcagtatgaagtctgaaacagttgagagataaggagaaagcattgatgactaagggcctacaatattttgaattatccaggatttcgagattccttcaggaattaaggaatagagatgtggaattatgccaaggttcccactttggaagggtatatatgctgacaaatctcaggaatgtttccagctgtaatcttcactgccctgatagtgctgaggcttggagaaggtgctaaatttaagtggtggcagctctacctctgagtaaggttgtgaaaatacatgcaaaggagaactataagatgcatgagttctaatactaaaataattgatcacagatcaccttgactggctggaaaccaaactgtagctgtgttagatttcattgaaatgtttaccaaagcacgtggacctagagaggagaaatgctctattatctaagcaaacaaaaaagactttttgaagtaataatataaaaagtagactgggcgcagtggctcatgcccgtaatctcagcactttggaggccaaggagggaagattacttgaggccaggagttccagaccagactgggcaacatagcaagaccctgtctttataaaaaagaaattaaaaagttggctaggtatagtggcatgtgcctgtagtgctagctactttggaggctgaggcaggaggatcacttgagcccaggagatccaggctgcagtgacctgtgattgaaccactgtactctagcctgggccatagagtaagaccctctctctttaaaaaaaaaaaaaaaaaaaaaagtaggttgtttttctagaagcatttcctatttccacagcaacaatgactaaacccctgaaacaaagattagataggacagtgggaataacagctggaagacagttcttgtcaaatatctggagagaaaggaaggaaacttagatgtaatttttagatttatttgctgaatggttccatttcaacctttttctttttttcttgagtttggaggttggttagcaggagggaatttttgggtgtgggaaattgtcagtcatacaccccagtgcatccactaatcaatccaaagcttccaaagcttttcttgattgattgattgatttgttttcctttcacctctgatctcagcagtttctccccacccctgtactaatacttcattgctagttcttcaccttgacaggaaccagatcttagtatgtttttatttagtgtaaaaaatttctaggacattatacaaactctttttcttttatgtaaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtaaggataaggatactttgagacagtagaacaaatgcaacaagaaaaaaatgacctgataagagacaaaaaaagggaagaaaattagaaagatactaattgtagagtcagaaaaaacctttttataaattaaacttggataaaaagcagtaggcttattaaaacagactgaaatcttaacacagcagtagaaatcttagcacagcaggagaaaagaagatagttactactgattgtgaaaagactcagacatggttttcataattgaagtaaaatagttttaaatattttattcaaccactataactaagctatttattttaatgaaacaacagtaaaattttgatacacctcagtccatttccacaatacttttagtagtattgtatctcttttagatacatgaaccctttgaatcattattaatgatacagtttgttgaaattttataagttaaaacattctaaagatgaacaaagtaaacaattttattcttatcaaattcagtatatttgtgtactcttccactgttttccttttagaaccattctgatagatgtatagatttttcttcagccatccctgttaacttgctattcttatcttttgagacccccctttttgtcctttacttccctgttatattcagacctccacagatcaaaccaagcctctctttgcttggtctccttccactttgtacagctcagcctggcccccactcctgcactttcctttctacccatgtgtgtgcttcatcccgcaagtcatctctttgttttgctgcctcctaccttacttaagatgagcatccttgtttgcttttttattagatgactagtcaagatactgaaatcctagcaagtctgtatcaagtggattttcattgtagtatttggtgcttgattttttcttttaggttttagagctctttattgagtcatagcaaagatgtatacatgtaagttgcaaataatgacaattgtcttctctttaggtgagacagctagtgttttggtgaattatagagcattatacccctttgaagcaaggaaccatgatgagatgagttttaattctggagatataattcaggtaggaaatgaattttttttttaatcatgaataacctaaatacattgtaatatattagtttctgtagtaatgttgaccattaatttcatatatttacctttgtaaaatgtttcttaaacattacctcatttggactttacaacatacttcagagctgcataggacagttattattactaactaagttctagccaaggaagcttaaactcacacaagttgtaactgtcagcattgcagtgccagaatgggatgcagttatgtgtttttttatttccaaatccagcgttgtttctgctatgccatacagcaactgttaaaagaattgaaggagttagattccacagccctaactggatacaggcaatttgttccttggaacgaaagtctttattgtgttatcacaatccatataaaatacatgaataagagaagatcccaggagtagtgtttgatagagccagtaggacataatggaaagagtacaggctttagaagcacacaaacttggattttagtctctgcttctgttttcttcttgttaaactaatgttaaccagagtatctagccagagtatctagccagtgcctctttcccccgctccccctgcactgtcaccagttagtgtgatttatcagttaggtggcaaatgtttaatgatactagggaaaaaaatttaccaaaacgctagcacccaagataaaccctaaacacacattcctgctcttgccattgccgctattagtagtaccggagctgtgcccgagcagggggagaggtttgttctacaaccagcccaagtccactgtctgctcttcctaccattcctcctctccttgttggtgatggtgtctggatgaagagatacaaccaatctctgggcgtgtttggtcaagagtttacttatatttttggttatattttttatttatttcaacaaatattttttgagggctgactatgttagactagggatttagtgaataagacattatctctgctcttaacacgcttgtaggctaatgaaaaagcgtgacaacctaaagcagtagaggaaggaaggtaaggaaaaggttgtagactgctaccagctttagcacagacctctcccatggtcagagagccattctggtggcagtgacaacagaaacataaagttagctgtgtgtcttgggtgcttgtgtactctgctgaatcattaacatgaagtattagtcatgagttactactgtcagtcatgagttgcctgatttgaacaaattggttaatgatggtgtcatttcctaagagggaaaatcagagggggaatatataagtagaattatgagttcagttttgtatgagtttcagatgtccaggcagtagtagttggatctccagagtacctagagagatgtcaggcagcggtctgggctgaggatgtaaatctggatgtcgccagtgtgatgtgatggtgttggaagacatgagagtaatggagctcatccaggggagtagtaacgtgagagagaagaggattgaggatgcagttcctgagaaacatggacactgaaggaattattagaggaagtggagccttaaaaggagtgactagtagtaggaaaaaaaaaaaacaggagagtttaatgttagggaactttgagaagagtgatctgcaagtgaaataaaacaaggactaaaaaaattattagattagcaatagcacaggtgttgttaacttgaggacagcagtatcagttaagtggactagtagagcgagaagccagatttcagtgagttggaataaattggaagagaggaagaggagacagtgaatatataaaactctttgaatgagcttggctttgaaagggagaaggagagaaggtagtaaataatgagaaatgtgggttgagggaagttttttttttttttaaagttggctgaagcttgagcaagtttaaataatagtagaaaggatctgcagagaggaaacaggttaatgataatggaaagagtataaataactgataaagattgttttttcttattaaagtataatttatatatagcaaagtgtacaaccataagtatacagctcaaagaatgtgtacacatctgtgtatctgtgaagcccccctcagatcagtgtgtagaacgtacagcatcaggaaggcacttcatgttccttgtcaaacctccctgttctgactaatagatggagatgaggaagattcttgaaaaggctagaaggctggaatctggagccctggaagagagtggtagaaggattgaataccttatcctttgtcattagagggcaggaagaaagggtgggagggattaaagtaaattttgctgaagtagaagatgaagtcaggtcccagggcttccaaattcccggtaagataggaggcaaggtctgatcaacttaatggatgagggtgttaccggaggtttcattgaaagtgaaaaggattagaaattccactgagtcttggccacattttcgatgacaagctgaaatgtttttctagccttctaatctgttaatgctattttgctaacattaattaataagtagttaagaagaagtaataagtagttttgctaggcctgtgagaatttatataaaatgttcagtttaactcagtatgtaaattaacaactaaaaattaattacaactataaatgacagatgtgaaagagattaaaattgacctcttactaaaacaacttggcctaactacagaataaatgaacgagatttttcttcttgattaggttgaaaacactaggaaaaagtgtatctagaaattaatacttttaaaagcttttggccaggtgcaggtgcacacccataatcccagcactttgagaggccgaggcaggagtatcacgtaggtactggcgttagagaccagcctgggcaacataggaagaccctgtttctacaaaaagtaaaaaaaaattagcggggcttggtggtgtgcacctgtagtcccacctgctgtggagactgaggtggcagaatcacttgagcccaggaggtcaaggctacagtgagctgtgattgcaccactgcactctagtagcctgggtgacagagtaagaccctgtctgaaaagtcagccagccagccaagtccatcagtgaagggaggtagaaaggaaagtaggaagggcatgtaagtaaatgtggtaaatgtgtgtgtgtgtatgtatgtatgtacatatgtgtacctatatatagccaatactcatagcttacggtgattcctttccttaagaccatacttttttttttttttttatactttaagttctgggatacatgtgcagaacgtgcacgtttgttacataggtatacatgtgccatggtggtttgctgcacccatcaacctgtcatctacgttaggtatttctcctaatgctttcctcccctagtcccccaccccctgacaggtcccgctgtgtgatgttcccctccctgtgtccatgtgttctcattgttcaactcccacttgtgagtgagaacatgtggtgtttggttttctgtttctgtgttagtttgctgggaatgatggttttcagcgtcatccatgtccaagacaatacatttaaatcaggtacaatgctgagcattttgcagcattgaaatactttggtttgtgtaattcctcagggtttattgtattcttgtctgaatttatattgctctggcttagctattttattttatttatttatttatttttgaaactgggtctcaatctgttacccaggctggagtgcagtggcgggatcatggctcactacagcctcgaccacccgagctcacgccatcctcccacctcaacctcttgagtagtggagactacaggcacacaccaccacacctggctaattttttttttttttttttttgtggagatggagtttctcactatgttgcctacgcttgtctcaaactcctggcctcaagcaaccctcttaccttggcttcccaaagtgctgtgattacaggcatgaaccaccgtgcctggcagacttaactattttaaactagtcttaaactagatttacaggataatatttcataagtgtttgctttcattctaactattttagaacaccattttatgggagctacattactgtgacatcatacagtttagccatagcagctctggtttaggagttttctaaatatttcattcatgatgtaataaatagccagacatataacattaaaatgagaattatttaccataaacataaatgaagttgccctaataatccatttattactaattaagctttaagtctattgttaatcaaatttagaataatccattcaagttaacatttgttgagtttgtaaccatgtgcctctggtgacatacaaaaatgaataaggagaccacagtctaggaaaaaaaagaaatgtgtattactgtacaaaatataacatgataaatttcaatactaatttatatgagtaagtactgtgggaacccagagaatgaaggaaaaacaaccaaatagaattggggaacatttttcccaaggataggatggaggaaggccttgaaggattatgccttatatttgcttagtgctttacagtttccaaagcgccttcataaatatactcaatttaattctgaaagataccctagaggagggcagcacaggtatttccccccaaatttgtagatgacaaagcacacaagatagcattcattatcttaacgaaggataaccaggtagcatggctaagactgaaatgtggttcttttaactctcaagtctgtagtatttcctctaaaccatgtaatattctgggcagaagagaataccttaaataaaaacattgaggcttgcatgtgccaggtgtttttaaagaatgtcatataactatttgcctagaatatcgaacaaatggtaagagatgaagctagaaaggtaagttgaaacctgacaaagaaactgtaatttcagagtattcaaattctacactaagaagtttgaacttttaagagctttaaactagagagacaacatctgctaggagaaaaatcctaatgggtctaaagtggcttaccatagagtaaaaggcatcaagattggaaaaggagaagacagactgtattgatttgcagaagacatgataatctatgtaaaaagtcccatagaatctattaagctactagaactatttaaatgagtttagcaaggttgcagaatacaagatcaatataacaaaatcagttgtagttctgtatagaaacgatgactattcagaaattgaaatttaaaataccatttacaattgcataaaaatatgaaatacagataaaactgataaaagatttgcaagacctgtttattgaaagttacaaagttttattgagaaaaattgaagtccgaaataaatggaaagatatatagtgttcatggattggaagattcagtattgataagaagtcagttcttctcttaagtcctgtgtaaacaaattttttagaaaaagataagaagtctgttcttctcaaattcttacacagactcaaagcaatttacatcaaaactttaacaggcagccaggtgctgtgatccacatctgtaaccctaacactttgggagaccaaaatgggaagattgcgtgagaccaggagttcgagatcaacccgggcagcaaagcaagacctcatctctacaacaacaacaaaaatctcagcaggctttgttttttttttttgtttctttttgtttttgtagcaaatgacgagatgattcaaaagcaaaacaactttgaaaagggaacaaagttggaaatcttttagtacctgaatttaaggcttattataaaagttacagcagtcaaaacagttgtgatattagcatctagacaggaaaatagatcaatggaacagagtaggtaaatagattcatgctacgtgtgtttgtgtgtgtgtgtgtgtgtgtgtgtgtataaacaacagattttcgacagaggtgcaaaagcaactcagtggaaaaagaacagtcttttcagcaaatggtattggaacaatggatattcatatgcaaaaaaatgaatttcaatttgttccttgcaacatatacacagattaactcaaaataggtaaaatatgatgtcaaatgtgaacctataactgtagaatttctagaagaaaacagagaaaatcttaacaactttgggttactcaaagtttttcagtttcttagctatgacaaagaatctaataaatagtgtttctttctttctttcttttttttttttgagacagagtttcgctcttgttgcccaggctggagtgcaatggcgtgatcttggctcactgcaacctccttcctggttcaagcgattctcctgcctccacctcccgagtagctgggaccacaggcatgtgccaccatgcctggctaattttgtatttttactagagacagggtttttccatgttggtcagactggtctcaaactcccgacctcaggtgatctgcccccctcggccttccaaagtgctgagattacaggcatgagccaccgtgcccagcctagtgtttctttttgaggaaaacagttctgtaagttattgtggtaatgattctgtaactctttgaatattctaaaatgcatttaattgtgtactgtaaatggaaggattatgtggaatgtgaattatatctccataagccattgttaaaaaagttaaaacatgtacctaccatgtgactcagccattccactcttaggtatttacacaagagaattgaaaacatatgtccgtatgaagacaaatgttcatagcagctttatttgtaatagccaaaaactagaaaaaactttaatgtctaccaacatttgaaaggataaacaaattgtggtatattcatatgatataatattacttagcaataaaaaaagaacaaactgttcttactgtatggatgccttgagtggaaaaaggcagacaaaaaggatacatatagtatgattttatttatatacaattttagaaaatgtaaactaatatataggacagaaaacaggccagtgttttcgtagagatggcagggaaggtcatggggaggggcaagctggaggacttatggtggaacaagaggaaacttttgggggtgatggaagtgttggctatcttgattgtggtgatttttcacaggtatatacatatgtcaaaacatcaaatttaacaccttaaacatgaaatttatattaatgatatctgagaaagcagtttttaaaaatatgaatggattcaacatgattttaatagatatataacactgtcaagtctgtgttttagaaaggtatggaaaatggattggagaacagagacacaactaccatattcatttattcagtgagttaagtgatttctactatgctagacagtgggggtcaataaagctcacggacaaatggaagagagatatgtaaataagtcattatttacatataaataatttatctgtagtaagtacatatacttatgtattagctacataattaagtgtcattatgcatatataatgtatataatgctaattatgacagttatgtatgaaataactctggcttgggttgggggaagttagaatcttgaaggatgagtaaaaatcataataatcttgagtgtgaaatgaaaaaaagcctgaagtagggcagtgagggtgggttgacaaattagaagagtctttaatgacaaattcagtagtttggatgtggaagtgtaaaagaggtaagagccaaagattttttatttagaatgactaaatttttggtggtgtgaataatagaggaatttaggagaaggaggggatggaggagaaaagttcagttttaaagttgacttggaagttcccatgggacatccacttgaagatatcttgcaagtagttgaaagtataggcatgttgcttcgggaagaagtcagcactgagatcatagctcttggattcattattgcacagaggactgatcaaactataggagtaagtgggcttattcaggaagggtatagaatgaggaaagaaagccagtgatgaaacttgaggctgtcctcagtgtttaaggaacaaggaccaagaagcagagggagaaacactgtgaggatggaggatgtcacactgtaggatgaaaatgtctgggagaagcaatgaaattgataaatcacctgacatgtttaccagttggaaaatagtattcagagaagatcttattgttctgttagagagttcaaaaaaactgtgtaacaggaacagaaaaaagtaagccaaaaacaaaaaaagtaatgattataggagaataaaaagtttacaaaaaaggaaatttaatcagcagcatgctgcatgactcagatgtgaaatatttaaacataatcataatattataaacattaaataaatttaaataaagattaagctataacagtattggtagagtaagaggctacagtgaaagagaggtcaatcttcatttcccatagccaaaagccagtaatgtctaaaattgaaaaaattcaagaaaaagcagtataaatatgttattcagaaatataaatggtgatatagaagaaaccaggaagaatggcaggtcaggagtgaaaatcagggcataaggagccatgagataggggaggattgttttccctcattagccatatataatgctatttgtctttgtaaaatattttcatgtaacttggataaaattaaaattaaaaagacaacttgccagtcactggaaatagtagctgttaatttgtagaaaatgccttagctgtttagttagatgggcttaattctgaaaatgagaatactatacaatagttttcatctctttccattgtaaatgtgtgaatttctaagcactgttaatccttctttttatttccgtaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgagtaagtttttagctaacagtaaagtttatatagatctgcaaatgtgtaaatacctaatatataatggtgtcagcctactacttcatcatagtgtaatccgggttgtactcttcaagactactttttgttccagatttaatactgaaatttagtaagtgaaaacatgggtcagtagtttgttaataattatttcttttcccacaaattgtgtgtaagcacagtgtatataatatgtaagttgataaattggtagtacttcattaagttctaaacaaataagtatacttatatcaaagtgttatatttgcagaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacaggtatgttgtctgttatttttgtgggctttattctttgaatttgctcctgattaaaatagaatgaaaattatatacaaaggaccattcactcatttaaccagagtttgtagcattcagtttctttcttattcacatgtgatgtgaagttgaagaaatgactattacttagaggtttctcaacaattttttttttttttttttttttgagacggagcctcactctgttgcccaggctggagtgcaatggtgcagtctcggctcactgcaacctccggctccctggttgaagagattctcctgactcagcctcctgagtagctgggattacaggcgcctgccaccatgcctaatttttgtatttttagtagagacggggtttcaccatgttagccaggctggcctcgaactcctgacctcaggtgatccacctgccttggcgtcccaaaatgttgggattacaggcgtgagccactgcgcccggcctaggtttctcaacaattcttttccataataccaagttgctagcagctaaggtttctaagctcaaaatgttatttttacaaatctcatgatatattgttcttgatttgtagttattataataagaagatgagagacttgggcttgacggtttttttttttttttcttaaagttatttgggaacgttagaactttttaacgtatatttagcctctgatttagatataactattgcaatagggttacattaacattatttttttaaattgcagacttcatcagaataaagtccaaagtcctccagatttcaccttcactcaaaaaatgccatggccataggttccaggcattttattatgtgctagaaatttaaggaaaaaataagtcaaaaaatacctgacattgacaccaggcacagtgactcagtgcctataatcccagctctttgggagtccaagatgggaggattgcttgaggccaggagttcaagatcaacctgggcaatacagcaagacctcatctctacaaaaaatttaaaaattagccgggcatagtggcatgtgcctgtagtactagctacttgggaggttgaggtgggaggatcactttagaccaggagtttgaggcacaattaattatgatcatatcactgtactccagcctgggcaatagagtgagccccgtctctaaaacaatttttaaaaaccagaaactcaccattcagtagatcataatctaatgaacatgacagacatataaataactgtaaagcatgagaaatgctgtattaaagatatctacaaggtctgtagggggtatatatagaagagatcatcttactcaattggtgagaattggagcagccttcacaaagggcaaggtatttgagtagggtcttcaaagataagatttcacccaacaaagaaggaaagttattcccatgaaagaacaatttggggaaagtcaccgaggcatgttaacacaagatatttgcaggaaacaagcattgttaataatatggctggaatacaggattcatggagaaagggttaagcgaagttggagagagaggttgaggtttatttgggaagcatttaataccgtgctaggcaacttggcagtggaaagtccctgaggatttttaagagtggagttattgtgtatgttttagaaagataattctggcactaacataaagtctggattagcagaagaaaacaaccagttaaggaaggatattacaatagctaaataacaagagatgatggtttgaacaagtgctatggtaattaagatataagaaagaggagatagatttagaagattattaggaaatgatattaaatagataatccattgaatgtggagagtgaggaagaaataggagttaaagataattcttcagtctttagcgtgagcaaccaaaaggatagtagtatccttgtctttggtagacagtgcaggaggaatgggtttggtaggttctaaaaatgattatgtttcagccatgctaagtttaagctatgtgtattagggacagcttggtagaaacacccagtaggcagtttgatatacaagtctggagatcaggagataaaattacactgaaaatataggtttgagaagtcataggcataattaagagtatttagggaagtcctgtggaacagtaagggaaaagggttggacaaaagaggagccatcaatcaccagagagtcagcttcaggaactacaaggcttgatgttagctgtttagagatcaagaggaataagggtttggaagaagcatttggctttgatgttattattaataaccttgtctggaagaggttcagtagtgtgatgagtgctgaacctaaattagaagtgatcaaggagtgaaattggaaaaaaagtttaagactatcatttaaggaattcagaagtagaagcaagtagagaagtagattgaagagaaggacttaaatatttttagaaaatgaaagggtataatagaagacttggagaataagtgaagagtttagccttattaaaggaacaaaacactccttcctttgagagaggagggaaagaaagaagaatgaatagaatagaataggaggaagttaagagaaaagcagagaaacagagggagccaagcatgccaatttccttccctagtggagtaaacagaattacattgcaagctggaagagaaaaaagatttacagtaacattcctttttcatttgttccatgatatgtatttcatggatgtgtgaatacatttcttgagtacacattatttaccttctctaccagtgatgtgatgaggtttctttgaatggtgggttttcagtctgtcttaacagaaggctagtcacatagttgtctatcatgtataatttaaagtcagttagtagactaaggttatcttaagtcaccacgacacaaaactggtctgctgtttgaacagtaagtatgttatatacacagaaacagaaatcatagttaccattgccttttaaaaatttttggtggttttgtattcatagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagagtaagcatctttatgtgttttcatgagatgtggatgttggtattttcactaatgagtcagccatggtctgattgagtgtataataaaataacaattttatacttgagtttgaatatcagaaaggtaattctggccggccgtggtggctcacacctgtaatcccagcattttgggaagccaaggcaggcagatcacttgagcccaggggtttgagaccagcctgggtgacgtggtgaaaccctgtctctacaaaaaatacaaaaattagccgggcatggtggtacatgcctgtagtcccagctacttgggaggctaaggcaggagaatctcttgagcccaggaggcagaggttgcagtgagccaagatgacgccattgcactctagcctgggtgacagagtgataccccgtattaaaaaaaaaaagaaaaaagaaaggtaattcttaggatgaaaaaagcatgcctcaggtatttgtttcagtttagaatatctttcattctagttatttcagatttcataaaattttcaagctactcaaaattatagatctgttgctttttttgtttttgagacagggtctcactctgttgcctaggctagagtgcagtggtggatcatggctcactgcagcctcgaccacccagccttaagcgatcctcccacctcagcttcccggctagctgggaccacaggtgcacgctaccatgcctggcttatttttaaattatttgtagaggtggggttttgctgtgttaccccaggctgtgttctcaaactcctgggctcaagcgatcttcctgcctccacctcccaaagtgctggaattacaggtgtgagccacctcacctggccacttctttgtaccataaatcagttagaaaagttacttttcattttctttcaagcatttctcccctgtttactataaattgtcaatatttaagtaactctttactgagggcctcctctttgccaaattggggcattcccatttctgagtctccaagattccctgaatataacttctcttattgcttatagcactctgcattatagttactgatttttttaaaccaatgtcccttattagatcataagctcaatgaggctgggatgcatgtctttttttttatttgttcatttttcagtttcttcatgcctgttctaatcctcatgcatagtagctgctcaatcatattagctgagtgaatgaagagaggcgtgaatgaatgaacaattgaatgaattttcaaatgaaaaaagctaaaaactagataggtctctgacctttatttcctactctgtagggagtcaagttgtcgaatataataatacaaggaaataagtactataatatagctatgggtaactgtctcttgtgttttatatggaagttggtagaaaagcagtctgatttgatgaaaagatgctggtcttttgcaatcaagaggcttgagttttggctctgctatttttgccaggctgtaaggaataacctacttaatcttcagttttctaattgactgaatgaaaaggttaagccaaataatctttaaagaccctttcactgctgagtttctgtgtttctggaaggtagtgctgtttctaaaaatttgcttttcagcctgacatggaattttggattgattgattgattgattttgagatggagtctcgctctttcggccaggctggagcacagtggcgcaatcatggctcactgcaacctccacctcctgggtttaagcaattctcctgcctcagcctcccaagtagctgggattacaggcatccaccaccatgcccggctaatttttgtttttttttgtttttgagatggaatttcgcttttgttgcccaggctggagtgcaatggcccgatctcagctcaccacaacctccacctcccgggttcaagcgattctcctgcctcagcctcctgagtagctgggattactggcatgtgcaaccatgcccggctaaatttttttgtatttttagcagagacggggtttctccatgttggtcaggctggtctcaaactcccgacctcaggtgatctgcctgccttggcctcccaaagtgctgggattacaggcatgagcctaatttttgtatttttagtagagacagggtttcactacgttggccaggctggtctcgaactcctgacctcaggtgatctgcctgccttggcctcccaaagtgctaggattacaggcgtgagccaccatgcccagccctttttatttatttttcaagacagagtctcactctgtagcccaggctggaatgcagtggcacaatctcagctcactgcaacttctacctcctgtgttcaagcgattctcctgcttcaacctcccaagtaactgggattacaggaatgcaccaccacaccgggctaatttttgtattttagtagagacaaggttttgccatgttggccaggctggtctcaaactcctgacctcagttgatctgcccgcctcggtctcccaaagtgctgggattacaggtgtttgccaccacacctggccgaattttggatttagaagaatataataacagtaacaacaaccatatatagctggcatttgtatgcatgcactgtgctaggccctttatagacaattcctttatagaaattgtcttattttatgtccataacatttacagagaagaaaacttaagcaaaaacagattgtttcagtgttttagagggcatttcttctaactatgcattcagttactagtgttttctaacagataaggcatataacttgaaaacctgcagtaatggagaatttagcattaaacaagacagtccattcagttgtgaccagtagttgtaataaggttccccttctgtttatttaaaaactgcctcacagtgtaatttactcacaggtcctggggaggcctggtgcatcccacaggtgtctagttaaacaggacagtcttctagatttttgaaaacagattcctgggttaaaatggaaattaatgttatagctgttctgagataataaaaacaaagttttattatttttatttttttaatgtagtgcattctaaacaaataataaaatgtatatattgcctttattttttcctacactaaactaagccctatatgtgcttaccacttaacaatttgtgggtgtcttttaagtttctttagaaaggcgaaatatctcacatttgaaaaactatttgtaaatcatattgaaattttaaaaatatatttaaaaatgtagaagtttataattaggctgttcttaatcctgcaggatgttgtgtataagtcttcccagttctgtgtactaagactatatttaatttgagaaagccctaaaaaatgcactactaaaacctgctgtgcatcaaatcacctttcttatttttgcttgtatttgtttgtttgtttgtttgtttgtttatatatttggtagaccagaagctttgtatgcagctgtaaataagaaacctacctcggcagcctattcagttggagaaggtaagcttttggcaatttgtaaattagatggtaatcaatttagctcttgactaactacctgacttcacatagttgctgttcttcacatagttgcatattctccccatttctgtgtctgcagtattaaagtgagattaggaaaacctgcccctatctatttcacatgaatattgagaatatagaaaaaatatgggtgaaaatacttggcactttagaaaggcagtgctatgaaaattcagcatagactggtttgatgaataacatcataaataaaaagtgttgcaattattgattatagatgtttaggaggtaaggaaatttcaatacatttcattgcttatacattttaattacaatgtaccatatgaatcattaaggaggaccaaggtatactttatcataagtattgcaaagaatttttttctatatccctttgggttgtttgattagtaaattattttgattttgttaatgtgttgaaaaatgaaagattaccctaatttcagaggatatttttatttaatagttacatacatttataaatgaaatgtataagtccattataaagttagttgaatagttgaggtacattttatgttttgctaaaaatatcagtttaatgttaaacaatttattcagtatctgttacgttgaagattctatgctagagcctggaaaatacaaggatgaataaaagtttccaaagtgctcacaatagaatggagcatacagttgtgataaattctttaatgagcgaacaaaaccaatttagagtaggacatatgaatccacagagatggcagtgttgcatcatcctaaacaatgagtaggatctagcagagtgacaaaggatgagaatgcacttctagacagagggaatggcatgagccaaggaacgggggaacgtcatgtcaccagtgaagctgaatcataggtgtactgtggaatgagtgctctgagctgagcctaggaaagtagtgaggagcatgttggaaaggacccgacttttattgcagcgtacctaaagtgattacaatcactttgaattttgttaaattaattgagtaatactgggaatgcgaatagtaaataggttgtaggtggtgtttctcatcgtctgaagtttatgatattaagatcaaattccatgttggccaaatataaataaaactagaaagaaagaaaaagacttagaaaaccaagtcaccaactgtttcttctaagcagtgacaatcacagaaacaaaaatcaaaggcgatataaaaatttagatatttcccttgaggtcatttgttaacaactatttatcgagcgtctactccaagtcaagcactgtgctaggagctgggtcatcaggatggagcttggcttctagtgctgctgtcttctgggtattgagtgtttccataactgtgtacttaaaagaattaaagagaaaataatatagcagattaaactatttctggtataaaaaagttaaaaaatatattttcctatcttgactccattatctgaataactgagtgacttaatctcactaagcctcagtgtatttatctatagagatactattatctgtttgtagttttgggtaattctttgtgataaaaaaataaacaattgggaataaaagaaactctaaagttttatgttaagtcaaataacttttttctaaggaattattaaataattgcttcgttcctttttctacctttagatctttttatgttaggtttcctgaaggcacaaggtcttttacagcaaacttatacaatgtcttggagaataacctaatttctttttcacttctgtaatcttaaaaccagaatctacttctttttgctttgttccctacagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagaggtattttggtattaaaatcaacccattctggttaatcaggtttatacttaaattattttggtattaaaaataaaatcaacccattcttgttaatcaagatttatacttagagatcatgtttatggttttgatcaggttgctttggttacaaagaaactgttcacagtagctccggtaaaatagggtttattatatggctccagttagataaagggggcaagatttcatgaaattctaagaacaagagttgtagggtagggttgagcttcatgataactgctaggaagtagatctggattcagagaaacacaaaaaggaccaccttgaagtagttcgccaattttcactttaagactgtaacattaatgtgactcagcttacatgagctcctgcctcatttcatccaccaccagtatggtatagtgcagaagttctctttttggtttcaggaactttacagtcttaaaaattattgaggaaccccataggcttttttaaagtatgttcagtatagctaatgatatttaccgtatcagaaatttgaaaagcgaaattatatatttattcattttaaaataacaataattaaatccattacatggtaacataaataacgtgcttttatgaaaaacagccgtatttatcatgaaaacaaagtttagcaagacacacacacgtatatatacgtatacatacatatgtatgtgtatatgtatatgtgtgtgtgtatatatatacacacatatatatacacatatatacacatatatatacacatatatatacacacatatatacacacatatatatatacacatatatatacacatatatatacacatatatacacacatatatatatacacacacacacacacacacacacacacacacacacacatatatatatatatatttttttttttttttttttttttttttattttttttttgagatggagtttagctctgttgcccaagctggatctcggctcactacagctccgcctcccaggttcaagcaattctcgtgccttagccccttgaatagctgggattacagccatccgctaccatgcctggctaatttttgtatttttagtggaggcggggttttaccatgttggtcaggctggtcttgaactcccaacctcaagtgatctgcctgcctcagcctcccaaagtgctgggattacaggcatgagccaccacacccagctaatttttgtattttcagtagagacggggtttcaccatattggccaggctggtcttgaactcctgacctccagtgatccacctgccttggcctcccaaagtgctgggattacaggctgttttatatttttgcaaatctctttagtctgacttaactaagtcagctactttctcatgtctgtttctgtattcagtcggtgacattttttttttcggttgaagtataaaaaaattcatcctcacacatacatgagagaaaatgaagaagtattttaatagcatttgcagatatctaccaatgttcttttttattctaccacactaaaacttgacaaatgctgaatcgttacaggttagttgcaacatggaatctgaagccctatcggtgaacagttcttactgttacattaaaattcactagtctgttttgcatgttgagtggatcttttacccgtgcgtgatgtgataacattatttgttgtttatttggaaaatattgaatcactgagttatgcagatattccctgtgtggacacatttcattacacagtatctgaaaaatcgtatgtgttaataccaccactcatcagaaaagtttttcaatactaggaaactgtcagactcatagtggtaggtacaaattttctaaaattttaattttccctggaaatcttgaattttatcattggcaaaaaatcctgccagctgttttccttgaagggacaggcttacttcatttttaagaaaatgttcgctaaatcccaagtctaaatagtttttctgttggttctttgaagtaaaaatgttgttccatgaaaaacctagttgagtggacaatttagtcacacaaatactttccttaagacaaccgtcatactttagtatgcagcacagatgttttaggcacacttctgtttagtcacacagaacttttaaaaggtatggacttgaagattaagatttaataaaatttttgctgtttcattaaagacattgttaagtgaaactggctttgttttactgtgagtgcatggcggtgaagaacactaccatacttcagtgtcatttggtgccactgccatgattcacactaaagcaccaatgattttacccaccactgtaaatgtcaacacagtgaagaagacaaataatgtcttagtatttttatgaagatagtttttatcccacagacccctgaaagaggctcaaggactatttccaggttctacaaaccacatgctgagagccattggtgtagtagaatcagactgcctgggttgactcttagctgtaacacttagagcctgggtgaccttggacaagttactgtacctttctgtgcctcagtttccttctctgtaaaatggggataatcataattacttaatagtgttattgtgaaaattaaatagcagaatatatggaacctcttagagcagtgtctgttatacagtactcagaaaatgttagcttttaactaccatccactctgcttaatacttgtactgcagctatgttcactaacagaacaaaattctttttaatcccatcccttttgttgttcaaattcctataaagaggaaatgtggttgggccagtttatcctttaaagtgaaacagaagtaatagttgctacacaggatagggattttttgttcttaggtcagattcagtcagtttggggggaggatggtaaaataaataaaaataaaaacattgtctcctgttcatcaagatccatagataagtcaggatcccttagagaaagcaggagcaaaataacatataccttgacatatccaggacacatatgttgtgcatagtgggcattggtgctaacgccattgataaatggagtgcatttggcctggagggtcatgtttaatatttaggtttcagaaaacgagctcttcctgttgagtcaatggttgacgatgacagccactcgtatataatgtattacattagcagaccagatctcctcataagtgttggatttttcacttatttgttaatactgcatgaggttcattgtcattttcatcttcatttaaagagaaaagaatcctgggaatttgaaatctctaattcccattaacctttatacttttacatttggattgttggaaataataaaacaacacggtatcttttccttgtagagttttgggagtgctagcaagtctggagcatcaaataaaaaacctggtacgtatagtagtgatcttaaaaaattactaacgtgtttgctctgtcgcaatcttgaattcatagtttcttctttgtcttttcagagattgctcaggtaacttcagcatatgttgcttctggttctgaacaacttagccttgcaccaggacagttaatattaattctaaagaaaaatacaagtgggtggtggcaaggagagttacaggtaatattctttaaatagcatctataaattttattataaaagtactgcatgctccataaaaaagataaaattaataaaaatttttagatcacccataatcattccacttagaggtaatcaatatcaatattttactgcattatatttcctttagtctcttgtgtgtacatttttagcacagttgagttgatgttataagtaacaatttaaggaataattttctccaaagacataattgttttccaataatgcattcctttataattcacagatcatgttcttaaagaaacagcatcatctttccctgggatagtcccaggcttgcagtatagcctctaggagaaagacataatctagatggtgtgctgagaaaatactactaattgggctgtccgctagtggtcttaggtttttgaaacagcagtgcaattaaagacaatacagacatagatgaaccttttttttttccctaaaacgttaatagatggttattgcatatgttttgatacaggaaaagggttcttctctcacttctattatttccttactagttaaaactaaaaagcattttagggattaaaagatgacaagagatataatagctatatttttatatgagtgatatataattgtagtatggaggataaacatagcttcattcttgcaaatcaggagtcttaggattcctgaagaaaaatgggggttcaaatttaataccttcttgaataaccccctgaaattccaccttctgatttactttgaagatggaccgaactaagtgggaaacatgactctttacaaattttacttctgacctcctgattaatgattaacaaagctccaagaagtatttgtagtcggctgcaccattttaagggttaggagaactctagaaatgtctttttagaatataaatatttttgtgaaatattccgagaactctgagcctgaaagacctccacatagacttcttcagatgctgttttcagcagtagtttgagatgcatgttttagtgtgtcttccagttgtttaatgtttacttgaaaggctaatgctgagttcgaggcccccaagatcatgctcatatttgaaaccaattccaaatttgggggtcttcaagactactctcaagttctgtaagtcactagaaggactttacagaactcactacagctattacactcatgttgcagtttattgcaatgaaaggatacagattaaagtcagccaagggaagagacacatggggcagagtgcagtagagttccaaaaacagagcttccagttgtcctctcctggcagagtcatgaacagtattaactcctcctggcaatgatgtgtgacaatacacacagagtattgccagtcagcaaagccttggtgtgcagttttgactggggttcctcacatagatacagttgattgcccgtttttctgaactcagtctccatcccctaccaaggtagagctgatactgcatgacccaaagcacatcacattgttagatttggcatgacccagtacccacaggtaaactaagacactctgaccagtcaggatagtccaaggatttagagattactttccaggagctgagggcaaaaaccagacctctctttaggcaaaattaaattatttactacacatttatggtttttctaatttttaagttatgtctcaatgattgtttttaatctcatctttcaattatgtatttcttttgctaatttttaggccagaggaaaaaagcgacagaaaggatggtttcctgccagtcatgttaaacttttgggtccaagtagtgaaagagccacacctgcctttcatcctggtatggaagtgggttaatttgtatttcattttagaggagtttgttaaaactcagcaacttcttagattagctcaatctttggaaaacattaaaaatgtgttctttccttatgtctgcttaaaagggacatgccactgagaatttcctttctgaaaagttcagtgtaggaacagccagcttattcactgatacttgaaccacttcgactctttgaaatctttcaatgtgaaattgttacaccatcatacttaaagtgaagtacttcacttggattgttaactgcagttgggaaattcttgtttttgtaagaccaggaataggggaaggagggtgagaaagagcagttcaagggaaattttagcctaattttaatatttaatattaaaataatttaaatcctagggagattacaaatgattgacccttgcaggaataattaatttgtttaatgtgttattttgttattcttgtgatagtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgtgagtaatattaaattatttttctctcacctagtgtgaaacttcaatatacagcactgcatttattccttttctggattagatcttaaactcagcactcacagcaaatgtagattagtgtttaaagtgagaagaaacaaaaggaaactttttacaaggtcagaagttatacagctttattttaaatacttgctagctccagactttcgtattagacttaatctgagagtatataatttttcctatgagttctttggtatgactgccatctatactgcagcttctttttactatcatcctctttttcagtgtcccatgttcttttttggtttaataaaaagtagctagtggctgggcgcaatggcccacacccataatcccagcactttgggaggccaaggcacgcaggatcccttaagcccaggaattggagactagcctgggcaacatggcgaaaccccatctcgacaaaaaatagcaaaattagctgggtgtggtggcacgtgcttgtagtttcagctacttgggaggctgaggtgggagatctcttgaacccgggaggttaagagtgcagtaagtcatgatcacacacactgcactccagcatgggcaacaaggtgaaaccctgtctcaagagaaaaaaaaaaaaaagtagccagcaattaccctattcacctattcaaaattactcttttagtgtacagaagccattacatttctaaccttctcatttatttctcgctgtttacatatcatccatgttggaagaaaattaaaaattaaatatttgactgttgcaagattcttgtcaggtgattctttagatagtcacctttttccacaagggatgtatcaatcaaggtctgtttcattattttcagaacaagggtccagatctcgaagtgtgaagtttggtactatataaaattatctctctgtatttatctagccgttcttttggttgacagtaaatatagcattagtaataaattagggaatgaatagtacttggaaataactttttacctttatgaaatgattgtcactttttcccactcttttgatttttagttttatttttaaaatatctcatgatatatctcttatgaaatttaaaatacttagcctttcatttaaattcagttgctgagaatatataaaaggtaacccaaacaaaactcagatacacttatgattcagtataaggattatgaatttataccatatctataattttgtgcattctcactttagagcttataaagatagttctgaccctgggagaaaccttccctttacataaagcaactaagtttcccaacttggagatgggaggaatccagttttttgtgatttgaatagtcccaaaaatattggagggtttcagaagtgataaagaaaattgtaacttgggttgcctaataaatgatcatttttaagctctgctgatggtttggcagttcacaatgattaattagaaaccagtttatctaactagctgtggcatctttcttggtgttgagaatggaaaagacttttcagacctactgggtttggaagatctttggctagtgatccctgaaggcatgccggtgtgtcagtacatttggcttctatagcatctatgatctaaagtgatggttttctgaatatgttgttgtggtttgaaacactttttccaattaagcctcatagaatagggaatataaagaacagataaaagctgtttgaaaggaaggacaggaccatggccccaggtcttatacctttcccccgcctattttatgaaggtcctttcagtttcccctctgcagataatttaaaaattactctagagaaatctacttcaaggcagtaacagtctcctagaaaagtaactttcccagagagttaattgagtgacaattttttattccaaaaagaagcagcatagtttctggttgtcagtaaatgtttaatacactaatgatacagaaaatagattgatatcatctgttagttattattcaaggacacatttgtcatgcaaattacttttgcccagaaaatgcttcgtctgctattttagtataggtggaactggcagagccttagtctgcctgtagttgagagagatacccaatctaaacagcactatccagtagaattttatgcaatacagaaaacagtctatatctccactctccaatacagcggccactagtcacttttgattatttggagtgtggctaatacgactgagaaactcaatttttaatttaatttaactttaattttaagctaaatagccacttgtggcctgtggctcctgtattagacagcatgcctctagaagacaaccaattgtaatgcaagccctccctgaaataaaacatggaaatagcagggctgggcacagtggcgcacacctataatcccaacactttgggaggccgaggcaggaagactgatcgtcaatatagggagacctcatctctacagaaaaatttttaaaattagctgagtgtggtggcatatccctatagtcccagcagcctgggaggctgaggtgggaggctgcagtgagccatggtcatgccactgtactccagcctgggtaacagagtgagaccctgtctcaaaacaaacaaggaaatattgaaagattaagaagaaaaagaataatcgtctttcggtcattattgacctacgcaatgattttatagctcctatgtgtttcaggttttactcttttggggggttttggattctatgttaacattcttcccactgttcatttaagaaattcatcatttggtattacttgagtgtctactctgtactgactaggagtactgggaatacaaacaacacaagacaatccattctctgaagtagctttagaggttagtggggaacaacattcagataaatataacaattgctgcaatgaatatttatacaaatatgttttggaaaaagaccccctaaatctttgtggagaaagaaggcatgttgtgaaagatacaacagaagatatttgagctggtacatgaaggataagtactaattgtttgctggaagggcaaatgttggggatgcaaggaggaactcatcattttcttggtcattttacatactgacagctgggaaaacaaaatgttcaagaggttattttataaaataagagtagtttcgaatttctctttgttataaagttattaccagtaacttacctattaccttgtttctggcgggtatatgtgggttttttttagtttaatcagatctaaaaactgaatacttttattgttttgcctaaatgaatggctaaaggcttgtcatctatcctggaataaaagggctctcaattctgtaattctaaggataaattctaaagaggttcctctgagatggtttattgtttctataaaacaactgtttaaattatctaggaaagtgaggcgtaccgattttgtttacttgaagtaattatttatcagaaattgaagaatcataattgctttttcaaagaagatgaagattaatgttaattgtgttggtagctatgaactcacattgtttatataaacctataattttaataggatatggttcagaaaatgcttaatccttaaagtcaggaatagatacgagatccttgttgtacctacccagctttttatagatgaatcacctgtttgtagttcttgtaatagtcaatgaaagctagttaaattatagattaccatttgtgtttctttggcccttataagtattatttttcattttgttacataattagaactttttttaagatagagaattttaacagttcaaatttgtttagttgatgttgcatgttgttactagtcaaattttatctcacccacctaatttgcattatgttcattttattcctcattttctttttttaggacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaagaactggaaacagccatgccctgttttctgtgtatttgggatgggaataacaacattttgggggagctttttaaatctcagagaagaggaaagtggcctgctctggcaggtatgtgcagtgtttcatttgttccagtcccaagaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgcgggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactatattagttgtattgtgtatttcttttgaaacattctttaaaacttacttttaattgtttttatttagtcatgattaaatgtctttggaatgtctctttttccttaatgtagtctcatgagaacaggccagcaaattgttttatatcatagggggcaaaataaatgtataagtggtcaagatgaagataatttgattggagataatcatatgtatctcaaaagtgaaataaagtttgattttaatacattgttgctcacaaaagtaaggaaaacataatctagggtaatagacttgtgtttttataagttttactgcaacttttttctaaaaagattggatggaacttacaaattaatactcattgcaaatgtagagtaagacttttagtacaaaataagagtttatgtaaaagaaacagcagtgaatgcttggaggtatcaaagttaagcagtgttaaagttaatcatgttggtggtcgtataagcccttgggtggaaagaaagatatggatctaaatccagtccatctgtcaacatctagcacaaacaacctctttccaaaaagcctttcctcatctccggaaacttattcaactaacatgtatgaagtgtttacataaggctaagcaggtgctggggatacaaaactgagtgtcaagtggccattgtcttaggtggtacatagttctttgaggggattaggcccatatgcagataattataaaacagcatattcagcacagtgatagatatttgccaggcacttaaggactacagagaaggaataccaaattcagccatagattggtgaacgagagacttgctggaggaagcaactgccaggtccataagataagtagcaataagccagatttggtgggtaggatggtggagtgtatgataaagacaagaaatggcatggtggggaagtgtaattataagcatttcagtatcgtcagaatggaaatacaaagccaggaactataaaagttgaggcttgagaggcaggccaagggctaagtcagaaattctctagctcagctgtatgttggaatcacttgggaaacttgaaaaatctatagtttccagggtcctaatttaaatggattgaagttcggcctgatcgtggggatctttcaaagcctcccatatgattctgatatgcacccaaggtggagcaaaaaatgatgaaacggagttctgagggaaaattggcaggaactggagatagatggaatatgagtgtcggtggaaaagtcagttatttccagatttgtgtcttgagggacaggatgggataatggtgccaccaactgcagtgaagaattagagttgggggaagaagaggagtttggagcacctatgggatgtccacatagaattgtcaagcaggtggtcagataagatagacaacatcagatgtacaccacctggtggaatgacatacatattggtagttgttgaaccagtgaaagtagatgagattacttgggaagaagatcagacctagaagatcagcagttaagggctggatagtgaaaggaactcacaaagatgggaaacagagaggttatatgagaaagagattattgtgctattttcatgatttttaaaaaataatgaaattctggctctgcaaccatctctcacaccagtaaaaataaaagaggaaaagtgctcttttttgaggacttcttagtttagatacttttctaaggtccttgaatgtattacctcttcattgttttcttttttgagatacagaaattaaaacagattagataatttgtccaagtggaacctgctagtaagcggtagaggtggtccatggtctggctcccaagtccatgctgttagcctctacactagtgtgctgatattgccaccatctcctaataatgaacttcggcactacaaccgttactcataccagtgaaacaaaaacaggatggtggctcatgcctgtaatcccagcacttttgagaggccaaggtgggtgattacctgagcctaggagtttgaggccagcctgagcaacttggtgaaacctgtctctacaaaaaaaaaaaaaaaataaaagatagatagatagatagatagctgggagtggtgctgctgcacgcctgtagtcctagctactcaggaggctgaggcaggcagttcaattgagcctgggagatcgaggctgcagtgagctgagatcacaccactgcactccagcctgagtgacagaatgagaccctatgtccaaaaaaaaaaaaaagaaaaaaaaacacaggaaaaatcagagattgcacaggcttttctctatgtaaaaaggacacacagagaagagtcaaggagtcaaagactgaacataataaacaaggacaagactctatgacaatagtatccagaaggataaagctgaatgtaatcactttttttggtaacagcttcattgagatacaattcacttgccatgcaattggtggtttttagtgtattaacaaagttgtccaaccatttccacagtcacttataagacatttttatcacctcaaaatgaatctctgtacaatttagctatcacccccatttccctaagcccccctccagccttcagccctgagcaggcactaatcttttgtctccatgtttgtctattctgaacatttcatatgtatggaatcataaaatgtgtagcattttgtgattggcttatttcacttagcataatgttttcaaggttcatccatgtagtagcatgtagctgtacatcattcctttttatggccaaattaacatcccattgtgtggatatgccacgttttgtttatccattcattagttagtggacatttgggttgtttcaaccatttggctattgtgaataatactgctgtgaacatttgtctacaagtttttgtgtgaacatatgtccatgtttcttttggatatatatctaggagtagaattcccaggtcaaatggcaaatctatgtttaatttgttgaggacctgcctcactggctgcaccattttctatttccgccagcagtgtacagggctttctgttactccacatcctcaccggcacttgttattatctgacttttattatagccatccagtggacataaagtgacatctcactgtggttttgatttgcatttccctgatgactaatgatattgggcatcttttcatgtgcttgttggccatttgtatacctcctttggagatatgtctattcagatcctttgcccgttttaaaattatttgtcttcataatcacttttttaaaagactttattttttagagtagttttaggttcacagcaaaattgagaggaagacacagagatatcccatatgtcccttgccccgacacaggcatagcctcccccattaacaacaacccccaccagagcagtacatttgttacaattgatgcacctacatcatgtcattatcaaagtctgtagtttacattagggttcagtcttggtgctgtgcattctgtgggattgtacaaatgggtaatgacatacagctaccatcacagtatcatacagagtattttcactaccctaaaaatcttctgtgctctacctgttcagctctccctccctcccatcccctggcaaccactgatctttttactgtctccatagttttgcccttcccagaatatcatatgattggaatcacacagtacatagccttttcagattggcttcttttacttagtaataggcatgtaagtttcctccatatcttttcatggcttgatcctttcgttttagtgctaaataatattccgttgtctgggtataccacagttatccactcactgaaagatattgtgattccttccaagttttggcaattctgaatgaagctgttacaaatatctgtgtgcaggcttttttgtggacataagttttcatttcctttgaatcaataccaaggtgtgtgattgctgctggatcatatggtttaagagtatgtttagtttgtaaatggcaaactgtcttccaaagtggctgtaccattttgcattccctccagcaatgaatgaaagttcctgttgttccacatccttgccagcatttggtggtgtcagtgttacagattctggccattctaacaggtgtgtagtggtatctcatttttgttttaatttgcattttcccaacaacgtatgatgcaaagcatctttttatatgcttatttgccatctgcatatctttttccatgaggcatctgttaaggtctttggcccatttttttatttgttttcttattgttgaactgttaaaagagtcctttccatattttgaaaaatagttctttatcagatacgtcttttgcaaattttttttcagtctgtgccttgtcttctcattctcttgaccacatcttttgcagaatgaaagtgtttacatttaatgaagtccagcttatcaactctttctttcatggattgtgtctttggtatcatatctaaagagtcatcactaaacccaaggttatctagattttcgcttacactattttctgggagctttatagttttgtgtttcagatttaggtttgtgatgcattttgagttgatttttgcgaacagtagagacctgtgtctatatttcattttaaagacaatttctttttttttttttcgcatttggatggccagttgttccagcatcatttgttgaaaagagtatctttgccccattgtattgcctttgctcctttgtcaaaggtcagttgactctatttatatgggtctatttctgggctctattctgtttcattgatctatttgtgtattcttttgccagtatcacactggcttgattactgcagctttctagtaagtcttgaggtcaggtagtgtcagttcttcagttttattcttctcctttaatttttttgttggctattctgggtcttttgcctctccgtataaacttttagaatcagttttagaatcactttttaaactttgctttaaagaacaacaaattatgaaggacattcttaagagagatgttttaagcttgtcaaaaggcaaaaatcacttactctttcaaagagaacgataaatgagtgtagtgggaagtatagtgggaggattgctttgattcctgtctcagctagctcacccctccgagccttagcctggtctgtataagtgagaataataatacccacattgcacatgaggcttaaggggtttgtaaagcacaagtttaatgtctgacacataatagatactagaagtaacagctaacatttagtaaatatttgctgtgtaccaagtcatgaactaatctttgggttgtctgagtaagtagtagagttggaactcaagtccagatctgacttcagaactcattctcttagccacccccacatgctgctttccattaactgggagctgctcttaactcccaaccacaaaagcagaacagtcatcagttaattgcaagatggagggtaaagaaaattaactgctttaaatgaatccaagctggtcaagttacattccaaggtaccgaagaacctgccactgggatccctgtgtcaccggtggtcatccattagccacctgaagtcagagtcagccagtgctatagaatttgtgtgtcctaaactcagcaatttggggcaaagtctccaattatgtatgtagtcataaacaagtggaaaacatgagttatatgaacataccattgggggagattaatggtgtaataagctgttcagtaatactaagaaaaaatatatatgtgcatatgaaacccgtattgcccaaggacagaactgtagtaatcagtgcactgatacaaagtgctacagtgcatggaacagtctctttggaactggctattagatacaaggtcctaattgtgtgtgtgacagagtagaagggtgtgtaagggaataattatatcacttagacataaaaaagagttagagtaagggccttgtttgctttttcattgctttgggctaattggcattcagaatatttatcctaaaccttttttgcctttagaattcagttcaccaagcataggacctggtaggtttatacatggaatctccagtaattgcagtgtaagcatcatcttaaatggcctgccattggaaagtataagacttgaatcaagttacctagatttagatatgtagtagctctaatttatctggtaagtctcttcaccactaagcttcagattatctatttacttatagagcaggggtcagagctgttatcagttattcggaggattgatcagggtttgaaaatcatcatacacatattggtatagttatttttattgttagaattgaaagttctaacatgatgaaactactatttcatatctctttataatagtctatatcctgcatctcacattaactccctcaattgagtcatggtacaagtctggcaggttagaaggtaatgcagattttagcctgaactaactgctctctggggccaggtctgcgcttttgtctatcattaggaggtcattgctgtcttaggcttatgaccttttacagtagattcaaaagtaaaaataaaaccaataaaatttgtctttatctggttgcacttgtcaatatagttgcttttggaaattctagaatatgactattttctgataggcaaatagtttgctttctgatggtctgcaacattagaatatgatttcaacttctttcctttttgtgcttacaggagcaacatagctcctaatggagtagaacttgacaggcctcaaaaagacatgaatttagaaatttgtccagtaattatttaaatttccaaaagtaaaaacaaatatctttgtggtggaagcatgctacccggtactcaataaatatttgccaagtggatgaaaagctattcttttacaacataaaatatcttgtaactttctagtgtcctgataaaacttcaataaaaaggcagccttcagaaaatgcagtttattcatctagatttactgttaaaaatctcatcttttcactgagcttaactacagtataactggaaaccattatgtgatactctggccgcataagtgggcacacagagaatagcattgttcaccggcactgctcccctccaaatgggcaaggacttttgtgggacttgtgacataatctgaacaagcactctctgtgttcgtcatcacagattgtcttttgtcctttacctcctggaatctgcccagatctttcccctctcctttcttaggcatctcttgtttgcttcttattcttgcttgcactgtaacttggaatagtgcttcccaactatggtgcgacatacctatgattcataacttgtctctcagtctccacatcctcccacagtgtgggggtgggtcttgtggcccagcccactactaattattcctctgggaacatcaacctgatagtagccatgatctctcatctttcttctttgcccactcttcttgtctaccaaaaaggacctaccaggaagttttcatcaatttctctgactgcctgtagtcaacactgctgtactgtctcctgaagctcagagtgtatcttcacatcacattccataaatgcttatcgaagccctcctgtgtgtcagacactggggatgtggcaaattataagacaaaaatttctgccatcttggagctggtgtttgagtaggctaaaacagaaaacgaacaaaatgagaatgtgaagtgtgtagcatcttagaaaaatgaagcagggaagaggaatgggagttctgcaagggaggtggatccagagggattttattttgaataaaatactcagataaaacctctctgagatagtgacggcaggcagagactggaggggtgtgaggatatctggagggagccatgcggatatctggaagatcattctgggcagagggggtagcacctgcaaaatccctgcagcaggagcatcctgtggtgcctgaggaatagtgcggaggcctgtgcggtgggaagagggaagagcaggagagaaggaggaagcgagggtctgggtgtgacctaggaaatgaaggaggttgtttaggttcttgtgggctatttataaactttggcttttgtttggagtgagaagaacccattggagggtttttattatttttatttttatttcttttttttgagatggagtttcactcttgtcgcccaggctggagtgcaatggcatgatctccggtcactgcaacctctgcctcctgggttcaagcaattctccagcctcagcctcccaagtagatgggattacaagtgcccaccaccatgcccagctaatttttatatttttagtagagacggggttccaccatgttggccaggctggtctccaactcttgacctcaggtgatccacccacctcggcctcccaaagtgctgggattacaggcgtgagccaccgcacccagccaagggttttaatgaaaggagtgacatgatctggtgtgttttaacagtactgctctgccttgccagattaaagaggggaagggatcagaagccaggagatccattggaaagctacttcagtaatccaagcacaagatgatgataacttggatcagaacagccatgggggacgtgtgagaagtggtctggatgtattgtgaagagggatcccacaggtggattgaatgtgaagtgtgagaagtatcaggtggcgtgagcagctggagagatgatattgccatccactgaggtggaaaattatagaggagcaggttgggagatgattaggggtttggcttttgatgttactttgatgtgccttttagacatctgaatggggatactgagtatacagcagaacgtgtgaagaagttcagggaagatgttcaggctggagtgtaaatttgggagcctatcagtacataaataagccatgagaatgaactgggtcaccaaggctctgagtatgtcgaggaaagttccaaggactgaattttagggcactgcgacattagaagtctggagagttgaggaggaacgagcaaaggagccgtggaagggcagaccagtgaggtgggaggatatgaggagaggagaggtggtgacctggaagacgagtgaaaaaggatctcatgaggatcgagtcatcagcaatcacagatgttagcgataggtcaagtaaaataacggaggaggctacctggggagattaggaagttctttttctttaaagtgaaatatctgaaaataatgttaaatgtataattttccagctacattcagtaaacatttttctacagtaatattgattccttggtgtttgttgaaattggttctgtgggttctttgtgttgttgttgagacagtgtcttactctgtcacccaggctagagtgcagtggcacaatcttggctcactacaacctctgcctcctgggttcaagtgattctcgcacctcagcctcctgagtagttgggattacaggcgcctgtcaccacactcagctaatttttgcgtttttaatagagatggggtttcgccatgttagccaggctgggctcgaactcctgacctcaagtgatctgcccacctcgacctcccaaagtgctgggattacaggcgtgagtgagccagcatgcccagcctggttctatggaaaaagaatgtatagtctcttgtatgtgtgttcatatgttaaccttgttaatagtgttcaaatctttcatattctcattaattttcattgagagaactatattaaactctactacgattatagatatgtcagttttttcttttttttggagggaggtggggtatgggtcttagttttttattttacactttgaggctttcctgttagttgcaaataagatcagaattattcttcttcctggtgaatgtttctaccatctcatacgggtccttaaagcctaatttgtctgttgtaataaaacctccccagttgcttttagaatttttatttggatagctttttctagcccactacttccaacacttctatgacctgatttttaatccagagcctctcttttcactgacagatttaagccatttacattgattaaaacaatttaatacttttatttgtatctattttattatgtattttctatttaccaggcattttctttgcccctttttgttctgctgacacagggacttctgtcgcactgatcaagtttctttgtttcttttattgccctctactggttgggaaattatgtagtctatgtctgttctttgagtggttacctttccatttttaacatacctgtttgcctttgatcaatatctcttccttctgctgatcaatgcaaggaggatgatttatctctaatgattctcttatgtctttcatgttattacatttttgtgttttaacttcaccttgtatttatacctgccaacttagtattattgttgttttatacagtcaatgattattttgatttcttacacatttactagtattttggctcaccatttctcatatctcttttctttttccttcttatgtaatttccttcttcctgaaatacgtcttttaatagtttttccagtcatgtctattagtggtaaatgcgctcagactttgtctgaaaatgtgtttatttctctgtcatctgtgatttagatttttagctggacagttatttttttctctgtgttgtgtgttatgtgcagccagtctaattgctgttcatgtggttattctgatttttctttctgactgtttaatcatgttttttcttccctccttggtgttctggtatggatttatttttttcctaatcagaagccattgttctgaatttgaggcattgtatcattcttcaattctagaaaagtctcagccattataatctcaatattacctctctcaattctttctattcccttctcctggactacctgtcagatgtatgttgggccttgtcattctgtcctctgtgtctcttaacttccgttttatgttttccatcttttttttctttttttagtgcaatggcacgatcttggctcacaacaacctctgcctcccaggttcaagcaattctcctgcctcagcctcctgagtagctgggattacaggcacccgccaccatgccccgctaattttttgtatttttagtagagacggttcaccctgttggccaggctggtcttgaactcttgacctcaggtgatccacccgccttggcctcccaaagtgctcagattacaggtgtgagccaccatgcccagccttccatctctgtttctttctgggctacattctaaataattcttcacatctgtttttaggtttactaattcctaggatgtgtttaatctgctatttaatctattaatttatcatttccatgacaatatttgccatttttattctttttcaactctccttattctttcttttaatagactacctatggcttcaagcccttcattatgtgtcttgagtaatgttaaacatatatattttacatctccatgtgtatttttgttctactgtcatatgttcttggtgttctaatcctcatttttcaatttatggtggatttttcccgttttttgtaattttttttttttttttttactttgagctcatctttaatgagacttggtttttctgtggaatctcatggagccacagttgtgagtgtgaccctccaggccagttgcaccattcctttggccagtcaccctaagggtatcaccagctagtgaccaatttttgtgttgttttttgtttttctttttctttttttgagatggagtcttgctgtatcgcccaggctggagtgcagtgacacgatctcagctcactgcagcctctgcctcccaggttcaagtgattctcctgcctcagcctcccaagtagctgggactacaggcagacgccaccacccctggctaatttttgtatttttaatagagatggggtttcatctctactaaatgttagcaataggtccagtaaaataacagaggaggctacctggggagattaggaagttctttttctttaaagtgaaatatctgaaaataatgttaaatgtgtaattttccagctacattcagtaaacatttttctacagtaatattgattcctttgtgctcagacctcaagtgagcaccaagaaaaaccagaataaccacatgaacagcaattagactggctgcacataacacacaacacagagaaaaaataactgtccagctagaaatctaattcatggatgacagagaaataaatacattttcagacaaagtctgagcacatttaccgctaatagaactcctgacctcaagtgatctgcccacctcggcctcccaaagtgcttggattacaggtgtgagccaccatacctggccaatttttgtgttaattcatctgaattcttgaactccaagtttgtgtaagatgcaagcccagcatttccattcattacttaacagacaaaaaactttttaatcatgtcactcttctggagagaggacatttttcctactccaccctgtaacattcagtctcctgccagagtttcctctcattggccaaacccaggcagaggccaaatagaacagaagcttagaaaaaacagcctgcaggattggcttttttgcagcccagagcagaacagggaaaaggtgagaaatggacctgggcacaaacaggcctaggaccaacacaatattctatcccctaacaaatattccctgactgcaggtagccaacacgctgtgctcagcttgctattacagaaatgtgttagacacagtccctggtctgcagtcagagccactgacaccgtaactacacagattaacaacagcaccagttagacgatgtgtaatgttaaaagacagatacaaaccagtaccatggaaacactgcatgtgttcagcggtcacagcttgctaagggctactctattgacaatgcaggtatagagagtggcaaaggggtgtatcctatccataaaacccgaattcctcagttcatcaggacttttctcaggacaaaaaagatgttaccctccctcctctcaaaaaaagaggattcagtggtcaaatacgtgttgggaaccctgagctcatcaaatttttctgtagcacagagtttctcactgcctaataggctaatgtgcactggggccctgcgagtgagatatacagcctgcagcattgtctggattcatctgaccgcacaggacaggagcatcaggagcctattttggcatttgctggactggggggagcagagagccaggcagcaggcaagaggcagaagacagaaggaaacaccaagaagaggagaggctcaagggctgagagaggcagactcaagtctccaaaaaagcctcccatccaaggcgcctgtgctgtgggccggcaggggagggtgcaagctcagaagaggtcactgaacttggcaatgccaaggtcatcgataccttcccgagagcagtgtcgggcagtggggcagaaaccagaatcccgagtggagatgtgacagggaaagctagcgagagttggccatgggtgtaaacccctctagtgacatttgccaatgagaccaaaggcaggcggtgctgaggagggggcagggttggagaagtgtgcttgttggttggtttcaaacagtgggataggagggacacttagcaatgtttacgggctaagaaggaaatggcgaagagtgaacatagaagcgtgaaggaaagggaggggccctggaggagaggctgactacagacagtggctttagaaagaaacaggacccctccttccctaactcaggaaggacacacagggacaaatggacagacagaaggggaggaagagaggcctcgtgtctttattttttccctgacatcagaggtaagagcatctggaagtgagggtaggagctgggttggaaacttaaacagagggtaaaaatttaagagcaggccaggcgtggtggctcacgcctgtaatcccagcacttcgagaggccgagatgggcagagcacttgaggccagtagttggagaccagcctggccaacatggcgaaaccccgtctctactaaagatacaaaaattagctgggtgtggtgggcacctgtagttccagctactcggagactgaggcaggagaatcgcttgaacccgggaggcggaggttgtagtgagccgagatcgcgccgctgcactccagcctgggccacacagtgagactccgtctcaaaaaaaaaaaaaaagttgaagagccgtcgtgatgaaatgcaaaagggtcagctaggcatggcatgccaggggtgtccccacattatcctgctacagctaatgcaatgtatagtctagttttagaaacaaatatctgaggttcttgctattattccaaggtattattccagatacagtggccaatacttgtggtttttaatgtaaatcattgtttcccaaggtgtgatagttgtatccttgtggtgctcaacgcactggtacacaaaatggacctgtttcattcgaatgattatatatttgctttaatgattattagaagaaacataatgagcacatttaacttcaaacacgagtacgtttagagaaaaatattaagtaaataataatagagatggaatgtggatatggcaaaagtcttgaaagcagaacatgaagtttgtaagacagtggtgtgggaggtggggcaaccttggaaactggtctgagttccctccatcaatcacctggccacaccgagtagcaccactggatcatatcaggatcagtgccatttcgccaggtgtctggtcaccaagcctctcctccttgctccacaaaagcctcgtcaagcagacatttggattagcctcagtgattttttttaacactcagttaccctctgcagttccccctggcagaagataataaaatactatctccctaaaagcgtaacaattttgaacatgacagtggcattatgatttatttctttcttttctttatttttcttctttcttttttttctttctttcctttctttctttctttttcttgtttctttccttttttttcccttccttcccttcccttccttctttcactccttccttcttccctcactcccctcccctcccctccccttccctttccccttacattcactttttccttccttctccctgttcctttcttttccttttttttttttttttgaaacagggtctcactcttatctggcctggagtacagtggtgcagtcacagctcactgcaaacttgaactctcagactcaagcagtcctcccagccttagcctcccaagtagctgggactacaggcacatgccaccacgcctggctaatttttttttttttaatttggtagagatgagagtctcactttgttgcccaggctggtcttcaactcctaggcacaagtgatcctcccgcctcagcctcccacagtgctgggattacaggcaccacagtctatgatttctttttagaaacaccaaacataacctgccttattcatttatttttttgttctctgtgggagtaatttctttaaagctgttggcaacatctgtagaatatagaaaagctgtcttccttagaactgtctgtaagcccagatctatacaaaatgtatacaaatgcaaaggaaattggaaagagcaacacgccctgctggatggacagtgtcctggcaggtgcagggtgcaccttcgctctgctgcccttcttggttgccttagctacagaaggtcttccctacttcattcgtctctttcccagttttctgacacaagccacttgctgcctcatgttgtagcttgctgggtacctacatgctgtcaacctaaataacggagagggagactctctaaaagaaagtgatatttatttaagaatagttattgcaccgggcatggggctcatgcctgtaatcccagcactttgggaggccaaggtgggcggatcacctgagatcaggagttcgagaccagcctggccaatacggtgaaaccccatctctactaaaaatacaaaaattagctgggcgtggtggtgtgtgcctgtaatcccagccactcaggaggctgaggcaggagaatcacttgcacccagaaggcagaggttgcagtgagccgagatttgcgccattgcactccagcctggctgacacagggagactctgtctccaaaaaaaaaaaaaaaaaaaaaagaaaagaaaaatagttattgtaatgggaatatgcataccaacaggtgcatattcagagaactaaaggaggacaaaagtttttaaaggaaaaatgaagaggatcacataatttttttaaatatataattatccttggccgtgagaatcaataagggtggcacttgtccgaggttggacaggcagttgctgggcagataaccttgcaggactatttttttgtgtcaggtcaccatggcctttatgtaagtttgtggttttgcagtcttttgtgatagttctagttatcaagtattcatggatgagaactctctcttcatggccttccctggccctttgtcaggatttttaacacaagtgactccattttgattctgacaacttccactgcttttgcttttttttttttttttttttttggagatgaagtcttgctcttttgcccaggctggagtgcagtggtgcgatctcggctcactgcaacctccacctcctgggttcacaccattctgctgcctcagcctcctgagtagctgggactacaggcgcccaccaccacgcctggctaattttttgtaattttagtagagacggggtttcaccgtgttagccaggatggtctcgatctcctgacctcgtgatacacccaccttggcctcccaaagtgctgggattactcccaaaggtgtgagccaccatgcccggctgcttttgcttttttttctaagaagggtttcctgaggtatttcgccacatcactgtgtataggcaagccctcagctacttgttaagtgactctggaattatgtcacttcatagtttgacatctagttcagctgtgatgtgcctgtgaattgatccaaagtgaatgcagtacctctcaccctgatgcaaggttgcttgtgactttcctgtcatttgtggctggatatctgcagtgtaccaggagttatttgttctagtgagatgaggcagtggtcttctgggaattgctgggatctgggaatttcaggttttataaccttagaactttcctttaagaaatctagagactgtttctcaaacatttttttaacagtagctcacagtgagaaatacattttacatttcgaatacatacataactaaacatttcacaatatttaccaaagccatatgcatggtaatttctatttatttattttttaatgctgggcctgaccagcattttaaaaccaaaatgatataatgacccactaatggctcatgacctgcagtttggagtggtctgaagcatctgattcatttaatcatttcagtaacttcgaaaaatgtcttgaggtggtgagattcttcacacgctctgcacagttctgaaaagaaattaggagcacattgaaatgttacagacattgctgatttgccactttggagctgtgagtgccggctcattaatgccaactctccgcgtacgcatgctgctctgcagaagttagcagcgtcctttttaaggctgcgtcattctttcaaagcagcatttgtaaacccagcacatctgctgacaaatgtctattttctacaaagttgactaaagtaatattttaaactaccctgttttttccacagggtgtgctgatctgcaaaccctggacacaatgcagccaattgagaggaaaagacagggctatattcatgagctgattcagaccgaagagcggtacatggctgaccttcagctcgtcgtcgaggtgaggaggctgctgctggctagctctcggggtatctgctgtctctcatgagagatggtgggcatcagactcagggctgcctccacgcagagtcaaagcaaggcatcacttttgatgtgtgaattcacaaatagtgacggaagctctcacatcctccaaatgctgtctctgcctgccggataatgcttgagattgaaagtctctaatgagctctttcccccagatgaggtcactcagagtgaagcgggagaacaagagggcattcgcatggcttcgttggatgtggcaggagccccatcaaggaaggacggggatagagtggatgggaagggcctatggcagaccgtagcttccttggatatttgcctaatatctgttttaacatctgacattttcataaactggtatctctggaggaactgtgaaacagtgaaagtgttcacctcatggttgtatcagtttggaaaacccaatgggagcatactgtaaaatagttcccaaatatcatatagctactgtttgtttataccagtgacctctactctgatgacagctatccttattcgagtagcactttaaaatgatttgtgcttgagtgaacaaaagaagactttccatttctactatacctttgtttccatgcctttcagttcccagtgtacaggccctcaggtgagaagaccagttacattaacaaaccacctgaaaagaacaggcgtcccctacccccacacacccaacaggtgcagcgtatacctggccatgcctttcatagctgaatggagcagaggctgcgtccttctgcgtctgttccccagcaagccctgccctggattcactctccaccttaaacgcaggcctaatgcctgggatatccagacatggaatacttgttcccctcccatgcaaactatatggcacttctcggttggtgatatctatcttcactgcacgcctgtgggctcactgagaacagggaccgtgcagccttcatcctgtgttcccaaaacttagcctggcccttggtcggcctttccataagtagtcagtgaattgggtgtgtttatgtctgcacctctctggccaggatagatggcctagaagaaaagcccatcattttgattaatcccctacaaggatcagccctgctgctggtcagattccagtcctaaggcactgtaagtaggtgtggaggtctccctaacactaggacagaggtgagcaggcaccgggtgcttgccccatactctgaggagtgaagcatcaggtctgggtccaggattctgggtgaaaagcaccattcacaggtgaggccttcttatgaccatcctcatgaaggttcccagaggcctgaccagcttattcccatctgcttacctcaccaagcccggcacaaagcagctacatggatggctagaggggcatgaatgaatcagcaaataaacaaacagatggacagccagactcttccctgtccctccatagcagcctccgagcaggccggccgtctttccagggctgctctcacaggagtggcctagtgtcttcagtctgatttggaactgtaaaactctctttagagagtgcccagcacttgtacttgaattctgtgaatccatgttcaactcaactcagtaaacatgaattacaaaccacgatgtgcaaagggctatgccagagaacagagatgaaagaaagttcttgtcctccaggaattcagagtcctgttggatggagagaggtacagtggggccagtaaggctgaaacctggggttagtgaccaccccagccaggaagaactttcccagttatgttttggacaaggacaagtttgctactccaggaggaggaaacagaagtgggatggcatgtatggagggagtcaggggcctacaggccatccagggtgactggagtgtgaagtagctgagggccaggctggtgaggttggcagggggcaggtctcataggccctggaacctccaggaggagtctgtgtcttatcacacggacagtggagagctttgagtgattctaatagcagcatgtcatgggcattttggaaagatgacatatgagaagagtgtctcaggtaacttctctatttccttaaggtgtttaaagtcattccctaggaatctcagttatgcagttgaaacttagatttagaatcaaaaagagctgaattttagtcctaggcctttcatattctgtctttgtgatcttgagcaagtctccctctaagcctttatttcttcataggtcaattggtaataataatacctgactcagcttcacctccatcacccgtgaagctacttgagaaccctgcaaacacacacgcgtgtgtgtacacacacacaagcatctgcatatttgtacatatcagtgctttgtaaatccttaagtgctatgtaatacagatgtagagtattactatttctccctcagcagccaacttctaaaacccacatctgcttagagttatcttaggggtggcataagttgttactctggttctcctgttgaatgtctcacaaattgttgtctagaactctacgatgctccacctaacaatggcctgcttcctcaatcctgcaagcttgtacagtgcctaggtgttcatgcccatggctttatttaaccttcataacatccctaagagagaaatctgaaaatctcctcttaaccagattactagattcagtccttggaactagccttgataagagctgcactagcaaaaagaaagaacattatgcagtataaaatgtgtcataagtatgcttatttggatgattagcttcagtttatgatgacattatttgatctgattagtttcagtttatgaagacattgtttgatttagaccacacgtaggctgtgtatccacacttaagctaactagtttttctatgttttgactttaggtttttcagaaacgcatggcagagtcaggctttctcactgaaggggagatggccctgatttttgttaactggaaggagctcatcatgtccaacacaaagctgctgaagtgagtcctgagcatcacctgtcattgccgctgaccccaaagcccccagactgagactcacacaaaaccctctgcaagggcttcttagcaaaggaacttcaactgctttctgcttcctcaggcttgttattttattatcattttatgaaatatcctgtgactgtaaaatacataagtattgaagaaagtaaagaaatataacaaaatattttgataaagaaaaaattaaatcattaaacaacatatcaatctatgattccaagatataagatgtccttgaccctggcagggcagaagagtcagaggagagctgcagctcacggcgcagataaaactgcctagtttggtggcctcctaagtctctatccccatgtgaagttctactgttggggtgattttccatccttcgtggctgtgaggacaggccccccaagggaggatgagcagtcccagcttccctcagggatagtgcctctctgcctccacacctggcccctgcagctcctgctcccttttttctcttacagactgaaaatttccttcttggttcaaccaagaacaagttagaatctttcaaaagaaactttgccaagaagctaaggtgaaaccaaaacaattctaaaggccttgaaacacccaagtgtattttttttttttgagatggagtctcactgtgtcgcccaggctggagtgcagtggcacagtctcagctcactgcaacctccgcctcctgggttcacaccattctcctgcctcagcctcccgagtagctgggacaacaggcacccaccaccacacctggctaatttttttttttttttgagatggagtctcgctctctcacccaggctagagtacagtggcgcgatctcggctcgctgccagctccgcctcccgggttcacgccattctcctgcctcagcctcccgagtagctgggatacaggcgcccaccactgcgcccggctaattttttgtatttttagtagagatggtgtttcactgtgtcagccaggatggtctcaatctcctgacctcgtgatccacccacctcagcctctcaaagtgctgggattacaggcgtgagccaccatgcccagctacccaggtgtgtattttttaaatttatttttatttttattatttttagaggcaaggtctcactctgtcacccaagctgcagtgcagtggtgtgatcgtagctcactgcacccaacttgaactcctggattcaagcaatcctcctacctcagcctccggagtagctggaactacaggcgtgcaccaccatgcccagctaatttttcatttttgtagagacagggtctcactatgttgcccaagctggtctcgaactcctgggctcaagcaatcctcttgcctcggcctcccgaaatgctgggattagaggcatgagccaccgtgcccagcccacccaactgcagggactttatttactttttttttctttgctgacatcacaccccggttggcttgaccagcagagcttttggcccaagctatctcctcttcctcttgagttctccttcccagtgccagaggttcttaggtagctcactggttatcattaccattggtctgccatgggattcatcctttaattacctaagtcattcacttagaaacacaaaatgagagtgtgttcttggcagggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaaggtaattccattctgggccttgcgggtcaggctccttctgaggctggaggcaacagcacacagtagcccaacagggaatcccagcaatggagaagggcatccccatcagtttccaaaggaaacaccaaaacggcagagaattttccgattgttttgtgttgcctttatgtagacctgattttttcctggcactgggaccatcattttttccccatctgatagcagagtgtttttttttaagcatacttacttatcagctactttatactcccaagaaacaaccagaatgtcactttcttaattttgtaaattgccttcatttaatacctgccttattccagaaagagtataaaatagcttactcttttttttttttttttttttaaacagaatcttgctctgttgcccaggctggaatgcagtggtatgatcttggctcactgcaacctctgcctcccaagttcaagagattctcctacctcagcctccaaagtagctgggattacaggcatgtgccaccacgcctggctaatttttgtatttttagtagagacggggtttcaccatgttggccaggttgatttcgaactcctgacctcaggtgatcggcccaccttggcctcccaaagtgcttggattacaggtgtaagccaccgtgcccggccctaaaatagcttactcaaatatataaaatgcaacaagataaaatttaaaataactagatgaataaacttggacaaaaggaaatgagagtaggaaacaaagacgataccaggaattaggataatatataaaatgcatatctgtgatcctgtaaatataccagaagtgtgcacagatgtcatcaaagcttccagaaactgatgagcagaagaagaaaggatcagttccgtgatgccacgtcacaagttaaacatgagaagtaaagctacagctgtactcagagagagaacactgtgtataatgtaatgagtcaacaacatccttcgtacaggttattataatagaaagtcatattttgagaagttatttgcattgatgttgttcagtagtagaaactattattatacctgttaaaatggtgaggaaattgaaagtaaaatctgttttcttgctttttttcatatttcctgttgggtttttttgttcatgaaatactgcatattgggatatattaaacagccatatcagtacttaaggagagtatataatttaaatattttcattatcagaaaagagtagaaagtaagaataaaatataaagatgtttaggcagagaatagaaattagaaaaggaaaatggaggaagtaataaaggtaaaaagcacaaattatatcaatatatccaagaactgttatattgaagagagataataaaatgtaactgatgaatctaatagagaaagaggaaaaaacacaagtaacagaatggatgtaaggagatctcttaaattaaagtgcatgtaattccaaaagacatgctaacaaatgtgaaaacatgaacaaaatttgtaattttctattaaaacttgaaaactggctcaataagaatagaaaatcttttaaaaatagaaaatcttactattacgatactatacaccaaggagaaaattgagaaacttaccccaaaaaggagctgggttcacttgatggatttaacagggaattctctccaactctaaaggaacagattattctatattatacaaactgttacagatcataggaaaaagtaaaaaggtcacctaattcattctataaagcaaaagtagccatgattccaaggcctgtttaagttaaaacccactatcatttacaaatacagctgttaaactcttaattaaagtaacaattcataaaattaagcattacatgaaaagaagagcctatcataaccaaataggattatctcaggaggctatagcatactatgcttagaacaagacaggcttcagaatctcggccccgtcactgtctaattgtgtgaccagaggcaagttatttaacatgtgggtgccttcagtcccctcatctataaaaggagattatcacacagtacttttaaaggactttaactcagagaccaacacattactattagcattcaataaatgattatcgtatttttccttacgatgatctcagggatgcaaaaatgattcaatataaggcagtgaggacagagcccttcgatttgtgataagggtaggaggcagggagttgcctcgaaatgaactggaagaaacatggaaaccaagaccatagaattaaacattcatcagaataatgagataaactgagaattgttagtatatgtgcatgttttaaaataatgatgtaaataggatttcaaagtcatcacaattgtaacagtagtcaaaataaataaaaatactgcctcatgaaaggcctgctataggttaccttaaaaagcaaaatctagcaataagctgtgttctaaaatgttactttttaaaaagactcagaaaatatggaaataagaagcacgaagatgcttgtgacagcaacctatatagatacggccaaaacaaaaggggggcaatttaaatatccagtagtggggaaatgatgaggtggattacagtgagtgtacttttcagtcattaaaagctgccatcctagagcagcagctgctgtcttcaggcagtgtaccagagctaggggtagaggcaagtaggatgtgggccctgggcctggcgttcacaaatcgggtgtggaatagagacactgcaacacgatgcctctccctgtatcacctggtgcacatgtggtgtatgctaaaggtagccagggagggtcatggaaaggagggaaggtgtcccaggggagagcctggacaaggggaagcagggcctgagtcttgagggtcaagtgtgaatcagctccgagaagagagggcaggggacagtcccagcacaggtcatgggaaagagctgaggagcatccgctgggcttggcacatgagctgagatattcctactgtgaacctaataggtatcattttagatcctgagttatttaaaagaaagtcgaagccccctcactttactacagtgcgacatatcagtgtagcaaaattacacttgtatgttgtgaatatacacaaattttaaaataaaaataaaaaatagaacactcacctaaaaaaaattctaaaacagtaagacagggagaaacataaataaataaaagaaatgtgaaatctaaaaggcgatcaaagaccagtgcttcctgtgatcggagctgtgatttcctcacgagcctcactgttgttttgcagaagctggcatctgacccgcggtgtaaaggaatgcccctctccagcttcctgctgaaacccatgcagaggatcacccgctacccactgctcatcagaagtgtgagtgtgcaggccgggcagtggggtctgagttaggagcaggatgcgctgaggtccacagaggccagatcctcagggagccctgagcatgccacctcaccctgcacacagtgtgacaccgcacaagtgatcccactgtcccggggaccagatgcctgtgtgtgtgtgtgcacagaaacacgctgaatccttgaagtgggcaaatcagagaggaatccagtatcacttgggtaacctgtcacccacctttcaagaaactccccagcatctcaaagtcataagtatacttgtccaggcagggaaaggcccctctaggtctccagttgtggagcccatcttgaacccagagaaagaccagagtaaccttagactccagtctttcctctgagatctgcctccatccaccctgaacacctttcctagatgtcccaggaggctccacttggcacatcataaatagagttcatttgtgtccctcgctgtattcggcttcaacattccttctaaaattccttccagctttctttttgataagcaatagggccctcttgagcccataagccttctaaggaaaaggcagactttacaaaagattatcccacgattaaccattgattacagtaacttacaaagaaaagcagcaggaatatgataagcttgttacttctattgatgattccttgacttttggtctgttagctgtgtgacctcaacatagacctcatgtgatagacgcctgcactaaactgaaccataatgcaggttcacagccccttcattgaaatacttggggccagatgtgtttcagaattcggaatgtagctcaaataccatataatatatgactcctcaactgagccttagggtagcacttacaaccagacacactaatattcctacagtggaacataagaacaatcactgtaagagtaagtaaatatatctcttctgtttaggtcagattttgccaccaaatgggtactgaataaaaactttaggctctcaggctgttctgcattttagaattgtaaatgaaggactgtgcactcatctgactagagtgagagagtccagacggggcatctggtgatggcccctaatttctggagggaccacacacgtttgtattctggcctctgcgcgttcacagttgcagcatgcgtcgtttgaaattgcttcagaatgaacagaatgcatttcttccacatgctgacaatgtgattttattgtatttttcctgtggcatgggagtcattgctttcatcagatttttttcaaaaggatcagtgaccccaaaattgttatgaaccattgctattcagcaagttcacacttaccacagctgcagccagtttatacaggagggcgcacccttacatggcttaaatttcggaaggagtcgggaggctcccgcctattaccgggagccagtcggagagcaaccagagacccacacagttcagagcacttgatccgtttagcactgtcaccttgtcacagcagcgttacctgtccctgtgtccccaagaacttgtgggagtacgagtttctcaagggcggaaagtgtcgtcttgttcaccgccgcgtttccagggcatggaagcagtccataacatggggttggaggagcggtcctgcgaaggtccaggtgggcaggtgagagacgcagctcccccatgtgacactgcccactcttttccagattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggaggtcaggcctgtgtggttaagccgtgcgcctccagggaggctctgggtggggaaccagctccgagccttccctcacgtggacagtctgcaccttaggcagcctgcgtggactcaccaccctgcccctgcaaaggcatttttttttcttttttttttttttttttttgagacggagtctcactctgttgcccaggctggagtgcagtggcgagatcatctcggctcactgcaagctctgcctcccgggttggagcgattctctggcctccatctcccaagtagctgggactacaggcatctgctacgatgcccagctaattttcgtatttttagtagagctggggtttcaccatgttggccaggctggtcttgaactcctggcgtcaagtgatcctcccgcctctgtctcccaacagtgctgggattgcaggcatgaagggcattccttcttggattgtcatcttcctttctcctaaggagagaacactgggattttttgttttgagttctttgaattcagctggtagaatcagtgttctgtggctagaagtaatgattttcactgggccagtttggactctgaagagtaatgtatttaaggatctttcatgcaaagtgaatgattctagccacattcccacctagaaaactccaccacagtatcctcaggcccagggcactggcctctcaggggcactggatggtttgtgccgggatttaaaaagtgaaattttctttctctttaagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacggtgagtatcacgcgtctggcggtagcatcaggggcctaatgaggtgttgcctctatcttaaggcctccctggcagaccctgagctggccttacgggaccctcctcacctggttccagatcgctcgtgcttcctttgctgcttcccacgggaagggccccatgcagctgggcactccccacctgccacaggccatcagccagattccagctgagattctggcttcctcctggccagcgtgacacctgggctcaccactgtgtgcattcagcattgggtctctgtaagccgagccccagcacagcaccagcgttgctagcagagagccttttgcaccagccgtcatgggcgcttggagctcctgtccccacccagtcccaacacctgacccacctcgataatgacttttccagaaatggaggcttcattgttcttacaaatggaggtttcatttgttctgtgtagaagaccttagacgctagacccctttctccttctcaacaaggctcttcagaacaaacagaactctctctggacataggcgggtggagtgttctagcccatctcacagcctgtgttttggccctaattctttcagcccattttcctgaatgaagtcttggtgaaactgcccacagacccttccagcgatgagcctgtcttccacatttcccacattgatcgggtctacaccctccgaacagacaacattaatgagaggtcagtcctgaccatgtgtggcctgccttgaactctgggagaaggcctggacgtctccctctgccataaacccatctccagccgtgcttaagccccactaattctgtatcctgaacctctcttaacacatcccctctgctccagtcccatggtaggccttggtcactgcagctgcctcctaacatgcttcccggcttctagtctctccccacaccactcagcagccttcccaaatggcagatcagcacctgaggccctgctacagtccctgcaggggctgcccgcaggcgacagcccactgtgctttgctggtttccgaggcctccttgggccacaggcctcagccctcgtccctccacctgcagactttcgcccctcaggcgcccttgtgtgggtgccatccccgctgttcccagcttccttcaggctgcagctccaacagtgcctccgcggcgccaacccggggggtgctgctgctcctctgtgtgcgctagaacccctcgtgccaggtatcatccgtggggccaatgcatcatctgtctccaggtcccagcgccttgcgagtgcctggcattttgtggtcagccaagaagggtcactaccagctctcatactccattagcataagcatctttcagttgactaatatcaggtctttgataggaaacttgtgaaagttgaggttagcaaaagactgaagaacatgtgcagagctctggggctccacgctgacctgtgagggtgggatgcggccaacggctgcccctgcttctcccgtaggaccgcctgggtgcagaagatcaaggcggcgtctgagcagtacatcgacaccgagaagaagaagcgtgagaaagcttaccaaggtatcagggtgcccggagggtgggacgcagcccccaggggccctaggaatgccggccactgctcctgcagtcaggctgatgatatagggacgggtctgaaagaccagacctgctgcgggatcagaccagagagccctcccctcttgaagctactactgcaaacctccctggggctcctgcccacacagacacgggctggcagtgccagctccgggacctccctctctgcaccacctctatcccccccactccactgcaccttctccactcctttctctccatgactcacctcacctctgcttgggctgtggtgctccattacatgccacacctgtggtctgtctcccttcagctcctgagcagccactgctcctcctcaccctcctctagggcctgccatccaccctctccctttgcagccagggggcctagaccctaagtctgccctctccccatccttctgcccctgcctcctcccccttctcacttcaccagacttcagtccacgtcctgtccccaccagtgacaccagtggcctagttagtggctcagctcactttccctgccccagctccctgcactgatggcagtcactgaggcgctgccttccctctggaccccatggccgccttcccagttcttcttccacccttgcccaggcctctccccgacctctgtagcgctctccctcggggaccccaccgacccccagcttcagggtcaggctagccacactctcccaagcccgcgcctctgaacagcaccctccagagaaccacctgccccgctgctcccacatcacacatcggcttttcccaagggaccaccagcctccttccagcagcagctcctcctgggaccctctgtggacagtagtgtggtccctggccacccaggcccctccctggcacctcacacctggtcagctgcactgcagtcctcctccctcgccactttcccatcgccctttcctgtccccgtatcacaggcccccgatctcccacccaggctgcagcacaaggctctctttcctctctgccacccatcctcttcatttctggagtattcttttttccagagctgctcttatacctcttcctgctgaagtatcttccctattgcctcccaaattaaggacacatttcttaccccacactcagggcccatccccactattgcctgccacccagccccatccctagctctttcctgtgcccggcccatccagctgcctagttgagcagcccattgttgccctgcctggccttcccatgtgagctccccctccagctcaagtgctctgccctcaccttaaattcttcccatccttcaaggcccacgtcaaacacagcctcctccatgacaccctcttgccctaaccagtgtgacttctacctggagcccccgctgtcctgaggctgcgatcatcctccgggcgctcatcctctgttgcctctgcttgcgccctctcagtccctgcttttctcacttaatggccataagctccctcaaggcaactccctcccacatcggggccagcatgtgacttatgccagtggggctccagatttgttgcaccggtgatgtcctctctgttcatggcacagatcactcacctgctcagtggagccgcaatggtctttgtaaagcaccccccaccccaccctgccccaccgtggccttcagaccagagctcccacattcttctccagcctccacatgaatgccaggccccaacctccctgctgcatctccagctgtgccaggccagcctgtggcctccaccccacagggggcctgtgctctgagccagctgcatctccaccttcctccccgccggccccctgcatctccaccttccttcccgccgggcccccccatgcagcctgccctcctgcctgggcctcccaccagcttcctggctgctatagttgcagctctttatgtgtttttttattcaggtttcccccattttgttatatactcctaaaaggtatgtttaaaacagcttttgctaatttagtgttattttaatggtactttaaaagcttgctgttgaaaaatcaatgattgatcatttcataacgcatatgatctcttaattggccaaagatgtcaatccggtttttctgcctgagttttgcttcccatcagcatctgcatatgttgctgtgcatcgtccgtgcgttcagtccttcccacatttgtcaattactttgtgccaggctctgtgctaggcttaactgagcctggactttggtatctgatgtttaaatgttgaccctgccatttagcagctctgagtggatcacactccagtcctttctaagcctcagtgtttctcatcagtaaaatggggagctacattatcaggtaattatgcagtttaaataatataatttacataagtctagcacatgcctaacacaaagtaagtatccagtaaatgttagctgctattaagtgctgcacaaataccatgtattattttattaatattactatttgctaggcaattgaggggttaatataaggatgatcgaaacagtccatgctctaccctggctcctgtctggcagaggagacagacattacacacgatttcagacccagcaggctgtgggctgctcataagcgagggatactggatgcagaggagggaagggatctgggaggtagatgtgggatcagacctgcatcttgaaggatgagtaggatgctgacgggcagagaaagcaggcagggcagaaagagcaagcaggggcttcctagcaggcaacacagcctggggaaaggcacagggcagccagatgctgggctgttgggcccagggcagtggcagatggggacagggagccggtagtgttatggttggtttgaaagacagggtctgcatccttggagaagagattaatgagacttgtcttcctcttttgtagcccgctcccaaaagacttcaggcattgggcgcctgatggtgcatgtcattgaagctacagaattaaaagcctgcaaaccaaatggtaaatactgccttgattcattcagcagacataactgccctgccccagtttttgctgatgactttttgagacagagtctcagtgtataacctaggctggagtgcagtggcacgatcttggctcactgcaacctctgcctctggggtacaagtgattctcaaggcttagcctcctgagtagctgggattacaggtgtgcaccaccacgcctggcaaattcttgtatttttagtagacacagggtttcaccatgttggccaggctggtctcgaactcctgacctcaagtgatctgcccgcctcggcctcccaaagtgctgggattacagcactttgtcactgacaaagtgccactgcgcccagccactgatgactcttctgaacactgaataaaggaatgctttctaacagtgtgtccagtgccactaaaatgcgcatattggaccaatattcttatcactgttttcccagtaagtgccagtgcccgccttcccgagtgtgtctgcgccgaggaagcatgcagcaggttgcagtgacactcacccaggattgttccgtgcggagtggtcctggcggtggagctctcggccactccccagttaatgctgctgtcagcactgggaacttggagaccctgttactagaccacagggatatggtgccccaggcagcggctcctgctgccatggtctcgagtgacccattattggaatcctgcttctgctcagggagggcactgtcagtcgcttcgttttacctgcatgcaccacatgtgtctgtggtttgtttttgttcaggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatggtaagtgtcgctcagccaggggatctaaaggctttcccagtttcctagatcctggagtccagatctaggggcttcagctgtgtgcagaccccatgccacttcagggaagtgacacaggcctgtgtcatctcgctttggcagcaggtgggtggccttcctcaggggaggaggtggcctgagatgtgtttcaggtctttgacccatcactccctacacacacgacgtgaacaccactcctggagcattctcagaatggagatttgaattccatgtggcagcttctcacacacaaacctgccatcattccccacacacccactcacgacattcaacagccatgagccaaaagaagttccttgtttcagatttgaaggttttatgaatccacttcttccggatgtagctctttaatgattttataaagaagaaagacttctgactctcctgtgtttattcaccagatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaacttcgtcaaagtctgactgatttactttctatatgaaagctgctttttttctttttaattttctcagccagatgaaaggctcttaaaaggtaccttcacaagttgcctataatgaaaccaagtttccttcctggtacgtgggaaaaccaaggacagagtgaggatgaggtcaggagacccagggcctcatcttgactctgccactaatttgctctgtgactttggtgaatctacctcgtgtttctggggctgggtttctttaatgggtgaaatggatgatctctgtgggagctactgaccctccttcagcttgcctcatcgagtgataacctgagggtaacttacagcaaagaaatgcacacaggtcttacacactaaacccagtaaaaactgggaaaagatctgccccccccccccttttttttttttttttttttgagacagtgtctcactctgtcgcctaggctggagtgcagtggtttgatctcagctcactgcaacctccgcctcctgggttcaagcaattctcctgcctcagcctcctgagtagctgggactacaggcgcccaccaccatacccagctaatttttgtatttttagtagagacggggtttcaccatgttggccaggatggtctcaaactcctgacctcaagtgatccgcctgcctgagcctcccaaagtgctgggattacaggcatgagccactgtgcccggccagataagtccttttgaaggaatcatttgaattgctagggccctgatttctaagggagcaggtctccaggcaactagaggaacaaggaaggattcaaatgtcccaagggcttgggcctccaccctagcccccgcttctgtttaaacataattgctgggcaaaggactgggaaacagaaccggcacattcagatttaaaaatccatcactcactcaggtatagatcctgggcactgattggttaaaatatagacataaaaaaggtaagagatgtcactggatatatgaaacctaaacaactgaacatattgcttgcttgtgggaaagtgggtagtcaggcccagtctcacggagcagagtgaactgctggctgtctctagggttggggcttgttggtcacaaggccagcctggctgatgtcagcagcaaggctgccctgatgactcaaaaccagctctaggcttactgggaacgagagctatggaaccgtcctgtgttcccagggctgcggggaccgtaatcctcactgtggcgagtgccatttctccactgctagatacgacaggactttttggtcagatttagggcagaggagcatcaggaccagagtcagacaacctctatgaaaccacggaccacacggagcatcggcgcacccggccactccagctgtccccttacgcctaggaacgcacacctgcccctttagaaatcaaatgtaagcctgacttttgggaggatgtggggtgtgcctgagtctccataccccgagtctctatcccgagtctccataccccgagtctccatacctgagtctccgtaccccaagactccatacccccgagtctgtaccgcctgagtctctgtaccgcctgagtctatgtacctccaccccagcaggacctggcatatgtgcctcatgcgcccagacatctcccctctgctgagaacccccctcagcaggtccctccagtgctcttcaggaacaggtgccatggccggggaggggcactccgctctcttaaaaggcaacccaaattgtgagcaatttgatgaccaagtctgagtgcatgtgaggaggggataaatgtgttgtgtggcacctgagggactggcctgagagaacactgccacctctgagctaggggactgccacctctgagcagctcaccaagcctcagagcattgtgtgttgggagaggataatactatcttactgcgaaaacttttcagtgaacaaagtacctcacagggttcctggttcacaacaggagctcaataaat

SEQ ID NO: 13482 - DNA, 6573 bp, Human
aacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtcaaaatcttataaggccatatgtcctgaaaggcaaaactctgtgtatgtgcgatttaccagggagatagtaggacagtttttatgagggtttcaaaggagttcatggcccaaatgaagcttgtggccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttcattcaaagctcccctgaacctccatagtgcctccaagatgtgctgtccctgccaactcctgcaccagcttgactggtggtggaagaggccaggaagagcggggggaagacatgtgctaaccacttcttagcaatgaggctggtaaggttactgtccccttgtgcctggtcactagtaacttttttgtagacatgaaggtagatgccctgcaggtcctatcagcaaaggacccaactcctaacagcattggtgctccctcatgaaatttgacagtgtcttttgccaacctcctgctggcagacacttctctgcagtgaataccactatcccatgctgcactagtccctaccaagtcttcaaccctcaatttgatcttccatgagtgtctcaaaaagttcccctcagaagtttcagccaagggaataaaatctaacctctcctccctcaacggagtgtcagggaggggaagaatctgttttccaaacaccacaatctcccaaaaggggatttcaccctcccttggtcatctttatacagggcaattgtgctgctgctgctgaggtggccactttcagcaagccctgtgtgcaggggcctagctgcatttagaaaccaagcatagctatcaaaaagtaatctccaaatagttgaattgcatttcttgagtatctggagaggatgtgcagaccacaggaatacctaatgccttttttctcttcctgtctttgtccctcacactacagcaggcccctcccttccctcttcaacctcatcctccctccccacaggcccagagaaccagttgggctttgttctcctgcaggctatggttcatcatgcaaatagctcctgtgtcagaaatgctttttggcttcaaataacagaaaagctaacaccagctttatcaataataatatcggtggtttacttaaggtgtccagagatggtggagaacaggattggtttcctcctcaatgtcaaggactcaaagactctttctgtggtagggccacatcctaaaccctgtatcctgtgattatttacctgacagggcaaaagagattttgcagatgcaattaaggttaaggaccttgacgtgggaagattgtgattatttacctgacagggcaaaagagattttgcagatgcaattaaggttaaggaccttgacgtgggaagattattctggattatctaggtgggcgcaatttgatcacatgggtccccagaagtggagaacctttcccacctgtagaaagccagagagctggcacctgagaaggacagaactgtcattgcaggatttgaagatgaaggggcccatgagccaaggaatgccagtgacctatagaggctaaaaaacagcaaggaaatggactctccccagagcctccagaggaatgcagccctgttgatcacatgatcaccagatggctgccccagagccaaatgtcgcttcctgagcaccatactcaaaggcaggggaagtggatggagggcaggagctccattcttgtttgccactctccttttgtcaattgggaaaaaattccagaaactctgggagccctccccttacatttcctgggtcatggggccagccctagctgctggagggactgagaacagctgttgagcagtttacctgacggcatctgccatggcttggcaggaactctggctttgggagagagcagcagcaaggtattcaagcaccacctccacccagcccctcccacatttcactcaggactgagtaaaggagacactcagatgctactcagatgctggcttcagctaagtattttgcaaagcctctcgtgttcttacaagtttgtggctatcatgacaaaatggagcagcctactatatctacatatacaactatgggggacctagttttatctcatttaccacaatgttttcaatcattttttggatgacataatttttagcctcttctctaaatgcttcctcaagctttccttgccttccagccactgcaaatgacttgcagtttcccctacatggcacctgacccttgtgcctccctccctctgcccatggcccagaaagccctttcctgtgccctctggcttcctgataaactcctatcatcttcaagagccagttcccatgccagctctccccaagtgctccactgaggcttccgtaacacctctgttcccacatcgggttgactgtctttgttttgtcattgcttgctctggctgtgtctccctcattagactgggatgccttcaaggtagggaccctatctgggtcagcttggcaccccaaagcgtaccacagcacctgattctgaggaggctctcagtagatatctgttgagtaaccagaatgtagggtggtcctgatggtttctgacattgaatagaaaacagctccctatttgatcttaaaataatcactataacctggacatactgtactagatgctgtttttgtctgacttctactctgtcaatctctttgcacctccatttgttcatctgtgaaatgaagaaaatgctcatggagttcagtgaagattaaatgaatgaatataggtagactgcctaatctggcacttgccacgcagctgacttcaatatagtagctctaatattatggtccttgaggatcttactgtcttatggcccagaactgcatttgattaaagaaggctcccctaaaaaaagagtcatacatattccatttgtcctttcagaaggccgtgaagcatttacactctttaagacaaattcccatccaaaaatagttaagatttctaaaatattttgatgctgaaagaggtgtgcttcagttgggtggcaaatttgcttctatggaagatttttaatacaggttgtttctattttactttttctggctgaaaggattttacatttattcaaagtcaaaagggaaaagaaatccaagaactacagaagagcagttgaagtgatttatgcttgatttctaaatgcaacttatgtttatacataatttaaaactcaaagaaagcatgcttatacaatcatgtgcaactttaaactttaagaactctggatgaatacatggtggcaacagtccatgacacctgaaaacatcatttgtggagtggcgtagagttcagtgttcgcagtcgcatattacaaccatgtttcacacagccctgctcggtttgattttctccacgtggttgataattgtcttcagttgctgctaagtgattttgcaaatttcatttataatcctcgccctacaattacctaagtactgtttctgcaggttaacctgtatgctacgctcagtcatatacctttcaaagttactaatgcaactgccaaagagggacagtgtcaatatcattgtcttcattagaaggacggctgccccacactgtgagaacactgctgttcctaacagtagtttacttttagagggatgtgagaattagtttgaccttaattccagatgtgcatgcctcaaaagaaaaatcccattctccttccttttggggagcacttttggtggcaccaaggctggtgtggggtagtggagagagcactgagcttagagtcacaaccagatgaaactgctctggtcttcactagctgtgtgacttgggcaagcagcttgcagtctctgagcctctgagatccctgatggacgaggagaacaatgaccccctccccaggctgtgctgagagagggaattgatcttggatatgaaaatgctgccctggcacagaggtaggagctgagcaacactgctggatgaataaacacatgtaatgcagggtgaacagaacatttcatctgcaacagctgaaggcacagcttacctatgcccatggaaagaactgcgtggaaaattcatttgttgcatttttgccaggttgatgtttgcaaagcagggcactcttctccacatttccccaaaaccaatcagagggagactccacattgtttccatctcctcccctcaaacaattatcaaagccatgtagaacaaacggctgtctgccaactggtagaggcaaagcagccaataatctggacaggggtggcaaactgctcctgcagtttaaccctgcctgactctcccaagcaccagactgtgaagcctggagaacagcctgggggagctgaacaaatgcacaacacctcatgctgtcaagccagaggggaaacttactgggaagaagatgtaggaagaagcctggtcagcccacgcctaaagcacacacctggggaaataaattagctatttctattgcacatctacccacagcctggtccagatctaaatctcttcccctcccagcagtgcagcggcggcagccgcaggctcccccagcgccatctcttcagtcaggctcctctccaggtcctccagctcctggcgcacctcctccatgaagctgccaacttcatactcatcggggacctctctgggcagcaggatctccccatcttggtcacggctccccacgaaggtcggcttgcacacatacaccaggctgtggctggggagagatgggacaaagccaggctctaaacgtgggagcctgcccaggccgaaagctaaggcgccctgactctgtggggctcccagcctcaccttcatgccccctcctctcctgtctcttcaacagagacacttcacttcccgtcaacatctatcttaaaatgatggctgagggaggctcactttgggagaatgtgctggtggggggcagcttcccctcctccagcgcaggcctgacctcctgtgactctcaggccccgcagcccaggggcaggacctgagtgctatgtagcagcaccacagcccctcaaagactgtggcccattcgggcctccaggcaggagtcagcctgactctggggtgtagtctagccacatgcagggagccatggacctctgtgggaatagggaggaagaattcctttttttaaaaaaaattaatgtgtttggtagagacgggatctccctatgttgcccaggctggtcttgaactcttggcctcaagcaatcctcctgcattggcctcccaaagctctgggattacaggtgtgagccactgcacagagccgtggggaatgggagttctgcctgtctgcccagcagccctggattctgttgggagagaagactgagtagaggctgcggggaggacagggagatgtgccctgagaagctggccaggcttgagcctcatgcctcatggagtctcagcag

SEQ ID NO: 13483 - DNA, 6573 bp, Human; identical to SEQ ID NO: 13482

SEQ ID NO: 13484 - DNA, 36938 bp, Human
acacggggtaggaggccattgtggtagaaaaacaggacatgagcagacacaacgtaagacagagaaacgcctgtaaagagaaaaagcaacatcagtaatagctgaagaatacaagtaaaaacaatgaggttttctttttttctctttagactggcaagagctcttgttggggatagaaattattgtcgcttttctggagcacagtgttacagtatgttccagaatacaacgtgtgtcccgttttgacctgtcagtcccacctttagaaatttattctaagaaataattgctcaaatgcaaggaaatatatgcacaaagatgttcaccccagcagtgcttatcaaagtgaaaaaatggcagtcatctaaacaggaggcagctggttcacttatctgtcggcctaacagtgatagtgggaaacagtagctcacactcaccctcctgttttgcagatgagggaagttgggtccagagaggggtagtgacagctccagtcctactccacggagctcagaccccctggctgtaggcaggcaccctgcccaacctcttcaactgggcttggagtcagagtcccttgcaaggcacttgtcaagcccttttcaagggccggtttgcttaatgcttttaaaatacgagttctcaaaatgttttgcaaatttgtttacaatgtcttcatttcatctcatggctttccttgcaaaggatgctgacagtggggggaaaacaggccgactgcctggccgtgatagaggggaccatattttcctgattcccaagtaagacttacagtggaagaaaggatattttctgctttcttacagtgtttacaaaagtcataacaggatgtgaggactatctggctgcaacatctgtcaccccattggtcgccagagttgattgggctgatctggctggttaggcaggtgtcccattcctccctcaccactccatgtgcgtccctcccaaagctgtatgctcagaaaggatgaccatccccgatagaggaggactggtctttggtcaagggtatatgagtagctgcaatcttctgctagggacccccaaacaagctctcaaaagtcataacaggagtacaaagataataaggaacttgcatttatttgtttccttgatcatatgtttattgattagaagaaaataaaattagcagccagccgtggtggctcacacttgaaatctcagcactttgggaggctgagacgggcagatctcttgaggtccagagttcaagaccagcctggccaacatggtgaaaccccatctctactaaaaatacaaatattagccaggtgtggtggtgtatgcctttagtcccagcttcccagcgttttggatggctgaggcacgagagtcacttgaacctgggaggtggaggtggtagtgagctgagattgcaccactgcactccagcctgggtgacagagtgagactttgtctcaaaacaaataaaaaataaaaataaaataaaattagctttgtgtgtggagaaaagggaggaaaaataattagcattgtcagagaacatctgggttatttggtcccctccgtgggaactgccctgggttttcacttctagagtttctggttctggtttaatttttccacgccacagcacagggaccgagaagctgctcagcttctctaggcttttatgtcttcaccagaaaaatgagcgggtgggcttaaatttcctacaaaaactcttaaaataaatatgatgctctttccattctatcacatgcctgttctgggtccgggggtgtgagagatgcattagtgctgctgtaaaccagccccgggtctccccccccggccccccaccaccaaacccccaagcaccaacctgggttctccaccacttttgagagctcatcgaaataaacacacctttgtgcctcttgtaacaattccagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccagtaaggcctttggggcatgtcttcctcttgttaaacttggtgtcagttctcgggcatggaacatctagcagccagctactgtttcatcctggaaaaggggatgggaataaaaaacccaactctaggtggcgacacagttggtttttggctttaccttcccctagtttgtaagcaagaaggagccttcagcagtgctgaggcatttaacttccacttcctgtccccaaaatgttctacacccagagaaaaagaacagccttaaggccaagttctgtcttttacccctttcttcgtcttctttctttgctcctttgagcaagagggttaagtctatgggtgtcatctcagggggttcaaagagagctttgcctgagggcctctctgaggaagacagcaagtgtcaggtgcttaatgaatgtttatggaaggaatgagtggaggtcctctctgaaaacaatttaggaacattgatgttgtccttaaacattatttaaattagtatgaacttgttatattaaatagtatttttgtttatttttagacttgttgacttttcgtttgagtaagtaaattttcacacttacagtcatcccttctatatatgtacaaacacctagggaataaggcagtgtagaatattcaaaggcacattttgttttgccgaagcacctgcgtggaatcttacccaaatgtccatttaagaggttttcttttgtttaatgagggaaaatctccgaggaggtataccccctacagcagatgtcctttctgctgaagttcacaggtcgaatttggggagcacaatggctggaggtcagatgcccactaggagatgctatgattaatatgtaagttatcccagatgattaagacagccaacacccaggggctggagagtgggtatgagggctgtgagggcgttcttccatagcagtaactccccagcagaaagactgcgagatgttggccacaaaccctttgtcttgagcaagcgctaagggagccactgatgtgttctaaggcctctgtcatctggacctgtgggttccagcctggtcaccacccaagatttcccttgtggactctggtttgctaatcttctgtaattcatggagactcaattaattaagcaaccttaatccctttcactatcattttaatgtaactgaagtcatctgtgactgtcaggcagagctttttctcacctgagattatcacctggcctcaaggaacagatagaattctagacaaaagggagaggggagtttttgtccttccgtgcggcctgcgtgatctctgaactttagaactagctggggaaactctctgcctgtgaggaaccccagggcgtctaattgggaacactgttctagaatgcccatgatatgatccagtgctcctagaaacagctatttttgcccttgggattacattgtttgaagggccatgctctctcctttcctgtgggataaaggaaaaaggagagaggcccagctggcagtccatgccctcctgataaatgtatggattggagaaggcggtgagggggatttggaactccttcctctggggatttcagtctgttttcttctactgaaccacaggatgcaacgaaacttggttttctgaagtctgtgaaagggagggagatccttgctgtgaccccaggacttctgtggccctcagccccactacgcccctccatcccaattcctaaaatctaggggttcccacctacctgagaagcagaatatttggcagtagtgcctttgaaaagctgcctggggctctgctcagtactttgttggtactttaattccaccctcctcacttcgtcccttccctgccaaatagatatgtatgcacatttatctttgatgctcaatatgttttgcaaacagaataagcttcatttatccagaatgatggggggggagaatgagaggttatatagatatttcaatcctatggttaactaagcatttttataaacactacatattcccaattttcaaacaatcagaatatggtaaaatatatgttaacacacaaactcttttgagatgataacttttgtttgataacctgagaagctggtccaggttttatagtaagttcaagttaattttcatttgttttacccttattatacatcattaattgatactgtggctgttcgaactttatgattgtttggtttctggataaatgagagccttctgtcttatgataagaagctcttctgtatgtctttattaacatgcagtcacattctcttttgttttttcagagaaagcatggacacagacaaagatgaccctcatggaaggtaccatgaacctagtaatttgaacttcagcatccttatagccattttctttgcactgttacacattctgttacttggggcagcacccatgtcctcaactggagatgagcaaggaggccgtgagcctgtgggcgctcactgtgtccctccaacccccagtccccttgtgtgtctgcagagagatgacaggatcaggcagaagaaaacagcaatgtgtaactttgccattcatctccagagaattatgtttttatcttttgctttttcctccccccaggttagaatatacagaacaccaaggaaggataaaaaatgcaaggtaagcttggaccttattttgtctacaaagcatcctagttctggttgcttagagagcagctgaggaggctctgcatgtttggtcctgtctaagagttctgttgggcactgtcacctccttagggaataggcaggtagtgggccttggccgaggtggccttctgccctccatgctctccatactggctggcctttactctttgctgtctaagcacctttaacctgaagtggatttgaaggtagcagaaatcaatcaaggctcaagtttttccccagtcttcagcagagaacgtcttcctgactggagcgccctccgcaggagacatggctcagtgatttggttcctgggctgggacttgcctctgtcaggggcccctattgcactgcgagttgcaactgaatgcaccacatggggcatgctcggtgtctcgagtagattctctgcctgggtctgtcctgcctccagccacacttgctgacctcttcccattgcgtcctcagttcttctgccgttagtaccaggctgtgttctgaggctgcgtcatgacagactgatacagggggctgcagaaattggctgccctaaggcttcaagctcttccctcggaggccagccttagcaggagctcccatggctctgtatctgcggcagctgcagcaaactacatttccatcgttgctgcacctccttaggaggaccatcaccaatggcaggtgcacatcagtcagtgtcaccctgcctcagcgggaggagtgtgacattcctcagaggaggctcctggggacagatgtagcatctgctgcacctaggtggggacctagttttgatccaaggatgacggcgttggttactgggtgccctagtcagtgaggctgtgactggaaagaattggtgccctgcccaggtcacatggccacacagcgggctcctcacagacctcagggacagcccacggggctctggatgctctgtgctatgaagccaccacctcccttctctttcctttcacccccatttcaaaatccaatttgacaaaggctgagaggaaaagaaacgaggagaaatgaacaattcagtttactctgaagagacaatttttgtagcttttctcctgaattctaaagatgaggtaaacataaaaaaattaatactgacctggcagtgagaccattttcttggagactttagttgaaaagtctaattttaaacattctgcaaattctaaatttgccttgtcagatgaacattgaaaacagttacaactcatttatttttgtcatcttttcttgatgcttggttacattttataagaaatcgtttttcatattgttgttcagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgagaccctgggctctattgtcctttatgtccttgcccacaaatgttaccacccttgcctagaatgttcctatccctaaggcagatgtttattacttgcaattatgtagccttcagtagtatgcctttactcttcagcaacagccgtgatgccaaatgaagtgattattgagcttatgtgggttttgacatgcaattttgcagtcacacattctcagagcatagaaactgtgctttgcacgtctctgtatatgcatgtaatcaggctatgtgcctatcagagatgatactgctctgatgtctcacatcttgcctatgtttgtgcctggatcccatccttacaattataacacgcagaaatgtaggtgcacacagtgacacagaaaagtcagttcaaagatgaaaattcatcatggttcctttgaaaagtgagtcatgggttgtgggttctcgcgacattttgttgtcaggaatgaacactgaagatattttcatcttcctggaattttcccgaaccagatccactctttgtgagggaggcagtattttccttcttttctgagtgtggggagggtgagaaaacataggcagaaaagtggaagtgacttatccaaaccacaagagaaatctgaaatatatcaggcattttagtgaatgctgttcctggaattttccatagctagtcttggacttttggaggaaattggaaagtgggcgctcagtcagatctctgacctgcgtggtagaagaattgcgtctttttatatttgcacaaggccaccagaaataagaagtagctggttttgtctgactttagatcattacccaaaaatataaatgttgtatcctgtgctggaagaatggcatttaaaaattcatattagcaaagataacatgggttaaattattataaactaatttctattaaattggaaaaaagtggcaaatctcaagttacagtaaagagcagggatagggatcaataggatggttgcaacacgtcctgtctccttccctccccatggtactttgaattgttacagatccatttccttttattccttcactattctactcgctattctacagactccaaatcatttactgctggcatttttctctgttaagtgattgttctcctgaaaaatgccagattgacagccttttaaacctaagtcttgtcccctttcagtcctgggagtgcgagctgcattgactgaagcaatgcattcctccacattgccacgctcgtttaactcacccctgatgaagagtaactcacattaaatgccttccacaatatatttactcagggcctggaagactgaatggtttcccaagaacatttagagtggtgatttgaaggactaccagacaacccatttaatacagatcttaggaggagggaactctctgaggagcctctaccagtttacttccagagctgccttctttcttagaagcagattgttaaacttccttctattatctcttggttttccctgtaatgagaaaaacaggcttgttaggtctcctgtgggtaacagtgttctctcttccatggaattctctttggcttacaggattctgtccaaagccagatctaggctcatctcagttaaggcctaaacaataaaatttaaataccaggtcatagagactaggccacttacagaaggtttgaggcagcaagttagaatgagacattttctgaatatcaagtataccaattctttctctttttgcccctaaggtgccaccaatccatacacagaagcaaactacaaaccaacttttctatcagacgatgaattgaaacacctcattctcagggtatgttcaattatgggattgttttacaacgtttgtttttataaattttcaagtaagtaccagcatgtgggaatttgatgtttcaacactgagcttttttttttaggcctgcttcctctctcaggtccctccctttatcttattgtttggacaggcttcacatttcttccacaaaaccattctcctcctcttttaacctcgtctagacaaaaatggaaggtctatgccaccgcaatttaaaatcagaagagtcaggatttgttaaaaataagggggatttgagaatcacatttctgcatgaagattttaggaagggactgaaaccaacaacaattgagaatttctcttcacctgatttaaccactagcacaaaaaagtccacctaaatctttacaccaaaatctcatcaaaataacaaaactgtggctcacgcctataatcccagcactttgagaggccaagacgggcagatcacctgaggtcgagtttgagaccagcatggccaacatgttgaaaccctgtctctattaaatatataaaaattagctgggtgtggtggcagatgccttcttgggaggctgagacatgagaattgcttgaacctgggaggtggaggttgcagtaagctgagatcactccactgcactccagcttgggcaacagagtgagactctgtctcaaaaaacaaacaaacttacaaagactagtggtccaaaaaagaaaaataaatgcaagagatatatgctttcacctgcttgacttgagtgctctctctgtcttgctaaatctctgctgggagatggttgaggtggcactatgggaacctgttgtcttccatgaagaattaggtcggcacaaagctctaagttgtgttactaggtaaagtgagattaacttgggaattgaagggaaagaaactggattcagaaacgtgttcttgtagattgtaaacagatgaatagaaaaacgtaactaaaaggaaggatacccgcttccacctcccacaaagtcagggctgaccttacctgcacagccaacagaatcttcctacccatctttgagcagaagtttgcaaagctctagagtagagggtagtccatctggaattttgcatcatcactatccattttcagctctctataagcctggcctgtctgctcactccagcattctctatttatctcctcatgacgtgctatctcaaattggaaagcattcacctgcaaggaccagaagacctgatgaataaatagagtttaatttctcaagtataactggtctggagtaggttatgttgggttgctgcagtggttcaatgaggtcaataggaaccaggttctttgtctttgcactcagccacaccaagctagcatgctagcttgtttccttaatgtagccaggtacctttgccaggtctaagtagccagacccactgtaaaaacaggggtaaatgaagctctagtctggctgtcctttttatcaagaaaggatacaccttcctgaaaactcaacagtggacttcagcttattcaaaagtgtgtcacttggtcacgcctagctgcagggcagggtgcagaaacaagtgtttatagattttccagcctccctggtggagacaggcaagagagaaggggcctgggaatggtgttgggaattggcttccccaacagtgtttgccacacacactttccagagccacatgcatttgctcgattccttccagaagtgactcccacaacccaatatagtgcttcaactgtggtctgattggcctgaggttgaatgggactagtgccttccttgccaaaaaagccatctgattagtactgtatcatttggggcagctgcagtactgcctcctcccccttctctcctgaatatgaattattgttaggtcaggttttttacatcttgtataggtgcttttttgaacttaagataggacttctctttcatttctgtcaaaacctgtttgttgaatggccccacagtccagcttgtcattagtgacccttggaatctttgtgtgacttgtagatccaatacatgcctctgtgcctttcatccttgtttattcataaattcaacaaacatttttgtttacttactagatgcatggcattgttctaggaacatccaaatcaatgataaacactttagggtgggaccaggctcccgatcaagtgagtgatagtcttttggctaccactctcaggacacagttattcaaacacccaactttgcccacctctccatccttttcgtaaagatgtccgtgttctcagagaggatttgctgaggttaaaatatgaccgatgcctgtagcatctcgagagctgccgtcggtgccagcttcatgggcatgtgacctctgcagtttcacaaggccccatgcttggtttaatgccctgtcaccatcttgaaaacgtaatttttgaacaaggatccctgcattttcattttgtactgggccccacaaattatgtaactggtcctgattcccatactggtaacagatctgcagctgtagatgtgataggcctgcctctatgcctttcattcttgcgtattcatgaattcaacaaacccttttgtgtacttactagaggcttggcattgttctaggaacatccaaatcaatgacattttgggctggggtacaggcttgattattttaagaaaaagaatctatgtctttatttcatatatatatatatatatatatatatatatatatatatatgtaaaataattatcaagcagagtcctgtggatggacaaatttaaaaataaataaaacaagctccttttgcagtggcacgtgcttaatcgttttcttgttgctgcttttcttaataattttctatcagatacccatacttaccagggtatggaacaaggattatcatgctatctcagctaaatacttcatgttgggcttgtctcttctactcccttgtttatgcagcactcaagagtgatctctcttgcccgatgaaggttttgtcacctctctagcacgtgtcagtggctgtgaaatactgtccagtcccttatcacttccagggtcccagttccagggacttgcttccacagaaagccaggtctactcagatgatgttcagacagtttggccgcaggagctggacttctgcttttcctcagcaatgcaaaatggacaaactgctttctttactaagtgctttcaaaatatctttaataaagtgtatgtcagggatcagtcaactgtatcagtttacaatgtctacgttagtctacttccccatgttttgaaaactaggcagaccgtaccaaggcctctgtgtcttttattaaccagcaccatcttcccaagagtgaccctgccactggctggcccctgtggctctgtggtgctggtagtgttctcacagcttctgctccttagctgtccttcgggcccggctccttcacagatggtctgctggccagggtgctatggagttggaatgtccagagcctcccctcgctgatgcattcactgctttggaacctgctggctttcctctggagtactgaaatagctttacctgtgttgtcggttcaggcctgaccctgcccagcattacctccagggtgtcacagttcccttctgtccaggtacctttcaagccacattgccacatcaatgaaaagcctcaaaaacacttccatgagatacaagattatctgcaaggcaaacgaggaagtttttaataccctatttgttgacagaatgaggcttccagcagatggtgcttggaaagttacttccccctcactgtcatcccttgcccctgggccagcttagggacctaacttaggaaaggatcctccccagcttccttctggctgagtagcctgccagggtcttaagcaacagtgattctgttcccctctcactcatttcttctgtcccagcacaagtacatgcaccattcttttaccttctggcacattaattcatttcctagttctttgaattaaaccacatcatgaaggcccttttgtggaaaaagagaacagtttctctgtatttttccaaagagcagattaaggaccagtgaataaggtgagaaactagtccactgtgtattagaacgagggagggctgagtcataagagcaagggcatgacagagtggggcacaccctccttgtcaccggaagaccccagcaggagttgagtggttgtatgtctggaaggcagtgggtgggattcacacagcccaagctctcaggcactatagcttgggtatttacctgcttcagtctctttaccaaatgttgtcctatcttaatggctggctttattggaacatttagattttttcctgtatttaaactgaagaaggggtaagaagaatctaagcggggagttttgcttttctgaatgcaaatagtccggccctggatggagggataacatttgagagtagtagttctcagccctatgtacattagaatcacattaacgtggaagtgggatgggtttaaaaataccccagtgatcagccccatgccagaccatcagcataaaaacaaaaacaaaaaacactgctccgaatgttgagaaccactgttttagagagctccctgtacgtggaggttttcaagttgaaggcagatgatggctgagatgttggagaggggattcttgaagagtccttccaaatctcagattctctgactctccatagagttgttattattagagcaatgaaatatgattctctggaccatgataccttcaaaagaacacgtgcaagctgaattctgctttgaaatataacttactttaattggactttcttcctataataattagatgatatgcagaaacacacacacacacacacacacacacacacacacacacaatcttacagttcttcagagacgtttgttttcagcatcctgcactcaggatatcactgaaactgttagtgttcctgtgctttggatgcttagaaagcacatcctctatttgttatcagggtgattacaaattatgtttcctacagtatgagaaattgattatccatttctcctgattaggcagcagatggatttttgtttgtcgtaggatgtgaccgagggaagatactctttgtctcagagtctgtcttcaagatcctcaactacagccaggtattgttcatgctcctgttgatggtgggcagcctcacagcagtcagaagtgtcactcaattttgtcagaataattatagtatacaagtcacatgtgaacttcttccagaaaattcttaacttcttaacagataaattaatttagacttagaacaatcttgtaatatgttccgtattccccccattgaaagatctgactctgatctgatcgatagcattatggctttcttctattgctgcaaaataaatatcccacaatatgtggcaaggacagagggtaagaggctatctgacaagggagaaaggtaggcaggttaacacaataccagagaatacgtcacttggaaatccactccatactgtgtttgcagtgctgtgtcacttcttagctctattgaacctcagtttactctaaaaattaatgataacttataggatcaaataagagtaacatttataaacgcttctagaacagaacttttcacctattatgtcccccagagtttttattcatttattcattcactcacacactggtatttgcatggaagcttggtaggcagaagacttgaagaatcaaaatgacatttatgtaaattagaattaatgtaaatttaatttttccaaagatttctgctctttttagtctcagagcaaagttatggaggaagttgctgttatctctgttaatagacaaggtgactgaagcatatgatatgcgtgacttgcttgagaacagagaggctgaacagcagagctggaatcagagcccacccctatcttctgccttctgaggtcttacaggggaattccaagattgttgccttagaagagcataaactgtttatataattgagggttttcccgtcatgttatcaaaaccaacctccagatgcctccttcctggtgtcaggcaaagtggttggacatatgtacaggttcacataggaaaagtttgaggtctcatgcacaaaaacacaaaggcaacatgcagactgtgcatgcttacttgttgcataattgattttctgcatgcaattgacttgtcatgtttaacatttcatctccccagaatgatctgattggtcagagtttgtttgactacctgcatcctaaagatattgccaaagtcaaggagcagctctcctcctctgacaccgcaccccgggagcggctcatagatgcaaaaagtgagtaccagagaggcctcgcatttcctcagcagcccactcacaggcagccaaccctgagtgagcagagggcgggtgtgtgtgatgggctcagcctttccagtcctacttctctgtcctctttctggggcaccagagctatctttggctaaatggaattatttatgttctttggtcttttacataaaaagaagaaaaaaatctcaatgtccaaatttattgaaaagaagagctatttagactggattctttctgatttttagacttttcttttttctttcagaatctagaaaatcccagttgtatgctcctgagtttaaagggctaagtttgatttgttctcccagaacaaatgggctctatttacctgaattgcacacaggcagcctcataaaagtaagaaaacgtcaactataaatatggtgtttcttcaaccaaagtgttcctccttaggttggctcccccacctggctttcttcttttgcagtagtggaaccaccatccacatcgctccctctgcccccagcttcctgctactgcacacacttctgtgcaaggccccagtagctgtcatctactttagtcctgtgggaggctgtacactcctacagttaagaatgagagaatgaggactctggctgggcgcagtggctcacatctgtaatcccagcacttcgggaggctgaggcaggtggatctcttgaggtcaggggtttgcaaccaacctggccaacatggcaaaaccccgtctctactaataatacaaaaattagacaggtgtggtggtgcgtgcctgtaatccaagctacttgggaggctgaggcaggagagtttcttgaatccaggaggtgggggttgcagtaagctgagattgtaccactgactgcactccagcctgggtaacagagcaagactctgtctcagaaaaaaaaaaaaaaaaaaaaagaatgagaacacaagggagattactgggctcattccggctccaccattcactagctgtgtgaccttgagcaagttacttaacctctctctgtctcagttttctcatttatggaagagtacctatttctttgggttgttgtgaggattgaaagtgttaatgtatataaagcaggcagaacagttcctagcacatagtaagaacagtatcagtgtggcctaatgtcttgctcccaagctgtccacgttaatccctggaaaaaaataccaccagataatctccttcaagtcatctctttcattacagcacaccgcttgttcctaaaagtaaaatgcagactttggtatctgttgttctttatagtctagccttggcttttttaagtgaccttaggagaaaaatatgaatggcatttgggccttgcctttgaggctcttagcatatagtcagagaaatgagacagacagcaccctgcatagtaataggtacagccatagaaatagtgccaggcatagagaacggatgattaattctcatgtgggcgcaaggacaggcatcactgagtagatgacaaccgaggtgggtttgaaaagatgaattaatgtttgccaggtaatgaagggaggaacaaagaggaaacaatctgtgcacaggtgcaggggtgtggagccacatggcttgcttggtgctattggacaaaacgtgcacggaggggaagggctgaaccatgaagaccatttgttctgtggggacacagtgaagagctctgagttgggtggggcaggctcggattggcattctaggggagatcgcagagctggcaatgtgggaggtagatgggatgggaggaagcccagaaggagccctgggcagtggccattcctcggcacacttgctcgtgtgatggccatgggtgtgttttccctcggcttctgtactgacacctagccagtgtttggtaaggaggtgtgctcctcagaatcacctgggagcttttcaacatagtcatgctccacccccagagattctaatttggtttttccagacagcacagtccaataaaaacataatgcaaaccacaaacatgagccacatatataatttcatattttctggtagccagactttaaaaaataaaaataaatgtaaaattaactccaaaatatttcagcatgtaataattataaacaactaataagttcgttcacattcttttatttttctatactgtctttgaaatcctgtgtgtatttaacacttacagcacatttcaattcagaaaagccacatttcaagtgctcagtacctgcatgcagctagtggctaatgcattggacagcacagatctagaatggggtccaggaatctgtaggttgatcatgcatccagggtattctggcctacaagccaggttgagaacttaaggcagtccggctcccaccttgccttcccaatatccatatcctacccatccttcagtgccagcccaagttccttctcctctgggaagcacaggttgtctttgccatttatttggcactaatcatacatcaccctgtcctattattaatcttttcttggtgcacctccatttgccctttgttagccataagcgtctattgggcaagaaccccatactatatttcttttcatccccagagtacctaatccatttatttagtagcacactctgtgatttataaacatttccagactgacaacacacctgtccatgctgcatctgttaaagcctaaacttgggagatatttatctcatgtcatcattataaaacagtgaggcaggcaagaaaaggctttgctcaaggtcacactccccctcctgacagacaacactgctctcagtttatcacattttgtgtattgatttgcagctggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaaggtaacaatttaacagtccattaaaaccctgtgacaggtgaagcatgctttctgcagcggagctctcagctgggcgttggttccatggtttctggctggccagagtggcaggtcccaggactgcagacaggaccctgcagtcctccctatgtgtagggcagttgggagcagaggagagagctgaaaagcctgatggcagagatttgtggagaggcctcctctgtttaaattgtgtttcttttaacatgattgaggaagaatactctcagccacaatcctaactgccttatgaacagccaccagtccaccaaaattactctgagctcaccagtgaccttgatgttgttaaatgcgatgaacatttttcctttgtcttccttcttgaagtgttctcttctcctggattccatgaaaccacattcttcttcctcctccccgaccccctgctgctacaggctctcttgctggcccctttgctggctgcccctctctgtcctgggctgcatctctgtctgcagtctctctctgttggtcatgtcatctactccctcagctttaaatgccaacaacttccacattcatatttccagcctagacttgtcttttgaactccagattcataaatatactgcttactaaatcaacctgctttggatatctcaggggagtctccaacaggatacgtgccgaagtaatcacctgagcctctcctccagcataaatggcactgccatccagctggctgctcatgctagaagccggggaggtgccctcacttctgcttcaccaccccactcttcaatcccgttagttatgaagtcctgccacaatgagtcccatctgcaaaagttctctgaaatgtttgtccctttccatgctgcctactttcactcagctccgggctgcccccaactctcaccaggtctcataaagtgtagacccacatgctccccacccccaacacagcagccaggatgatctttttatcagtccccttttaaaaacccttcagtgttccctattgttcttgaagaaaagctcaaaatatttaacgtgaccatgcagcccccgaccctgccactaagcacatgtgagccatgttgacttcctttgatgcctcaagccccttctgggcaatgcttctgcacatgctgtcgcttcctggttggaatttcttccctctccccatgaactcccttcacatggctctctccaacctcagactgccttatgtcttatagcaccctactggtttgctttctagtgctttcttatacttgctgttatatagttatttgtgcgattatttgtttaaagtctgtctcccccactaggctgtaaactccacaagggcatgtctgatttgtttttcactctattccagtaaccagcacagactccacgcttggcagacactccatagtggtttgcttgttggtgaagtctataggtgctccacatttaatgtgtcccaaatcgaactatcttttttctctctctctcttctagtctgttttctttcttctctgagtcagtgaatgacaccagcaaccacccaatccagaaaagttagagtcatcttcatttgtttctttcccttaagcctgatattcacagcaaatcccaacagtttgatctcagaaatttctcctgctttctttctctgctccctctcatcttcactgcactgccatagttcagtcctcctaatctcttgctgtattatagccactggcccctgaatcagccttcctacttctgttttctactgtcttccagttcatacgtcactctgctcctacagcatccaaaccacaatttgattttgctgtttctgcacttaaatacctgtagatgctctccatttcctgccttaaaaagacagaccaacattggttagaaagtaatccaaggcccttttaatcttcctccaacctgcctttccaatttgcccctcactcccagtacctccaatttcacttcaaccacacagagctcttggccagttcctatataggctgtgcctctgtgcctgtgtacgtcatcagcctttatacattctagtccctcagccactgctcatccttcttgatccacctcctctactggttttttgggggagccttcctctccctaggaagagttagatattccttccttggtgtatgtaatgaatgtccatggtataactggccctacttaagcattctgacactggatgacagtttgtttctctttccgtctgcccctttcattagatgcttacttctggagagtgaagccttgatttttttttattttttgactccctacctacatcccatcccaccatcggccgtgtacacctccatggcccaaacctagtgctgacactaaccacgaactttgctttctagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagaggtaagagtctacatactacccttgagcaatgatggtagaggattttcaaccctgatctaaaaagcagagaagactgggccatcagctggcttttctaagaatgaagaaagaaagaaaaagctgggtgcagtggctcacacctcaaatcccagcactttttgaggccaaggtgggtggatcacttgagcccaggagtttgagactagcctgggcaacgtggcaaaaccctgtctcaactaaaaatacaaaaattagccaggcatggtgacacatacctgtagtcccatctactctggaggctgaagcaggaggatcagctgagcctcgggaggtcaaggctgcagtgagctgtgattgcaccactgcacttccgcctgggcaacagagtgagaccctgtttcaaaaaaaaagagacaaatgatgagagtctctgttaaaaaatgagattcaataggatatcatcataaatacagagatttttctgtcattctttggcatatagagacaattaagtggggtgccttgatgtccatggctaaaagaaaaacagtagggatagcatgctgtctgaatctatggaatgttccagaaccattattgtgattgaaattcttttgaatctaggacttggaagcaattatttagtcctgagctgtccaataaaatactcgttggccatggtagcctcccatgtggctaacggcacagacatagaacatttccatcatcacagaaagtcttgttggacagcgttgatctaatccaacctccttattttatggatgaagaacagaggccagcctggggactggtctcctgtaggattcacaattaattggtaatagacctggaccaaggacccaggtgtcccaaatttactgctgcctactgctttccctcagaatatgcacaggctaataatttttctggctactagagacagccacaacatgctggaaaaagagacagcctcagctgtcttgtggcctcagctgctgcagcttctggcatttggttgtcctgataaaaaggaggcagcaaaaactagaagccttgcactgaggtttagatttataccacattttaatctaattaatgtggttccttttttaaagacagatctcagtctgtcacccaggctagatctagtgcagtggcgagatcttggcttactgtagccttgacctcccgggctcaagcagtcctcccacctcagcctcccaggtagctgtgaccataggcgtgtgccaccatacccagctcattgttctgtgtttttggtaaagacagggtttcaccatgttgcccaagctaatcttgaattcctgagctcagacaatctgcccaacttggcctcccaaagtgctgggatgacaggcatgaaccaccatgcccgactggttgcaatttttaaagccccctcagatttgatttcttgtgataatagtccctttacaaaggctttgctctgtttccctctatttttatagccttgattaaattcagatgcctgaaaaaaagagagaaagatccacacagtgagccctctgaaaatccatccagctcttttgcctgcagctttgaccttgctctcataggctgtagcagggtttatccattgcaaagttgcaattaatcatctgaatggctttttcttctttaaatattcctttattcccttttagggcaacagctattttggcatatttaccacaagaacttctaggcacatcgtgttatgaatattttcaccaagatgacataggacatcttgcagaatgtcataggcaaggtaagctaggatgtatgaaagatcttaagttgaaagtgtccccttgcttctagactagtcaacatgaccttccagggaaatctgtccactgaggatgtagagtcagccagcctaggactcttcaggtcagaacatctgtgtgaagaggaagctgatacctgcaggcactgtttatcccccttgtagttgccctgtgctgactgcatggcagtttctgaaagacatctcttgttcagagggttttcccagaccctgtaaagatttagtatggcccagactgatctgattctcttttccattcaagcctgcactacctcctgtgttttctgtcttgactaatgctgtggcttcatgtgcaggctcctgagagagaccaacattgaccccttctttcactgtgtctccaccagatcctgttcattcacctcagacatgcatttccaaaagtctactttttaccacctctgccatcaccctggttcaggccctcgtgcctacttagagacctgtgatagacttctcagggtttctctgatccctctcacccccagttcatcttccatagttatcctatttatccccagatagattgagcctggtaacatcagcctgcttaaaaacctcctgctttagactcaagcccaaatgcttttgacaggcaatcaaatgtgagaccttccaccttctggccccagcccacctcctcagtttcagtccccatccctgcctgcagaggcctgtgctccaggcacactgacctcactggcccctccccaaccagaccctgctgctcctcaggcactgctgggttcttccctccctccttctcttggcaaactcgtgttcatccctcaaggctctgatctcttctccctgtatagccttccctcactactcttcttgagggcaggagtcatagcctgtctcctcttgtatctccagtgcctggcacatgagaagggctcattacatgttacatgaaagaatgaggttgaataggtgagtagcctctgttgatttggatgttcttagaaatgagataagttctatattgcccttgggctttgtgattgagataaagcatgacattttggacagtgccttctcatttgctggtggtcatgttagagctgattccagttagatgtataacatgcagttagtaattccctagagcctcaattttacagactatggaaaatcgtgacagcttcacaaatgaattgaaaggctctgagttagaccctcagaaacaacctatttcctgagtgttgaccactgcagtttccttggcttactaaagagcgatgtcgttggagctcaagtacctttaatattttgtattggatgtcctgtttaatactttggtctgagaaaacaacaatgtccatgttttctttacattttcagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttgtaagtacttttcctatatctgaagctccccttgcttcaaacagatgcctagggttcctcatctgggaaatggggtgcaggcaacatccagtatcacatcctttaatgccatcttgctaatacctgtgaagcctcaggactggcagaagctagaaaggattgttaacaaagggacaagcttcaggacttgtaccatgcaggccctggcttatgaaactgctccaggaaatagcaacatttccttccagataaagcagctaacctttgaattccacaggccctgcaccctaggcatccacttgtgctgctgtggaggaaggggttggcaatctatgaaaggctcattcaggcactagctcacactggccttggctgaggatggggaggtctccatacctgtcaggcagggggcccaagcactggcagctggaatgccatctcaaaaggctgctacctgctagatgagcagagggaggtgaaggagcctctctttggccaggcctgctccccacttttccttccccatagtgtccaaaaccccacctatggtaagagctgtgtgaggggccggggctaggtgcactgcaggctggcaggaggaggtgctgtaatgatggcagtaggttactgcagccaccacctctgctgaactgtgtcccacacatattaggaaggcctaggcaggcagtggggccaaaggccaggatgctatccattatattatcaaacagtgagacctgtttacccactcagacagacacttcattttctggcctgtccaggtccagagtggacaccggacaccttggccaagttgaaaggtgcacagttctgagcaggcctgactcacgtttccttattgctgggatgttcacagagccaacgtcctggaaggcggggacccaaccttcccacagctcacagcatccccccacagcatggacagcatgctgccctctggagaaggtaactatgtgctgctggggccctggggcttgcccgtgggaaggtgcttgtggtcaaatatcctcccctaaagtattcagggtcccctccattcatattctgtggaacaagggaggcctcgaggggatgatgtgcggatttccccatgaatgcagaggacactgtcatgtcactttctctgttgagccggaatactaggagctcactgctgcacttcccaaagctgctggcccctggaagcccttgagctcgcaaactccctactccccttgtgctttcctcctgtgttggctagtggccatgatgtgaagtgctctttcgtgactgtcactaactcctgtggttggcaggcaggtgtctttcggcaccagggtgtgtaccatacccactgggctcccttctcaggctcagccttggccctgcccctgctgtccacgctggactcatccttcctgggaccatcccccacatgcatggctgcagcccccatcgatgactcccacatccacatctcctggcccagtctctctcccgagctccagatctgtctctccaaatgcctcatagacagaaccacctggagtctcagaggcacctgaaattcagaatatcccaagctgattttctgcactcccctacctgattggttgtttaagccagaaacctggctgttgtctctcccccattatatctaaacacggagtcctgaaccttctatctcttaaacttcgtcaccactattgctatttcaccctcctcatctgctgcctggattattgcaaatcacttcgcaactctagtccccctctccccaccccatcctccattgtagttcattctccctgccgtggactttctaataacccagttctcatttgtgccttttctgtgtatcgtcctttggtactcctcattcccttgtggaaactgtccaaattcgttagtacggcatccaagaggcccctcatgatcggattggtacctgctgccccagtttcatctatcatgctctcatcatcatttatgatgaattccttggaggagtctcccaagttttaacctgcctcagtgctcctgcacgtgttggttgctgtgcctggaatgctttctcctccttacctctctgccaagctaattcatattcatctctcaagactcagctcggggttaacttgctccagaagctgcacctggccccagatgagttggttgcctcgtgcttgcctgtcaaacttacaacattttgctttagccattgttcatcttgttggttttcctgttaaactgtgagctccttgagggcagggacttgtctctgtaaccctggcacatacagtggtcttcaataaacgttttttttcagtgcatgaagggaaagaattagatgctgtatgaagggaaaaaactggcctcagatcctagaaggaaacttgagcctttccctgctggaatgccttttcctgacaagctgtagccctaaagtccctcaaggcacaactctgatgttgaactgcaagtggatcatgggataaactggttttactttaatacataatagtatttcttcctcagttttcccctttcctactctcagattcctttgttgtaggtggcccaaagaggacccaccccactgttccagggattccagggggaacccgggctggggcaggaaaaataggccgaatgattgctgaggaaatcatggaaatccacaggcaagtaacaccttctagttcctctgttaaaccagtggttctcaacccagggaaattttttcccccaggcaatattttgcaatgtcaggagacatttttggtcttcacaactgggtgggaggttgctacttaaacatcctgtggatagagaccagggatgctgcttgttaaacatcctacagtaaacaggacagttccctcctccccacccaacaaagaattatccaatccaaaatgttagtagtgcctagattaagaaatcctgccttaaataaagaagctaaaccaaaatagcccagcgctaaagagaattcttgagaagacttaactttcttatggctcaaggagcttctcagtgcggatagatgtacctttactttacaggaatgcaggagtagagctgtgaactatcagagtgatctggaccttaacaaaacattcactttttttcaatcaaagagctgcccaggattagtactagaaaccaagcagatcagctagttattactagctgtcttgggagagacttcctttccatatgaaagagaaggagcttagaagcagtccacctgggtctgagtcctgggcctgtctctctacctggctatgctgagacttacttaacctcttgctctctgttgatttaaaccataaaaagaaagcactatttcccaagaattgtgttaggattgtgagggcactcaggaaagttccaggaacacagcctgacatatagtgagtgcttaaaaattaattaaatctgtctttaagagcagtcgagagggaagcagttatcataagtctgtccaaatttggggaatagagaaggtggtaaccagattcttcagaacgaaacttaatgtaacataagaaaaggaagaaaacactgctgccgctggattctctcaggagaattagaggctggcctgttttccaattggccataaaggggctgttatccccctataggtaacacagctcttttccaaccccacaggattagtgggtgtgacttctgcatcaggaaggagacatgagggtagtgtgcagtgtaatcaggttcaaaccctatactttgcatttgcataccctgtattttgcttgagaccatccaagaacagtatcaaacagtccttgacctcaagaattttaaaatcttttataagtctattttctttatgataacaggaaaaagggagggtgcatgggccaaagcaagcaaaagaggaaagatttgaacttggccttagccagggtttgcaataagagtggatgttccctctagaaaagccagggctattcttgagtgggcatgtgagtggcaaattcagggtcaagaaacaagctacctaactgggcaggctttgtgtaggaaggagacacagagctatgataggcgattaagaaacacaagaaatgatactgtgcagtttggaagaaacctgtaagaccccatttgttgtaggatgctgaacaagcatccaaagtcttgtgttacgctttgtggaagttgcattggaatagggagagatgaaggtgggcatgtttgacaactcaggaatgaggccttatcctacagagatgacactgccaaaagagaaatcaatcatctaaggtctagcgtttgaagatgaaatcaggaatgatgaaacagcaattccaagatgagaaacctgggaaaatagtggtttcatagacataagtagagaaaggtgggggacactcagcaatttttccgtaagcaattagcagccgtttgtgcatgctgagaatacatgatatgtagttgtaaactgccgttaagaagcttataatccagaaagaaaacttgttcactcataaatctagagaactaggcagtacaagaaccaaaagacttctgggtggtggaggagtggtctctgggtcacccaaaagctacattcatccatgtaggagctgagagtcctgtggttacacaactgccatcacactctccctaaactgtagctgcaatgccaagtgatggattctttcctgaggtccttcagcctgacaagtatttaggtggatttacagttctaagtcttcccttctataaatcttctgagagatatgctagataagaaaggcctggacccatttttcatcaaccactgccttcgaaggctgcttttcctgtcactactactaggctaccttttagaccctggtgccgtccatgtcctaagagtattcactagctaaacagtgtttgtggagaaggggacaaattgttttctgtggatcaaagatggaggttgatcttagaagttctcctccaattcacctggattctgtgaggaaataaaactggccacttacttgaaattcaccaactgaatgcaaactccaatccaagggctttgtcagtgagatgcttgactctagggactgcgttctagatcaggtgcctgtagaacaaatccagcttgtcatctgtttttgtaaataaagttttattggaacacagccacaccgattcgtatctgtggctgctttcaagctgcagaggcagagttgagcatttgtgacaagacaccatatggcctagagagcctactatctggccccttacagaaaaagcttgccaaaccctaatctagatcttcatcccctttctcacctttaccccttaacaaagcacatacactccactgaaaaaagaaaaggcagtgtaattctcttttctgacaggataagagggtcatcgccttctagctgtggctccagcccattgaacatcacgagtacgcctccccctgatgcctcttctccaggaggcaagaaggtaagactgatgattcttagcctaagctagagaacctcttgcccaagatctgaaatgttgggggtgggagtatggaattgcaactgcgattgctgaaacaatttggactacttcctccttgaagtaaatgcatctgtgtgaggctggatacaaagcatactggtagggctagggaggcttgctgacatcctcagaggctttcttccatgtgagtggaagaagggagaaagaataaggaatggggaactgtcagttcatttaattgagggagcaattcaagagttcccatgagggaaagattattgagtacctcacatagaaaagtttctcattttctgccaggaattttcaagggagaaaatattagtgtctagggcaggcaatggaaacagcaatgccaccagcagtgctttggaaatcaagccatgctttatagctgcagaatacttggggatctgctgcctgggggttccattggtgtgacagcattggatccaagcagtggatcaatcaccagccctcatgaagagcttgctataagactacactataaataggtttaggaaccagtcatttgttttcatctttgctggagaacttataagcctaggcccatcttaatcgtaaattataaatctgtttatattgcctgatgccagtagagcttaggacagtttaaaggccatcattttggacacaatggcttcctttccccatctcctaaaacagagagagagaatatcaggaatttccataggcaggactcctagggcacaaaccatcaaaagcagggcaaggattttcaaaactgagctcctcggaggtttgttcaggttaccaagagctgtggtgttaccaggtgggatgggcgtggggatagttgctaaggagagagggtaagagtagaaatcctgcttctacaagggcagcaatacttcttttttatacaggaatcttctgcaaacatttctatttgaaaaagcgttttgctccccccaaaaaaggttgaaagttaacaaattaatgggtaagactacaaagtaagaaagacctgggttcgaagcttggccttgccatgtgctagttatgtgaacttgtacaactttcaagccctagttttctttataatggagctaataatggttagggtagccagcatctttgcacgaggtcctactgtgagataatatatgtgaaagtgcttggcccaaaataccactgacagatgaagtctgagcttggtgtcccgtgacccccgcccccctgcccacaacacacacactgcttgccagctgtcttcttagctgttcttctgttatacctccaggtccttcctgcatattggatccaccatcttcttagggtggtcttccagtctctgcttcttaagttaacttttaggcacttgacttgactcctggtattaccaaggattctacttcttggttttgaaaggttatcagtccagtataggcttaaatattactcaaagaactttcatatacattgtctcatctcaccttcacaacattatagtgacaagatccaggctcctcagcgttcgttttataagtatggcccccaggctacaatcctgggctcatggcttccaattcttttcacatcaacaactaccagaaatcaaaagctgtgctctgcatcataaagccccagctatttttgaggcacttatgaaaattctcccttttctttgagaagaatggattataaaatggatctgtgagaagaaatttggatgtgttctcacgagatgagtcctgggcagcaggacttataagaaaagcagcttaaacaagacagttaaaactgacagcagtattaaatggtgcaccatacccagccctttccagtcactttcaaatttggaaggtccaaaaatgaaccatttagcctgcagttgtttgtcaggatcaagctaaaaaggaagcctaagtgagcctccataggtcgcaagagagtacagacatccagaagcactaaggaaaattcagataaagcagcagttctacaaatgtcatctgcagtctttttccagaaagagagggggcacaagatccttttaagggtctgcaaggttaaagctattttcttaataacattaaaacgttaattttttccctgtattgataatgtgcactattcatactaaaagcacggttgggtaaaattgctggcattttacaaaaatcagacaagtggcaccaaactatactagtagtcattgtattcttcaccaccacacactcacagtaaaaaaatagtttaaagccagtttcatttaagattgtccatcatggctaggtgcagtggctcacccctgtaatctcagcactctgggaagctgaggcaggcaaactgcttgagtccagcagttccaggcaagtctgggcaacatagagaaatcccatctctactaaaaaatacaaaaaaaattatccaggtgtggtggtgtacctgtaatcccagctactccggggactgaggtgggagaatcacctgagcccaggaggttgaggctgcagtgagctgagattgtgccactgtactccagcctgggcaaccagagtgagaccctatcaaggagggaaggaggaaaggaaggaagggagtgagggagggagggaaaatgtccatcattacttttataaaattctcaagcacacatctttttaatgctctgtgacaaaatgagaagtacacagaacttgtgctgcataccaaagtatgatgtttgtctcaaaaactacttgtgtgattaagttgtgagttgaactagctactattttcattggacaccatttttattgtatatggtcattcggttttgggtatttagaatactttttttttggaaatgaatgaagtgaacctgtcactttaaggaaaatgactgacatttgttgccaatgataaaatctgagctttcaagcaaaaattggaatttttagaaaacttgtctctgctactttgaccttgagatcttcctaaaacttaaaaaatgttgttgatgagatagggagtattaataatagtgatattttgatgctctataatgaaatgtgtcaatatatagaagatctgcataactcagtgaaccaatattttgtaactaaacaatgcaaggtatttcaaaatcatgtaagggtaaaagatccatcctaagtgccaagatataaagagtacaaaacattcattgatatggtttcagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgttgctgtggaaataaagtaagttataatgccacctgctggcaaagcctgaaatcattgctgctcctgaaagcagcagctaccaaactgtttcctcacgtatatccagataggtctcaaagaatgctcttctttgagactcagccaggggaaggcagctggggtgagtgggggagattttgagacagagttctcttactgaggagtagtaataatcctccccagtagcctgtcttaacttaaaccacaggttactgaagttggcacctgtagtataagagatttacttctgttttcttcatttgactccttgagctgtgtctcttcacagcttgttaactccactttttcttcttcagaaatatctgtcactataagatgttttattcccttataggggaaatgtctagctgggctcattgaagtttaggcattggtcctaaagaaatatgtgggcatcatgattccaggcagttgaatgctcttgggattttattcagcctttaagttgcctctgtgggctcactaaaatggagagaaaagaatagttcgggggagaggttttttcttactctgaccatgtctgtctaacagttccttgtttgaaatcatccaatagaaaactgaagccatttgaagcttctccccaccccaccccatgcttcattttccttttggcattgctcataatactgattcaaacttcacacttccctccttttgtttgtagattttaaatggagggactccagacattccttccagtggcctactatcaggccaggctcaggagaacccaggttatccatattctgatagttcttctattcttggtaagtggcatcattattcgtttccattgcaatgagcttgcaaaacatcttacataaagtcaattttaagaactgaactgtgtgaaacaagctaatcctagataaatttgataggaacagaataaaagtttaaaatttgtttaaatctctaaaaagttgaccagtatttgagttttggtggaggtccaagtttgtgcctggaactcaagaggaggctacagctacctagacataggctttctcccatgtggggcataatctcttcagagagagaaggctaatgaaggttcagagataatgcctagaagggtgattagtaagcatatcagaaggtattaaaagtcattaagtgaaaagagtttgcttttcccatcacatccatctttttctcccctgggctttctagatctgtttttttcctaaactctccctacctatttgcctttctttttgtaactcctcttaactggttacatcagattattaaaataagcttgactcaaatatttttaacatttactaaattttaagcgctttgtacttatttctaaaatgatcatttgattccttagagctgtgtctcttcacaacgtaaccccacttatttcttacgtatttttaaaaaattggttctttcctctaaaaaacagcgatataaaaaaagatagccatgcagcccaaaaagcagcatctcaccctaccattaaatgtaactttcttattaaaaatgtgcttaggaattgcttacttaatctgaagatgctttaaaaaagaaatcactgaccagtctttatctcctcccacaggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaatactgttcacatttcaaataattagaaaaaaaatcctacgtgttgcagggctggattataagtttctacagtgggtgttcaaggatgatctacgccagtagcatttgtggtgcttttctggccttcataacgattctgggcttgcataatttccccatgctactagcttagctgtgttgttaaaatagttcatttataaattgttgcaattttaatttatgtgagaacaaagatgttactgcttatccacaaacatcgaatcctctgaaattataaattcaagattatatttaacaaattggcttctctaatgctgcacctctctaatactacttcagttatatagtaagtgaccccagtcctaaagcacctaaatatttgatcccttcttgaattggaccacagaatatttagaatagcatttgcataaataatttgctaagcaaagtagcatggtataatggaaaaagcactgaactagtatgagaaactggctctgaaacttagggtgactatatgacctagtaaagtcattttgcccttcatatcaagttggactagaaaatactcttttcagctctaataaatattgttttgatttatagtacattttataattagggaatttaaatgcctcatcacacatatagtaaaagttccttgagctactatttctaataatacttacaccaccgagatgggaaattatgagactaaaaatctggtcaatgtggttataaatttggtcagaaacattaaaacaatggaattttattttgatgaaaaactcaagtttacaatcatttagtaaatgaagagcaaacacttcattttcctatcccataactcttaagaaaaaaaaagcattagtaaataaatatctgtgaacagattaagggtaaggcagactggataataaaccacctctgacattcacactccctgcatgtgactcactctaaagggtgaaatggctctggagataactgaactggtaagatatgggcattaaatctcatcctgatcattcagataagcccaagataaatactttttgctcatcaagggcagcaaactatacaaattgtactggaggaatactttgacagaagcacttaaattatattgtgcatcacaactataaaatggcttgaacatttccatttaaccaccatttataaagtgcaactatatattactctgcattttatctgaggtgtgatgaatatcagtccaaactgaaagtaccccagctgccaatttccaccacttctgaaaagacctagctgtgtgaaaaaggaccatcccccatacaaagaaccaatttcacaaacctactggtaaacaaatacatttacaactggaacttcaaaatgctagagttgtactcatttaaaaaaaaaccattcagctacctttggtctttaaaaaagcctacactgcaatatcctaaacattgttatgtgcatctcacaatgaagaagagtggccttgcagtgcagaatgaggagagtacaacgtcactgtgaagagtagcatgctatggtttcaaggaagatcagcatcacagcattggattctgtgcatcaggatcgaggtcactgttgccagaagggggatggatagggagaatatccagctcatccacttgtggagttggatgcatgactaccagctggtcctggggaatgtctgctgcagctgctgcaagattggtgatagatttactctttacacactgaaagtctacatgccgactctttccttcttccttctcccaggacattcgaataaagggtctttggacatagttgtagatcacttctgggcggcctccaggccttttctttactttttctttgtaggtaggataacctgaaagaaagaaagattttaaaaactgaggagacacacacagacctctcacccaatttcgccttagaaagcttttctgctatagatcctaaagaaacaaatttaaaacaaagaagtgaaaacaatattccatccacctactcatcagttcat

SEQ ID NO: 13485 - DNA, 7802 bp, Human
cagttccagtcccgggtcctgtggccgccctgccggcggaccctgcggagagcgagtcttagatacccagtccccagccccgagttgttattccctcgctgtagttaagaaggaggagatcaattaagggcatcttagaagttaggcgttcccgctgcctcctttgagcacggaggccaccaaccccctagggggaagagatgtagcgcgaggcaggggtgtcgtgctaagaaatttcgacgcttctggggactgaggacaaaggtgcggacacgaccccggggtacctggagttccgtgactcgcgccacggacggcacacctaggggctaatttctgctctgcctcaaagaacctcaagctagagtccttgcctccgcccacagccccgggatgccgctgctgcgctcaccgcacaggcagcgcccggaccggctgcagcagatcgcgcgctgcgcgttccaccgggagatggtggagacgctgaaaagcttctttcttgccactctggacgctgtgggcggcaagcgccttagtccctacctctgctgagctgaacgctcaggcacagtggaactgaaacccggttctgcgggatgtgagagctgttgaggtcacgcgtaattgggtgtgatggagggcgcctgttcgtgatgtgtgcaggtttgatgcaagcaggtcatcgtcgtgcgagtgtgtggatgcgaccgcccgagagactcggaggcaggcttgggacacgtttgagtgaacacctcaggatactcttctggccagtatctgttttttagtgtctgtgattcagagtgggcacatgttgggagacagtaatgggtttgggtgtgtgtaaatgagtgtgaccggaagcgagtgtgagcttgatctaggcagggaccacacagcactgtcacacctgcctgctctttagtagaggactgaagtgcgggggtgggggtacggggccggaatagaatgtctctgggacatcttggcaaacagcagccggaagcaaaggggcagctgtgcaaacggctcaggcaggtgatggatggcagggtaggaagggggaggtccagaggtctggatggaggcttccgcatctgtaccttgcaactcacccctcaggcccagcaggtcatcggccccctcctcacacatgtaatggatctgaagagtaccccgggacagtccggggagatggagattcggaaagtatccatggagatcttacagaatcccctatgcggaccaggaaactcttgtagatccctgcctatctgaggcccaggcgctgggctgtttctcacaatattccttcaagatgagattgtggtccccatttcaaagatgagtacactgagcctctgtgaagttacttgcccatgatcacacaaccaggaattgggccaactgtaattgaactcctgtctaacaaagttcttgctcccagctccgtctcttgtttcccacgagccctggccctctgtgggtaataccagctactggagtcagatttcttgggcccagaacccacccttaggggcattaacctttaaaatctcacttgggcaggggtctgggatcagagttggaagagtccctacaatcctggaccctttccgccaaatcgtgaaaccaggggtggagtggggcgagggttcaaaaccaggccggactgagaggtgaaattcaccatgacgtcaaactgccctcaaattcccgctcactttaagggcgttacttgttggtgcccccaccatcccccaccatttccatcaatgacctcaatgcaaatacaagtgggacggtcctgctggatcctccaggttctggaagcatgagggtgacgcaacccaggggcaaaggacccctccgcccattggttgctgtgcactggcggaactttcccgacccacagcggcgggaataagagcagtcgctggcgctgggaggcatcagagacactgcccagcccaagtgtcgccgccgcttccacagggctctggctggacgccgccgccgccgctgccaccgcctctgatccaagccacctcccgccaggtgagccccgagattctggctcaggtatatgtctctccctccctctccctccattcgtcattttctcactccctttcctcctctccctctctctccgttagtctcttcatcagatagtctctgttagtccgcgatttataccaggctcgtgccctaggttggatcggacagtctcaatcccccggctcgctcttcctgctcggctgcggactccagtcttactctctcgcactgcacacaggcttaggccagtctcgggacactcaggctccccagggaccgcgcacagagcctgaggcaagagaaactttccgcagacggtgcgatcagggacggcgtctggagcccagcagtcccagggaaattggttcagaacctggaacagagcggatgggtggcaaataggcacgacgactgagggacaagcagccctaaactgcaagccccagtcacaggctctgggagcaaagagagaaagtcttgggtcccaatttaagagtaaaacttggttcctgcaggggactgaggtgccagcaggcggagcttaggctgagcactaaaattgattcttttatttctcagattccaattgcagagataatctctgtggatagatcccacccctcccaccaaggtgtatgcaaaagccccagaagaggaggacagctctgggtttccttatgggatcagcttctgtgacaggggcctgggagcatgtcctccacagagacctggctaacaggtttatatgtatctgtgtggctttggggagaagggtaggactgagacctcccccactcagctctccctctaggatcgctcctccagctctatcagactgtgcatgctacaggcccactgaacctcccagaagtccactgtgctgatgaggaaacaaaaaagaagagaaatataatgaccagtctgaagccacaaagccagagcgttagaagcaagacagaaaaccaggataggagccaaggtctgtgggctcctagaacttcgaactggcgcaggtggtttatctcattcttcccttgcagagaggtgtcatgggcttccaaaagttctcccccttcctggctctcagcatcttggtcctgttgcaggcaggcagcctccatgcagcaccattcaggtaagacagcctgaagccagaaccacactggtatcagacaattccatgcctcttaagtgtggtgtactgaatgcttaaaaaccgacagggggccggggtaaggtatgtactcatgcacatatataattttttgatataaaaatgtgtggtacacaatttataagtagtgataaatatttagacaatattcttcattataatttttttgagacagagtctcactctgtcatccatgctggagtgcaatggcaccgtgtcggctcactgcaacttccatctcctgggttcaagcaattctcctgcctcagcctcccaagtagccgggattacaggcgcccaccaccatgcccggctaatttttgtatttttagtagagatagggtttcaccatgttggccaggctggtctcaaactcctgacctcaggtgatccacctgcctcagcctcccaaagtgctgagattacagccgtgagccaccgcgcccggcctattataaattttatatagcccactgagtctcacaaaatgcttttgttgcttttagccaaacttttgtatgtgtagccatcctatttatcctattcagccatgatttgaaaaatgaattgcatcctattctgttaaatagtttgccactaaatttgttattgttaaatctggtattttacctgttgatctatttctcacccacatataaatctattaaactgaaactattttcaggttcagcactaactgtaagtttttgcatttaatttttaataatggctgcactcagcttgcaaaattcttgaaaatttaaccattagctttcacaagcctatacaaactggctccagcacaccactgcttagaggccacaccagtgcctgggtcctgaggaggacactggccttgtgccctgtcccctaggactcccgctggccacatcctcaggggaagaagcaaagaccaggaagcctggctgcttatcctggggaggggcaggcaggggctcacagcctgcactgagtttgcttcccctccacaggtctgccctggagagcagcccagcagacccggccacgctcagtgaggacgaagcgcgcctcctgctggctgcactggtgcaggactatgtgcagatgaaggccagtgagctggagcaggagcaagagagagagggctccaggtgaggctccccaagcgctcagcacagggcctcctctccccgcagcatacacaggaaggtggatcccgagaggtaggagagaacacactggccaggaatccaacaggctgtgttgttcaccgggacctggggcccagctgttctcagcctccaagggagacagaggtcccactgcagctggaggtaccgtggttagacataacaaaaggctccgtttctgaaagttcttaggaaatgaaatggggaggtgtggaatcgctcactgtgggaattgttcttgcagtactgggagacctcccagcactggatgagttaagactagtaagggtgaagtcagggatacacatagtacatctcaggaagttttagaaatttggatccaccttgttaatctgcatacgacattctttcacacctgcaaggagctttcatttcacatttgcaaggtgaaggtgaggcccttgcaggggatggggatgggtagagcagtgtctgaggtaggtttgagcctttaaatgtgtggcatctgtggagatgtgcatgttgtcaggaggccagggagagcacccttccccagatccacatccctgtgtaccttgagcctgagcagagaccagcccctggcctggccccagcactgctcaggcagaggcatgtgttgcccctgcatctgccctgagaacccctctgtcaagcatgaaggactgaacagcatgtggaatgccagaaaagatcatccttccccatccagcccttccctgcattgccctagcccactgcacctctgagctctcctaatgaaggatagataagtgagctgccctcctgcctgcccctcctgctcccagggtcccctgcctggtctaaccttctaagtgactgcccatggggacagattctggtgcatggtactgtctggtatgtgttttccctgcagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaagatctgagctgtggtggtcattgctctgatctatgtcccaggcttcatagtgtctaagacctatgcttagaaatagccttaaccctaggctagctggacagaggatatggtgggtggtccctttgaccaagctcaagcaggaagaacaggggtcctaaggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtcccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtgactgcccttgtatgatgggatgggaagatgaatgactggtttttacaggggtgtaaaaccactctgagcctctctgagaccatgtggttttaaaaaatccataagggaaggtacccacaccagtatctgagttccagtagctaagaccctagaatttggattcatctctgttttttcagtctctccttgtaaccctgagatcatcagaccaagaaatacagatcctgtttatttagaacactgctgtttgacatttataattttgattattctagcctttgagtttgaaagataatgacactatcattttagagtatacattactatgttgtgtacctctgaattaagtgtacagacttgagttcaagaactgtatttgccctttaccagctatatgaccatgaacaggttacttaactctctccaagcctcagtttctccatctgtaaattgagggctacaatagtacctacctccaagcattactataaagagcaagtgaggtaatagatgttaagtctgacaattaaccagtaactaaattctagctgttattttcttcctcctaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatggaatctctgctgctatttatgctatttttcccaggagagtttcaggggcctgtaagcactctgttgaccaaccaatctgactcacttagcacaaagacaacatgcctgggatggatccctagtgtcttgtaccctcagtttctagtgaagcatcccctattg

SEQ ID NO: 13486 - DNA, 10751 bp, Human; identical to SEQ ID NO: 12097

SEQ ID NO: 13487 - DNA, 11770 bp, Human; identical to SEQ ID NO: 12720

SEQ ID NO: 13488 - DNA, 11770 bp, Human; identical to SEQ ID NO: 12720

SEQ ID NO: 13489 - DNA, 7686 bp, Human
gagagctctccacggaggtcctcacccggatggcactgtgagcccgagtgggcgatgtctgctctcccaggggcagggggtggaaggtggcacagtttggaccggacccccaccctcactgcttccacttaaacccccacttctgcctgcctgcatcccaggcctaacagatgagttccgcgggcgccccaggcgatgctctgagggccacggaaggatgcggggaccccgagcggagggcagggcctccagggggaagaggcactgcagacggaggtgtgggtcttcccaggcaggtgccggagccaagcgagatggtgggacggggaagagagggcaggccaggctggcagccagctctccacctacgatgcgtggagcctcccaactcgcgcactccgtctccccaccgctgcttcctctgacctggctgcagagatgagaccgccctccgggcaggtgacacggcccttgctcttcagcctggaggccaatgcttcctccaaaggccctggccccctcagctccgggcctggctccggttgttcccaatgcaaagcagcaagggccccggggtctgcggacgggggcgggcggccgctgggggcaccagctctcggccgggccagaacagggggtaggaggcgcgtcctgtgcggtcggtggcggccccaggtgggtgcggtgcgctggcaggaagcggcagcacgacccccgactttgcatctggacttttctagtaacggaccagctccttctgccgaccgggccggggagaccgcgtggctcagtggctgcagcggccaccggcccgggcgtgggggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcggggcggccttgggcggggacccggacccgcggttggacgttcgcctcggggggggcaatgtcccctctccgaccccgcggtccccaccagggcggcacaccccgccctctccccgcctccgcaggcgcccagggctcacaggctcggagcggcctccgcctctgccggaccacccagggccgccccgccggaggggcctccccgcccccgagccctaggtcacgcccggaaggcccggggcccccgcgtccggccacgccatccgcccggcggccccagggactcagcgccggggtcagcgcaggccccgcccagcgctcccgccccctccagctggccggcccccgggaccgcgcccccgcccgcgctctccacgctcgcactcgtatgggcagggcggcccggggtcccccagctccgagccgcggccccttgaagcgcgttacctggacgtgcgctgtccgcagactctggacgagctgggcctgggcgctgcgcggcggaaccgaccctgtcctggaccgcaggcagcagctgaccccgcgccaccggcctgcgggcgagacctcaggcgcgagacgggctgtgtgtgtgtgtgtgtgtgtgagagagagagagagagagagagagagagagagagagagagagagtgtgtgtgtgtgtgtgtgtgtgtgtgtgtgtgtgtgtgtgtgtcgggggaggggcccgaggacccgcttcctagctgagcgtcaggacggggggcggactctcaggagccgcgcggcgcccgcagaggagaggaagcgccggagacccccctgctcccacccggcctccctgccccgcttcctttcccggggctccagagaggggagctccaggcgtggggcgcctggcccacgtggtgcggcgccgggcggggcaggcgggggcgcggcgagagccgcggagctttctttatgggtgggggggcgggggcggccgggctccgcctccgggggatcggggcgcgctccgccaatgggtagccgggcgcggggcggggccgcggggccgccgcttaaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcggtgagtgccggcgccccgggggcggggttcgggaccttggccgcccctggtctcggactgcgagcgggggcctggagggcgcagagctcgcggaggtggtggccacacgcaggctccgggctctgcaccccgggcgggtgtcagggcgggtcccagtggaaaaacatcctctggccagccggggtccggcgccagctatgggagtcgggatccgcggagggcagcgcctggggtgtgcaccctcgtggcgggtgcgctctggagccagttctcctggcggggaacaccctgcggagggccatggctggcaccccgacgtgccctccagccgttgcgagtggccccagccccgggaggcacgcccggcacgacagcaagttgcatgcggctctctggaggtgctccctccttagaaagggctcagctcctctagctcctggaccacccatggggagggagtgcggcaggcggatgggtgggcagcaggtttgcctgcgagtaccctccccgcagtttctccctctcctggacaccctcggtccgaagcagggagggcaggagtggagatgacggggtgcgccgtgtgcacgccttggcgtggtggggccggtcagttttccagaaattaggactgcagagtgaagaacttgttgctcaggacaggccgcccccaccgagtgtcctctggttgggtttcaaatggttctcttggtttggggctctggttcccgtatcctgctcctcacctggaagaagggagcttggagcttgcgtatttgcacctcctgccttctgtctggatctagggcgcagccacggggcgctgtggacggcaggcccctgctcccccaagtcctgccgcacaggcggttggaggtgagcctcgggaagagtcccaaggagtgtgtcctgtggctcagtgaggacgggcgcctgggccctgccagggcttctgggtgtctgggaatggagggacagcagcccagctgcccgccgaaggccggcaccgttcccgggaagcctcgcttttgtccaccgccggctgggtcctgcccgcctcccccgcctcccttagaaagccccagagggagggaacagcaggcccggaatagggggaaatagaaggaggaagatgggaggcgtggggcttgttcttctttggctgtcgtaagcataccaaccttcccaaacaggcgccggccggttctcccagaggagtgtactgcctggtgccacgggaggctccggagcgcacggcaggcgggtttccctggtcagagcctcctggccccggcctctgctgccggttccccctgtggtgtgtgcctgcgccgagggcacagtgggcgccctggccatccctgcctctgccctgtgctgcagcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacaggtgggctccaggccccccgcatatctgagggtccctgtatgggaggcagctgtggggtttctggctgagaagggtgcatgatggtggaggggggcaggcgccctcgagagaaccgggccttccccgggttccctgaaaaagctcccaaggccccggccgcccctgtttttggtgcacgagggacctgcttagccaccttgagtgctgaggggctgacagctttgcttggcagggaccccgagaggtggtgttttcagcaagactcagtccaatgcgggctcctcttcccacaccgagctgctgcccacacggcactcagcagccccagcttcagggccagactgacagggtggagtcctgccggggcctcggtcaggctggctgacgcccgccagcctcagagtgcttggctggcccggggaggaacagggtctgtgtggtcccccagcgccctgtaaacgccagctctggccaggctgggcctgtcggcttcttccccccaccttggtctctgggaggggcctcgggtcttcccatagcacagcgcttcatggaattttctcggccgaggagtgaggtctaggtctgactttgctggaatttctgggaaatgtaaagaaacaaaaagccgttgatccccctggcagttagcgcgggcgtccctccccttccagcctggccggccccacccgccccacagaaggggcattcatccctgaagcctgctctcctgtccccagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatggacgtgggctgcattttgtgtgttgctttgtgtgagcctggggctcccggggtaaagatgtccggcaaaggcaggatcaggccgtgccacgcggccgccggcctcaccccagtgccctccacgctgggcggcaaggagggcggccgcgagcccacccggacccccgagcggcaggggcagcccgtcgtgccaccaggcgtcagcaggcttcagtcagaatggaaacagccatgcccttcgcgaatcccgtcgcggcctctgggaaccgagctcctcgtcttccttcctggagggcctccttggtaggcaaaatgggtctggacgggcccgattcggggctgtgtttttcctcccaggcgaatcccagagctggtttctgggtggctgtgcaatgccaggaagccgacgg

SEQ ID NO: 13490 - DNA, 12157 bp, Human
cctaatgacgacaaatgccataaatttaagagtataattcaaccctttgaaactcaggtccaaatagggggaaaaaatgagtaactaattttttttaattttaaagagctaataatctaatgaggaatatataaattgttcaagaatacaaataatatgcatattaaacatattaaatacacttatgatagtgaggggaaggaaagtggagtttgggaagcaaaggatataaataataaataaaacaagagaggggacttgcaaggacaaatgattgtgaacttaggagcatgattaattaaatattagtgctaggggtccaaaaattaaaactgtatggtagacaaaagggaagaatgtcttggtccatctcctgtgaagtcagcagtgattaactatgttatttatgtgagaaacccagaaattcccggggctccaggcctgcattcatcaattcatatagtctaaaattttagccaagactactgagaggtcattggaaactgttgctgaatgaatggggcttgtataccagttgaaaggcaaagcaactttatttttagagggacttgtgtctcatttccatgattcttcttgggctctgggcttccaggctattaagagtagtacttgccactatctattcacaatagcaaagacatggaatcaacctaaatgcccaccaataatagactagataaaatatggtacatatgcaccatggaatactatgcagtcataaaaaaaaacaagatcatgtcctttgcagggacatggatggagctagagggcattatccttagcaaactaatgaaggaacagaaaaccaaataccacatgttctcacttataagtggaggataaatgatgagagcacctggacacatagaggggaacaacacacactggggcctattagagggtggagggtggaaggagggaggggatcaggaaaaataactactgggcactaggcttaatacctgggtgatgaaataatttgtagaacaaacccctatgacacaagtttacctatataacacacctgcacatgtacccctgaacttaaaataaaagttaaaaaaaatagaaaaaaaagaggaatgcttgcaatttttgtaaatatattattttttaaaagttatttacttttttaaagcactgcattcagaatgtcagattattgtccagaaagttggcaacattagtattcgccattcccccacccatcgtgtaagagactcctataccagacggagcccaggctgggaatcaccattccttttaacttttgccaatctgataagtgtggaatgtgtcttttcgtatttatacttctttgattattggtgagagagaacactgtatcctaccacagatgccatttgattttctgcctcatgcccatttttttctgttggtctggtagttttttcttactgatatataagcacttgaaatcatttctaaggatttgtattaatttgctgtccttcgcatacattgtgactatttcccctcctcgagccagtttcctcctaactctttttgagagatcctagatggccggcccattctttgatttatttttaagctcaaataatattagaaataacatttgaaatgtctagaccaacccttttgcagtgactttactgggaggttgcatcagcatctagacacttccatacattgaggaaaaacagacagccgtgtttaaggacctcagagggcttgctatcacccatttataattttcccagaacttatgagtcccaggtcctcattgcagtggtaagcgctgagtgctcacgggggtgtgtgtgggacaggatgtggtttgagttctgtgatcctcaccccgacctcatgcgtcgggaatccttgcagccctgtgactggcctgtgggggcttgggctaagtccctgccaagataccaaaagactgcagaggtgggcaaagacctcaggcccccagactagcaatctacaaacactagtcatgactacacagttaagggtcgtccatctgcttccccttctcctagcctgctttgtgcaaacaagtcccaagcaggagaagatgaaggtgagtgagcttcagagagggcatggtagttactcttctgtcctacttctagaccctgccctccactccttcttgtaagactccaactcctgctttcttcttctttgccagttcccctaaaccttgcttttttttctccttgaatcttcttcattcctatggatgggtattccttgcgttgaatatgactagggaagaaagggtctccatatgactagggaagaaagggtctccataccttcttcaggtggaggtcccctggagacctctctggccacatcagtctctgcttcagagctgggtctgaggctgggacagcgatgggctttagagtaggtggggactggggtttggaggagaagctgagtggacttgtctcagacacagctcagcaacaaccccttgaagaggaggaaaaaacgaatgtggaagttttaaggatggataaaatcagagagttatcagagaaacataaaacatgaaaaaaaaaatcagagccctaaaacaactggatttggagtcaggcatcttggattctggcctcagttctatgcccaattcatggctcgttaccttattgataagacacatgtgtctggcagcagaaggggcagtttaggaaaggataataatgaatgcgataacttggaggcagaaaataatcatgaagttaggtaaaggcaaactttcatttacataatgggttaccacttttgactttggacaaattaacctctgttatctcattgtaaatttatgggtaacagtaactaccttatgggtgggtgaataacaattattatgcatataatacattctacaaaatgcagttctaataacatctccccatccctcgcctctaaaattaactagataacatcctgggtgaacttctattttgagaattgatatggtttttatgttacctgtggtgcttaattgagtgtggagactctgggctgcagaatttgcttaataaaagctgcgtctagagataattgagacacgttatatggacttcaataaatttgaaacagcagtcaatatcagaagtaaactggactaaaggaagtcttcaaattgagagtctctctaagcttttgcatactggtacccaacatgactgtgagtgattgtcattgcagtagcaaaagaaaaaaaaaaggcaaattcttgcaaatgtttaacttgaaactaggtaacatggagatagaaacagatacttttacacaatattctctttatagatccctcaattttgctggtgcatgtatatatgtataaatttagggaaaggtgtaaaaacctgcatagaaaaatatctttttcctcaagagtaagaagtgagtagctacaacctagtatgctggtgataaaatcagtgggataacaggactagaaaaaagttgtgttttgttttgctttgttttgcattactccttctctgaatggggggcagatgatgttcaaccaaaatccttactagactactgcatttccaggaagtctagtttaatcctagtttgtctggacattccttatcaaataatgcccttctctcttttctccagccagttcctttccacctttttctcaccggatggtttggacatagagcttccttttcatattcctgtcatatatattctgtattccatgagcaatttgtggcagcttccccagtataagaaaagggatcagcatgtgctggtgagcactgtggcatcggtacacttggggtactgcatgaacactgtaagggtagagacagaggaggagtaagatgagacctgccttgtagaggaatttaataaaagaacatgcaatgagaatttcaggcagggctaatttatattaagtggaacttaacaaatgttgcatggaagtctgctcaaatattaatatgttcatgagatttgagaaggaatgggataggtggaatggaatatgaaagtggatattagacacctagagcacaatgggctgatgagctgggtgatgctgcccaacagatttcagggactcacttgcagatggactttagggttctccatctcctttcttgagagctaccaaaagctgggatttcagagtattggcttacatgaccaccatgttagtaagagagtgacaggagaaatttattcaaggtggggataatattagattctagaatgttaaacatggaagcccacttggagttctagtaagaatctagataaatatcttcattttactcatggggaaactgaaggccagggatgggaattgcccaggttcacaaaggaatttaacaatggagctggcttctgattcccagggcagtgttctttctactctacctgctgatgagtggagtaagaggtcagaagacctggggaaagataagcaactaagatatcctaaaaatagttcagcaatttaaaaccctcccttctcagagagtccagacaggaggccttcaatccagagccaaggagtagcctgttttttacagaagcatgtaaggcaagtgtgcttttctcttcggccccacttacttccagctcctaccatcccagcttatgaatcaatatccttttccattatccgtgtatttcctggtatctcacagctttcaaaataataggaaacttgattcttatgtgtgtgtgtggaggggggagtgtacatagtaagtgtgtatatatatgtgtatatatatatatgtgtgtatatatatatatatatatatatatatatatatatatatatatatatatatatatatatatatatatggtacaagagatgttttgatacagacatgcaatgtgttataatcacattatggaaaatggggtatccatcccctcaaggatttctcctttgtgctacaaacaatccaattatatgcttttagttattttaaaatgtacaattaagttattattgactatagtcaccctgttgtgctatcaaatactaggtcttatttattctttctaactatcttttttttttctcattaatcatcccaacctcccttccaccctcctagtatctttcccagcctctggtaaccatccttctactctctatctccgtgagttcaattgttttgatttttagatcccacaaataagtgagaacatgcaatgcttgtctttctctgcctggcttatgagacttgattttttatttccaagttacaagaaccaagtttcagtcttgtcattgacactttagacaactcttatttgttttctagatcttggttagaacataactattctttgacttctttgaaagattacacagatgccaggaattattgttaccagtattatcacttaaaaaaaatcttccagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctggtaagagaattcatagttacttctctttgggactaaattttccagctgatcatattctaaattatacttggaattatattttaattataattatgtaccaaaataaatactcataatcaagtgacttcatcctccatatcagaagtcagcaagcttgggtggacaggccaaatttggtcagcctggctttgttaacaaagttttattggaatgcagccgtccccgttcatttacacatcacctatggctgctttcatgctgtaaaatagaggttagtagttgtaggagtagtgatgatggaaaccatgtggcccacaaagtctgaaatatttcctatctggccctttacagaaaaaatgtgctaaccccctccccatgccctgcctctgctttttcctgagatttccaggggaatcaatatatacttgagaactaggagcctctcagaagattccagaagtcttcttgataaatacaggacagaagacccatgtttttgagacttttgcaaggttttacaggtaacttacaatgacaagaaaaaggagttttatacctggaactgcatttgattagagtgagggctggcggatgaggctgtaatagaagcaaatactccctctccaacctcaacccctttttaggatgtagtttttcctccctttttgtacattattcagggaagaattttctcatattttagggcatgtggtttaaaaatcagtgaataacaatcaggatggattataccagagacaaatgtacttcttatatttgaagtaataagaccttcattttttgtttttaattatgttttgaataagcattatattcacaagtctcaaagttcaaaagaaaaaaactttagaaccaaaggtttccaccttcttcccctcccttcagtagaccaatattatcttgtttacagaatacatagatattcttgtttctgctcccccctccccagctgataacacacaataaatactatttgctgccttgattttttaattaataaaatacatttgagttcagatcatttcctcattctttcttaagactgaataatatttattggaccacaatttattttcccagtttatagggactttaagaatcgatttattcagtttccaccctgcaaataacagataacagaaggacatagggaggggtactgaggaaccctgtgaaaacaggaaggcaatctctgttttttaaaaaggcctagaggaggtaccagttggctgagctgaatctgagtgggactggttagtgtttgtcaagggactaaaggcatctggctcagaaagggttaacaaagaagatgattataaaagtctgagcagacaagttggaaaacttcctggtagtggacgaaggcagctgaagcttgtttttcagcatattactgaggatttttagtaagaatgcatcttcagcatcttaaggactgttgaaaaatgttaggattgttgatttcagatttctctgtttgtctttgcctttgtcagttttacttccactccactcagggtgagccaggctgcacagaggagagaagctcagtcctggctaacatggcgaaaccccgtctctactaaaaatacagaaatattagctgggcatggtagcaagtgcctgtagtcccagctactcgggagtctaaggcaggagaatcacttggatctgggagacggaggttgcagtgagccgagatcgcgccactgcactccagcctgggcgacagagtgagaatctgtctcaaaaaaaaaaaaaaaaaaaaaaagaaaagaaaagaaaagaaaagaaaagaaaagaaaagtcacctgttgaacttttgaataataaagaagactaagccccatttcagaggaacagaaaactctctgaaatgggacctgggcatccctatttttaggaaagggccttcagctgattctgatgtgctgcaggtatggaaaacactgcaccatgacaaagggcttttgagcgcacgtctgaagatccggcctctaacttcagctatgctactaacagcccttctgatgcagagctgtttccctccctgggcctctgtttccttctctgtaaaatgggtaaccccagggaatcatccttgcacaaggcagaacctctacctagaccaaaattgttcctcctctaactgcagaactaaatgcactccaggaggagctgaagccctatggtctagttgtgttgggctttccctgcaaccaatttggaaagcaagaaccaggagataacaaagagattcttcctgggctcaagtacgtgtcttcttgaaatccaataggaggcgcctgtgtacctttcctcagtctccagaggcccttccagctcaggaactttctggggaggtatggattaataggctcaggggcattacaagcagagtttaactttggcctaccgtgatgagcgtctggcagtttccagactctctctccatccctggctgagacttggatggactatggaggacagaagggatggaggaaaagagacaagtcatgggatagagagaaataaagtgagtcagagagcccaaagtcaaaacatggccatattcctccccacccacaacgatacttccctctttctcccctttctcatgacttcaaatcctagtgtcccattataatctttacttgcatatcctggagcttcctgggaacattatggcttgttgcaggtatgtccgtccagggggaggatttgtacctagtttccagctttttgagaaaggggatgtgaatggtgaaaaagaacagaaagtcttcagtttcttgaaggtgagtaaattcctggcataagcctcctcctcttttctaatattgctaacatagagttggtgtggcagaaatggatccaagggctcatgcccagaggtgggattggtctttgtggagaaaaatctccagatcagcattccacattgcacatgctgatctggagattaatctgtgagtatctatggggctctaactctgtgtggtgaagaaagttgtgtggaatggcaacttttactaggaccaccctcttttgctcattgacattcattcattaattcattccaggtacacttgatgaatgcccgctacttataaagcaatctaaataataaggatataaagatgaataaggcatagtctgtactcttgatgagtttataatggagagagagttagaaaccattagctatgtagctggggtggtggttcatgcctataatcccagcactttggaagactgaggcaggacaggagaattgcttgaggccaggagttcaagactagcctgagcaacatagtgagaccctgtctctacaaaacaaatcaaaaaattagctgggtgtggtggcacgtacctgtagtctcaactactcgggaggctgaggccagaggattgcttgagctccggagctggaggctgaagtgagctatgattgtgccactgcattccacactaggcaaccaagcaagacactgtctcaaaaaaacaaaaacaaaaaaagtaacaaaccaacaggtatgatacagtgtagtaggtaccttttatgaaacactgatttttagacatagagaatgccagagctgaaacaaccctaaagattaccaaagtgaattgttcctaaatgctggactgtgaaccaagaccagtccatgttaagactttatatatcctcaataaattgaagacaatagaacagtgtatcatgcctctgcaccccagcctgggcgacacagcgagactctgtctcaaaaacaaaaacaaaaaagaacagtgtgggaagttttttataaactcaactcgtctaacttataggacttccctttattcacaaattatgacccacacgcagtttattcttccaatggtctttttaaattaagtgacaaaatgatggtgttttaaaaatttttgttatttgacaaaatattagtaattcagtgttggtcccaaaagacaattattgaaatattagtggcccatggaaccctaagacctggaaaaccacattccaatccaagctatttactttgaagaaaaggaaaccaaaagcataaaaggtaacatgtcttatccatggcagcaaaattttgttatggggctatggggagaaaccgaaagagagcagattttgctataatatctataatattcttggtagttggcatagtggtgattcaagaatttatggagttttttaggaatatcaggaagttaaaatatctaggtataggagggggtggattacctgtgggtaaaaatagcctggatcatccaggagcagaaataacattgtttctcttttccatctctctggtttagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaataggaaggtggagttaagggcaggagcaaccctacttctcacctaatgacttgctctccccacccctccaaaaaaaaggaatacccatcttctcaccacactctcttcctgcatgggctccacctgagtaaatcaccgccacatactgccagaattcccactctccacaaactagatttatatttggaaggctactgctcttttgcctctcaagagtatgtgggtgaagactgaaacaaatggaaacctaaaatccccagacctctgttacaggttgaatcattcatatccaccagagggaaatcatccttccacgacaatggttcagtcggccatcacatcctgaagaacattcctagacattctgactcttccatctctctctaccctggaggtgtagaaatagcaatggggtcacagtcacacaatttaggttccacttcataacattttttgtctcctaggacaaacgtgtatcatcagtttccaactgttttggctcagttttcatccatgacacctccccctaccagccattctcctgtgggagcaagaacattgcttcaaaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcgacaatctctatggtggttttaaaatcctgtctggtgcttgaactcattttatctccctcctccttattactctgtcacaaatgatgtattgcccacatgacctgagccccccagacagaaagatttatgtttggaaggttgtcacctaatgcctctcagttgtcattcctcttcaggaattgcctcagcctaagtttttcccctttccagggcagcctgtatccagttactcatccctgagaggcatagaggccaaaccctgactgctcaacttagcacaactttgaagggccatactagctctagacatgcacaaggggtaggccggtggcattttgtgcttgcactgcaccccagtttttccctctgacaaattctgctcctcttctttgccaccccccccaaccctccacactgattgtcagttaatgccctagtaaactttctgaatgcaaatatccatcttagagtctactgtctagagaatccaaccagtaattattggtaccaaatatgatctgagaaagaagatactaagaggagatttttgaagctgaattattcaccgtctggttgatgatgagaagatgggtggagcacaaacaactactggcacaagtagcagtgcggttgtcaaaacttttgccaaacctgaactggcatggtaaactggtggaagaatatgcactagcagacatgaagttttaggtgcttgagaaacatgaggggaatggtaattataacgtaatagaattggatggtcgttgccagaggaaattgatgttttggagagagataattaaagactgaggatgatatattattaaattaaggctaactgtgaaagtgtttctccatgggatgtataaaggacctctcctatctgcaacttaacagcagcaaaaccgaaagttcaggctcaagacttaatcataggaatagtatgtacaactctaaaagaagttagcttccagctgtcacggtggttcacttctgtaatcccagcacttttggaggcagaggcgggaggatctcttgggtccaggagttcaaaatcagcctgggtaacatagggaaagcccatctctgcaaaataagaaacagaaccaggcatagaggcacacacacccatgatcccagctgctagggaggctgaggtaagaggaccacttcggcccagaagtcaaggctgctgcagtgagctgagatctcaacat

SEQ ID NO: 13491 - DNA, 12157 bp, Human; identical to SEQ ID NO: 13490

SEQ ID NO: 13492 - DNA, 24563 bp, Human
gggtgctggacaggctagggagggggacctgagggccttagaagtcttgccgagcccagatatggcagccctggggtgccaggaacgacttctccaaggacagccccttgcggtagcctcttttgaaaaaatgcagaggtcacagttaccagaagactggaccatgagcagatttcttaattttcaaagaaaaggaggagaagaatgctgcttgtgtgagtcagagagcagtgtgctaatcctgcagcctctagcctcctagaacatggatagcttggggggagattggtcagcgctgggagcctgtgtccacctgaaggtcacccctggctattgggctgcgtttacttttctcctgggggtaattaggcagataaacaggctctcttcagagtaaatgtgctagaaccctcacttgggcatgtggagaaatgtgtactgggtggtggcagagtgagttgggggagagctggttaaatgcctgcacccacatgatgcctagtgtttgatgttgaactggggagttctgagtatgacagttctgtagtgtccctcgttgtccctttcgtcttggttacttggcagaacacaaatgccatgcttattgcatccatggatgtaaaacaaagctgagagagagggggaagatgtttgatgttgagcagaatcccagaaggtctcaggagactggagcagtgggcagaacccaggggagaaatttcacaggagcccacataaggtctccgtggcctgaaaacccacttgtaccagtccggggaggtagggagtagcatccactggagggagatgaaggtcccgccctgcactcttcagaccatacctggggcgtttggtcctgaaaagaactaaaagataagagtggggtcaggccaggcatgtaatcccagaactttgggaggctgaggcgggcggatcatctgaggttgggagttcgagaccagcctggccaacatagtgaaactctgtctctactaaaaatacaaaaatcagcctggtgtggtggcaggtgcctcaggtgcctgtagtcccagctacttgggaggctagggcaggagaattgcttgcaccgaggaggtggaggttgcagtgagctgagattgcgccactgcactgcagcctgggtgacacagtgagactccgtctcaaaaaaaaaaaaaaaagtggggagcaggcttgaaactatttcaggcagagaatgacagagggaaaaatgaggctattctttctaagaacggaggactagaggtatatcttggggagaggggaagacccagggtcgcaggaccacagctcacagtggggtcgacctgccctgtggggccatgcagggcagagctcctagccaggaggcagattttgactcctgctgggaactcccttaaaagccaccccaagaatgagctccacgagcgccatcaaggctggcctgcaggccctccagggttaccaaggctgcctggaactgaatggaccctgtgtgtgttcttttagtcttggaagaccagccaggactttgggggccagacggctagcctcaagtgagctcagaaatctgcacctgaattgggcctttttaaaagttgtttaatggccaatacatacatgcagcagaaatgcacagggaacagatctaaaccggaagcctcattttctagccccacctttcctctcgagaggcagctagtgttagctagtttcttgtgtgtcattccaaggatgtccgtgcacgtctacactcaggaaccacttagtttgtatgtttctgggttttttattagcttagtacatacacagtactgcaccttgattaataatggtggtcattgcatctttccatatacagagctggctaaatccagaaatagctacagagtatccattgttggatctgttgtggtttatttaaccagcctcattggtggaggtttaggagttgttgcagataaggctgtagtaaaattcatgtctgtatgacatttcacacaggtgtgtgtctggggaagagacttacagaagtggagttgctgagtcaaaggtatgtcattttaagttttgatatctttgtattttatttatttatttattttggagacggagtctcgctctgtcacccaggctggagtgcagtggcataatcttggctcactgcaacttccgcctcccaggttccagccattctcctgcctcagcctcccgagtagctggtattacaggcacccaccaccacgcctggctaatttttgtatttttagtagagacagtgtttcaccatggccaggctggtctcgaactcctgacctcaggtgatctgcccacctcggcctcccaaagtgctgggattacaggcatgagccactgcgcccagccgacatctgtgtatttttaattggtgatttcctcagcacattggtgaaggtgagcatcttcagctccttttctgtaactgccagatctgttcacatcatttgacagtttctctagtggttattgatctttttcttattatattaataaaacttttttcctaagtttttttctcatctttattttttttaatttgtctcttatgctgaaattttatttatgtcgttggtttttggggctacttctttcactgcattatttggcctggctggaatttacttggtataaggaacagggtggtatccagcttctgtttcttgggttttttccctggcctggctgtggatggagcttttggcttcatttctctgagaggaggccaggagtggagagtgtctttggtgctcaaaggtcctgcctagtggtgtctccagagaggaaggtgacagagacaccatcccggctcttcctgctcacctgtcgggcagttccttctattagaaggttcctggcctactggtcatttacatcccccagattacctcctcaccagtgaagtctgagggtttggcagagtctgggcagaagggtcaggctggggccgggacggggagggctttgtactgacagcccacccagcctcagggacaccctctctgaaggtgatgccaccggggacctcatccaccacgtgcttaggggctcagagagaccgaaaactgcaaggagtaggtccttggtccacactacagggagccaattccagctttctccaaagccatagggctttgcctacggtcacctctggacccactgacccaaacaaatgactacacccgtagggctgaaaaccaggcccaccctatggggaccggtggtaccttaaggaagttctttagcttccttaaaaacagcatgtaggctgggcacagtggctcatgcctgtaatcccagcactgtgggaggccgcagcgggcagatcacttgaggccaggagttcagaccagcctggccaacatggcgaaactccatctctactaaaaatacaaaaattagccagggatggttgcgccctcctgttggaggctgaggcacaagaatcccttgatcccaggaggcggaggttacagtgagctgagctcgcaccactgcactccagcctgggtgatagagtgagacgctgtttaaaaaataaaagtaggccaggcgtggtggctcatgcctgtaatcttaacactttgggaagccgaggcaggcagatcacctgaggtcaggagttcgagaccagcctggccaacatggtgaaaccctgtctctgctaaaaatacaaaaattagccagacatgatggcgggcgcctgtaatcctagctacttgggaggctgaggcaggagaatcacttgaacccaggaggcagaggttgcagtgagccgagatcacaccattgcactccagcctgggttacagagtgagaccctgtctcaaaaaaataaaaataaataataaaaaaacttaaaaagaacagcatataccagcctcggcaacatagtaagactctcaaaaaaaaaaattagctgtgtgtggtggcacatgtctttaggaggctgaggcgggaggattacctgagcccaggaggtccaggctgcagtgagccatgattgtgccagtgcactccagtctgggtgacagagcgagaccctgtctcaaacaaacaaaacccaatatgcccagttcttcaagatagatatgaagggcagctagactcttatagttggatagcgtggctagaacagtggtcttcaaagtgagttccctggaccagtaacatcatctggaaacttgttccaaatgcaaaaactggttccactgtctcagaaactcttggtggtggagcccagcaatgtgttttaacaatcccatcaggtgattctgatatgcattgcagcgtgaaacccagtgtgtaaaaagaagccacatactcgagacgagcaggtgtgattgttgagggaccctgcaggtttcctcacatgtccgcctgccattgggtgtctctgcagactgcagcagcagctgctattagcaagagcaggcaggttgcacaatgtggctggtgtcacagcagatctgtgtccctcctcacaatttaactggcaggggacattgccaagggatccgtgttcagagggacttcgtgagagcaggtgtctcacctggcacctgtccaggccgctcttcctcccttactgacagatctgcaaatcacttacttctcttaatcagcagcctctactgcagaaacagggtgatgctgcctcatttgccctggttcttcaccctgcatcagatgaacctcctgagggccctttttgcttctaggaacgatgattccataccttaccaggtccccttgcctgatgaaccagaggttggagaatgaagagagacaggggcctctgacttcccctgttgctggagggatggcaataaggacacaggaagataaatagacagacctggagtcctgagaatgaggcagtgcgtctctacctctgaggtgggagaacaggcccagaggcgcactgcacccttgccagcagaggcaggagcaaagcttcagtgagagggcctttcaaggaaactggctcatggggagtgaatcctgtcactgtgggtggggccgggggtgtggccctggcccagaagtcaggcagcatgctggtgggtactgtttctagctggaggcgccagcaggagacagtgaactggtctgcgacaagcagggcagatgcagcagtttcttctgcagggtcccagttgtggtggtggctgccctttcaagaagctgggtcccacgggccagcaggggctctcaggcagagcctgaatgtgctttcgtcttctcttccagatctaaccatgagctaccctggctatcccccgcccccaggtggctacccaccagctgcaccaggtaagagggtctggggtggggaggagagtgaatgctgcctctgtacagtggctgggagtggagaggggagaacagtagtttcctcactcccctcctcccctcacagcacggcccagcaggggaggagaggacaacaggagtagtgggacagccagccgaggcaggggctggagaagagcatgacactaaggccatcggaggcctaggtttgaaactgcctccagaaagccctggaccaggcccagggctgggtctcttgccttactctctagtaacagtgggcaaatgctgtcactttgagactcagttttcttctccgcaaaattgcttcaaggatttctccctcattaggtggtcctggatactgatgagataggcaggcagagcgacacggtgtcctccaaagcattgctaggtgatggttgccccttaccacctctcctaccctctgctcaaggtgtgtgggtttgcagcaacaagatcccccttgccaagagaggaagtggaggcagatgctaagggtcaaaggtcactccctgttttctgcaggagctgtgggtagtcacatggagaagtcgtcttctctggccctggccccttttggtcctcaaatgagatttggtccccactgtgggaaaggaaatatgagggctcatgagaccaaggggagaaaagggtcattccaaggctggtcatcctgagggtgcctgagccgctgcccctctccccaggggactcctaggcatcattgatttctttggagctgaggtcctgtggtttgaacaccccagacctgcaggccatttaccttccctcccattcagcaggtgaagaacagactcagacctagaggtggctcagctgctgtcccagggcatgttaggggctgagctgggccactgccctctgaatgagcccaccccaggttggctggcactggcctgggttctctctctatagtagaaatcctgccatccagatcctgccactgccacctttgctagcacagctgagcagcctctgagcagcaagagaggaggaggcaggaaatttagggaaggttcttcctggagggtctggagccctggagatgaagagccgatccgaagctgccatgtagaagaaagcatctaacaggccagaggccccatgatgatgtcgaatgcccatcgggcacccagctgagccctgcaggtgttaactcagtcttcgtcacagcagtctaggcatacactcaccattagcccatttgtaagctgaggaaacaagcctaaggagggtgaaagccttgccccagggcacataccggtcctgctggtttcagagcgggcttttcacctctgtttcttcctgtcctcttgtggactggtatctgtgtttaccatgacccagccccatgtccctccagcctcttatcctgcttctccctgccttttacagacttgtaatagcaaacagccaaaccccctcccgccagtgccttcgcattactgaaatctcagagctccctatggtcacctctgtcatgggctcagcatggtgtcccacaacagtctgtccttgtctgtcctcctgctccatgatggtgaacttgggagggcagagcctgcctgggctctcccagcctccttaataccccacagagggtcttgggagtgtttggggaactccaccttcctccctgggaagaggggaaggtttcccctcctctgccagtgggatagggggagactttcctcctggtgttttcatgtggtctgtggtgtcccgaggctcgaggctcgaggctttactgggcctccctttctgaccacctgggagctctcatctctgcctttccccgtgtggtgggggactggcagggggctaaagggcttggtgttgctttcaggtggtggtccctggggaggtgctgcctaccctcctccgcccagcatgccccccatcgggctggataacgtggccacctatgcggggcagttcaaccaggactatctctcgggaatggtgagtccagctctcctgctgaggcagccctggggccacacctgcgtggccagaggaatcaaagctgctggcctctggggctccagagttgtctgtgtgtgtgttgctgtggtgtgtagtgtgttgagctgtaccttagaacagggttttcatcaggcttctgccacctgctctctgcccctctctgggtctcacttttcccatctgtaaaatgaggggaaggggaccagatgatctcacaggtccctttcagccctgaggggttagggttgggaaggtggcgagggtatctgcatgagtgtgcatgcacgtgctatgtatgagtatccacattcatatacctgcatgtgcatgtgtgtacatatggagggctcttctggttaggccttggtgggtgtgtggcaggtatcttgggcagacatgctactttttaaatttgttgtttcacttttaaaataatacattttatgatttgaaaacaaacatatgcttagtttatgatttgaaaacaaacgtatgcttagaggaaattatgcaaccaatacacaccctaatttgtgccaggcccagttctaggcactggggatatgtgaataaaacaaacaaaaatctcagccgtgctgcacttatcatctatggggaaaagacaggcagtaccttaagtcaacgatgtgatgttattgaaagtgtaggtgccataggaacaagttgaccagggtaaaggggtcaggagtgggggtggggtgatgtaaggataatgattttaagttagcagtaaggtgggtctggctgaaaagaggatgtgtgagcaaagacctgcatcaggggaaggaagtgctgtatggatgtctagggaatgccggtgccctgaggtgccaaggggtgtgaggtgctcagggacagggaggagaggccagtgtggctaaagtggaaaggcgagggggtgagatgggaaatgaagtctgggggtctagctcttgcagggtgtaggaggctatccatcctaaggatttaggtttttattcctggtgagtgcagattcacctgaacatgcctgccagaggtgtctgtgggtagcaggctgatgtgatggggatgcccccaaccctgcatatgggacccacgcaccttcttgggcagtgagctcttaaccttcacccaggtggtctgggatgggaggagcaaccatgtggagagggaaggcatctcccctgcagaaggggatgaggatctctggtttggatcgagtcgcactgttcactggctgtgtaactttgagcaagtaaactcattctgtggtctgtgaaatgggtataacggtacttcatattccacaagcggagatgctgtgaggactgacttggcttaggtatgaaaaagggtggagggacggagtgcagcagggcccattggcctcaggctctgctttgtgtccttgcaggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccaggtgagtgtcagcccactgcctcccttggtccaggcctgggccccaaaggctggagacacatggctcagtagatggggagacagggaaaggcgcaggcctccagctgcacttcttgttttaacaaatagtgtcggccgggtgcagtgactcatgcctgtaatcccagcactttgggaagctgaggtgggcagatcgcttgagcccaggagttcaagaccaacctgggcgaaatggtgaaaccctatctctactaaaaatagaaaaaaaattagctgggcatggtggtgcatacctgtaggcccagctactcgggaggctgaggtgggaggatcacctcagcccaggagacagaggttgcagtgagccgggatcatgccgctgcactcactccagcctaggtgacagagtaagacccagtttttaaaacaaaaacaaaaacaaaaaaagacaaacaaagagcgtcaccttcttgcagactccccacctctgggttgtgttgcttaaggcccaagggagctgtcctgtttctcctggtgtgatgagacgctccacatccgagttgggtcagaacacccctggcgagtactccttattcctctgtgtcatttactgcctgggctgtgtgttttgtaagaactgcccaggccacctgtctcaaggctttgtgctcaacagctgtcttcggtcccttgatatgcaccacccccgccccccccggcacagacaggttttggaggattattaaaattccctttgggtagggagaatgttggcagttcctccagggttgatcttggctcattttggagaacagttcgtgtttgcagagcctagaattcgttgtcatggttctgtggcccaaccagccagcacaggggtagtggtatgtgctcaatgactatttttagacagagggtctcctttcctccttcccttccatacccacacgttcccccaccctgtgccatcctccagcctccctcccttatcttttccctgagctgccctcttaattgtgttataaccagtttgtaccagcccctaggaagacaatccactgggagacagtttagcctggaaagttccagtttgcgggtttgtgcagctatcagggtctggaggaagtccggcagatgctagtctagagaacagtgcgagggaaccagtgctagatcaagaggtcatcaggctgccatgcacagttgtggaggctcaatacctgcatccactggaggggacacatgggctagccagccctgttaggagtacccatgtgtgctcacatgtgctgtggaggccaggcatcgatgagagaggccacagcccctgctcccgagacctgcccttcatcaggagcctgagccccagccctggaggacctgggcactgggcagattttcagcatcaggactcagctataggtgagctcccagccactggagccaggaaaaagcttcagtactagaacacaaggccagataacagtcaagttaggtagacgcggcgtaaagtcctctgcattgttgactgtggactcctttagatactccaactcttagagaaagggctgttcccagagtctaggggtggagcagccttgaatgtggggaaggcggcatgcacgacatcttacctgagactgtttgtccgagtagtttggaagccgaggcaccatcactgatgctcccggctttgaccccctgcgagatgccgaggtcctgcggaaggccatgaaaggcttcggtaagagaccctgggtggctcaaatcctactccctgccccctatttcccaggcagtttcactgtggctctgtgggctggggtagctgggggacgctgacctggccccagtggtgatagaaggtggatgtgggggtatggctagcatgcccagaacagttgaggggcccaggccagggaagtctcagctgcagagcatctcatgacccctacccgacccacccctgctgcctcttcctccagggacggatgagcaggccatcattgactgcctggggagtcgctccaacaagcagcggcagcagatcctactttccttcaagacggcttacggcaaggcgagctgcggggtgggggcgcgggacagtgaggcgtgtcctgggctcagcacagccctgctctcccctgcttttccttgggtgggcccggatctcccggatggacagtaaggagcaggagggcatttccttctgcccatccagctggtggcatcgttgggaggtgaaggatgccaccgggtgctgaggtttgctgagaggctccagacatctatccctgggttctagcccttgctctgccacatctcactgaggttgtggccacatcattttccttcccctgccctcttcatgaccaccctggggggtttagctgatgtaagagctttgcagggaaaggctgtgagtgctgcccaagtacgaggggcgtgtatgagcatattttgaacttctggggttttgaatcttagaaagataaaaattcggtaaatattgattagattcgtgttctagcccagtgcttctcaaacttcattgtgtcaccgatcccctgggcatcttggtaaaatgtggtctctgatttgggaggtttggggcagggctgagagcaggcttttctctcaggcccctgggggatgtccatgctgctgttcctcaaatctgggatatggctcttattagtcacttcctgtggattttttaaatagacttgtttttttttttgttggttgtttgtttgaatatccaatcaggatttgatcaaagatctgaaatctgaactgtcaggaaactttgagaagacaatcttggctctgatgaagaccccagtcctctttgacatttatgagataaaggaagccatcaaggtgtgtacgtgtgtgtgtgtgtgtgtgtgtgtgtgtgtgtgcgcgtgtgtgcgcacgcgcgcatgcgtgtggacacacagcccagaaggaggcctggatggcgtgctgtgttctagcccactcattagctgctgttgtcagtatggctcccaggccttcctgggttggagtccacatgctatagaaaagggaactccctgtgatttccccaagaggcaaatgacgcaccagtcatcatcagggaggcttaagtctctctccatcttaaagaaaagggggagctcgggtttgaaggttgcgattctgtggtaagaagaggggtaggaggccatggttggtatcgttctcattctttaggactctgttactagcaaatgacagaaacacacttcggtttaagaacaacaaaagtggagaatcagtcatgtgggtaaagagggcccaggccagacgtctctctggtctctgtctctcctgagcgcccgcttttctgtcagtttctgtgcttctcctaccatggctgcttcatgtggggtgggagagggggcctgtcgaccactctccgcataactatgagacccagctccagaagagaccagcagggtctccaaacgggcaggttctgacgggcccggcttggactcactgttccctccagtcctgcgggttttgactgagggttgggtcctgtccattctgtgcagtcccacagctctgtgtgcaccctgcaggcaggggcaggcagctcccttggaaagggaatcccatgagtcaggctggagcccagaaggagcctgtcactcagaggcctgataagcacagtgaatgttccctccttcaggagaagcagagacttcagtgtggtggcctggaaaggagaggggtctccgctgaaacacatctacatgtgttattctagggagggggtcaggaggccatcaggcagggcgatggcccggggccccagggagtggacccagacatctccctggcccccgtcttcagccggagtcatgagctggtggttgtggagtgttagaaaccacacaggtttggggcagctgtcactcaccagctgtgtgtccttgagcacctgtgaaatggggacagtggatgctgtctcaggacatgctgggaatactgggtgaggggctaacgtgtagtaacccaatagtagctgtagcaggaaacagctgacacaatgtcgcacgtcctgcctgacaggccctaagtgctctacgtacattaactcacttaatcctcatgactttcctgtgaggtaggtcctagtatcactcccatcttacagacaaggaactggaagcacagagaggttaagtaatgtgcccgaggtcacacagctggtaagctgcagagccaggattcaaaccaacatacaagccaggctgcccagcctgtcctctatggtcttactgtccctggcgtggttgtccgattcatccttgttgttcctaccttttcctagttgttttcagacattccaccatcccctctaggaccagggtttcgtatgtccacttggatctctcttgctttttacccatttttttcagttgttgtcatctcgcttccggctgaactctgaataaagcaggcctcggtccacattttaacccaaccatttactgtgtggcctcggaccagccagtacccctctctgatgctcagttttctgatccatggggatgcccctttgtgtgagccctactcatcaccactgccactgtcattgtgcttgcccgggctgtggagaagagctgatgccctcgagcctgggagtggctggagggtgtgtctctgtgtcaggggcctctgttgctgggattaaggcagcagcgtagcccccacccttcttcccgagtgctggtgaggctgctggaacaagcacatggttggttgtattctctgcccctgcagggggttggcactgatgaagcctgcctgattgagatcctcgcttcccgcagcaatgagcacatccgagaattaaacagagcctacaaagcaggtgaggccgctccctctgccctctgccctctgccctctgcagatccctgtgctcttggggctgtggcctcattctctcctagggccttttactccttcctggccttcttatcaacccatcttctgccacccccaatactttgggctttgacccaagacccagcccttccttctgtttatacatggtgcaaatgactaatgtaagggagaggcagggaaaacctggatgtggtttgggccaaggctgactagaggccaggtcagcctggaggtcacaggcttgtatatccctggagggccatatgggctatttgttctcttgagcccgagccaagacctccagcctttttctccccagtacccacttttgatagtgttttgcaatgggcagctccataaagagagctacaggatggaccttccttgcttctccctttcagaattcaaaaagaccctggaagaggccattcgaagcgacacatcagggcacttccagcggctcctcatctctctctctcaggtacttttcccacgacagggctcggggcccccaagccatggaagtcaaagagatgggatccccgcaatgaggaaagggaaaataaatggggaaggagtgggcatgaccatacacctgcttcctttcagggaaaccgtgatgaaagcacaaacgtggacatgtcactcgcccagagagatgcccaggtgagtgtgatggccaagcccctggacttcctaaagcagggatgcaccccgctttcttgcttcctgagagaggtaccctagggtggaaagaacaatagataagcagtgggttgcagatgctgtgagtttcagacgcgctgaactgttcaactgtatgacctagaacaggtaatctgacctccagggcttcagcttccccacctataggagggaacatgtgagataattagtatttcgatagttgatagatcatggttttggacgtgggattttgtgtgacagcgtactttccccatgtttagttgcacatagcattatgtttgcaaaggggcaaaatttgcacttgcttattaagtttttgaggatttgagcctagaaaccagctgccacattagttgagcacccttagaattctgtcgttgtccctcttgtgagttgcagacaaaaggggaaaagtccaagcaaagtccaggcatctgagctactctctcgaaaagtttgggtttcccactaatgaatttcaaccgtagtattatggcagggcagagccattacttcctggtggggtggagttggccatacctctctgtctcccttcactgctcttgtcatccacggcagggcattcaccaggagctgccagtggtctaaattatctctaccatctgcgggattggaatgagacctcaaggaatgcccccttgttagggctggaggagagctactcctctggtctggtccttttgctggtcctccttttccggaggaggaaactgaggctcaaaaaggttgagcactgttcccaactgaaagctagaagcagagcccggacaagggcctatactcctggctcggtcttctgtgcccagtcagcacttgcctctgccctggtctcagacctgctgctcctgcagggtctgccttattcagtgtctctctggctggtaacatccattcccattctgggagtcagggctggacacgcctggggctcagggctctggcttttgctccagcgagagttttgcatgccacttttagcggggcaaaaattgtctcatgctctgccttctcagtccagagctgctttggcctcatcttgacctgtgggatctcagcccctgattgctgctttctgctctttttcagggctgctacctgaggcctagcaggcactttagaggccatctagttcagaggttgcaaattggcaaatactttaggctcaaaccttcagaagtttaccaggctctcctgggtgacctgggcctggggtctgggtgtggcctgtgccacatgtgcgtcttcctctctctccaggagctgtatgcggccggggagaaccgcctgggaacagacgagtccaagttcaatgcggttctgtgctcccggagccgggcccacctggtagcaggtaaggcaggctggggtccctcagaggccagttagatgagggcagtcaggggattgtggggaaacaaagctatgggaacacttggtcgttcctccctgcgtggggctttcgcctcctcaaaagagccccctggtggggatttaaaagacactgtcagagggtttcctgagttctggcaaacatccagttctggaggttctaccggtgtagaaacctggtgtctttgtacgtgggaatgtggaacgtcagagttgggagggtccttcgggagcacccaatccagtgttttccaaagcctggcataagaaacagtcataacaataaaactgggtgccattcatttactcattcattcaacagatgtaaatcgcgctcccgcatgggtcagtctgtcaggtggtggagcaggtgtggggccacggtggggggcagggcactgcagagtgtgttccatgggctgcactttctcatttggggagacagacagtaaacaacaatgaaataaaatctgtatcagatgggaaatcctgtagaggaaaatcaagctggaaacaggtagggagtgatggtagggtccaccgggaggtgcttgggccagtccccactgaggtcgtgacatttgatttaaaaacctaaagggagatgcaggggcagaggcctgcctggggctcccagcacgactgagaacagtgaagggggaccatgtggagcaggtggagtgagcaagaggagtgggaggtgagggcagagaggggagagggccctgctgatgacttcccggagctgggtatttatcctgagcaaaagaggaagccagtggagggccctgagcagaggaggctgtgcagaatccctggctgtggtgccgagaatggagtgaagggtgcaaggccaagcagcgaagcctgtcgggaggctgctgcagggacccggggaggaatggtggtaataggggcttgtggtgaggaggtgtcaggttccggccatgtttgctgatgaattggacacgtgacgtgtgggagagagagggttcgaggattatacagggtttctttaggccaagcagtgggagaatggccctcaactgagacagggggactgtaggtggagctggctttaggtgcctgtagggtggagctgcagggaggctgctgggttgctgagtgtggaggtcaggagaggtctggcctggttgtggaaggtaagggagctatgggtagttgaagttatctgaggctctgggactgcaggaggtcccctcaggagggagactgtggggagcccaccggtgtgaggagactaagaaggagcagctagggagggaggaggacgcagaggaagggggtcctggaggccagtgtgaggtggcaggcaaggactgaggatggtgaccacacggagcaactggtgggctgtggccagggctgctccagtgggcagtgagggtgaaaacccagcgaccgctctgtgctgcacacagagacaggcgctgtggctctccccattcgcagctgtgaaagcaggcacagggtggtagaggaagtaggggtgcacagctagtaacagctgagctgggatttgaacccagaccacccgaccccagagcacactttttaacctctgcactatcctgtaatggagcctgagtgaaagcattttcatcttaatcattatttcttttaatgagtacagaacatgtaagtagtgcatcaagcccatggcttcacaaacattattacttaggagaaaagagtagctgattggaagaagatattaattgagacagatacacacagagcagaaatcacaactttaaaatgcaaatggtagctgagactcaggctggggaaggagagttttatgtcctgggtcagaactggagtcaggaccaaggtctccatcatgccacctgtctctctaggagccagccatccactcctgtgggtgcttagcgtgtcctaggtcgaggtgagcagcaagaagccaggctggctggggcaggctgggcctcagctcacaggcaggctgaggaagacagatggatgcatgaataaagccaaggaatggcagagactggaggtgtggaggatttgagaagaggggacactgtcttggagtacatgggagtgggccctggaggggtattaaggtgcgatttggttaagcagattggcagtcctgagaaagggaccacacagggagggacatcaggtggtgcatgtaacttgtgacgaagactctgacttccttgagcgctagcaggcctggggacgtgcagggtgtgggagcagagtggcaggtgggagattttggggcagaggccacctcatgtgagtcctctgttagtctgctcatgctgccatgacaaaataccacagactgggtggcttaagcagcagatactcattttgttacagttttgaaggccagatatccaagagtggggtgccggtttctcccgtggcctcttcgtgacaatcactgtgctcacatggtctttcctctgcatgtgcacatccctgggatctctgtgtgtgtcctaatcttctcttcttctaaggagaccaggcgaattggattagggtacaccctagcagcatgttttaacttaattacctctttaaagatcttatctccaaacacggttatattctgaagtcctgggagttgggacttccacatatgaactttggggagacacatttcagttcataatataagcctctgtcatccccatagttttcaatgagtaccagagaatgacaggccgggacattgagaagagcatctgccgggagatgtccggggacctggaggagggcatgctggccgtgggtaagtgtctcaggtttgccgcccacctgccaggggctaacgtgtatcgtgagtgttcaggctgctcgcctgtcctccagctgatgggtgacaccgtgaagggaccacaggatccaagatcgctcagcccagagtgtccagatgctgggaagtcatgctgcttcccggttccctgtgcagttgaacccctagctgtcctggaggtgtcttgtgtgtgtttgcggtgcagctctggagtagggaactgcagtgtgggtattagtgggagggcatccaactgcgctcccggaggagtatgactcatatcctgccacgtttcctctaaaaatacatccctgcaggcagttgtcagatgtttgtgatggaaacacgtggaaagatttttacttgcagcagcgaaacaggcccatgctgaggaaagctggcttggctccaggatggtggtgtgcctcttacattgcccatgtcctctagcagggccctcccactgtgcagagttgggtccctgccctgaggccctcacaacccctctttctactcacttgggaaaatcagtctgccccttttttcattatgctttttttggagctttctggatgggagagatggaaaatcctcatttccctgcctgtcccccatagtaggtctcatggcctgggaagcctagggagatgcacattccactcagccacggtttctccatgacggtcatggcctctccagtctgcccctcctgcctgagcagcagcacagttcctcatcaccatccacattgcttccctgtgtagctcctagccccactaagacccccgcccctctgactcttggtcctttcaccgcagtggttgccaggaaagagggtgggttggtttccaggctttgcgtgtttctgttccaaatagctggagccaagatcatgggatagttgagcctggaacagaaggaggaggagaaaagatggatgcagtgatgggtttgacatctgggcctctaagaggacacttgtagactccatgccctgcttgggctgagaattttctgcagatctggttatgccgagtttctctcttctagtgaaatgtctcaagaataccccagccttctttgcggagaggctcaacaaggccatgagggtatgtaacttccatgtgcaggttgcgatggaaccttagcctcgcctgtgcctgggaccaagggctgagggcagaaggcctggggagagctaaatctcagctgagagttccgaggacctgggtagggaggggactggagggcccagggcaggtgggaaggtgaggaggcctggtgctcatgctcttgggtggactctctttagggggcaggaacaaaggaccggaccctgattcgcatcatggtgtctcgcagcgagaccgacctcctggacatcagatcagagtataagcggatgtacggcaagtcgctgtaccacgacatctcggtacgggcctgctgcaggccaactgggctcccttttggcatctcagtcacctgtggaacctccctccttggagtggccatatgcttggcctctgtgctgtgtgtgggcatcttgattatggacctcggacttgttcatccccttgcccttaaacagattataaatttctgagggcaggtggatcatgaccttgctgtcgcccccaccttgcatcccccagcagcatcagagaacactcgggacctccccaaccttgaccgtgaccttcagcgttccgatcaccgtgtgattccttgatctgtcagtgagaactcatgtcccaaaggctctgtggagctctgctgtcactccctgacaaagcacttcctgcactcagctttatggcgtaggccacatagtaaggccgttcagagcgagggccctgggggtcacgccacttggagtccagcttttctacttgctaactgtgtgaccttgaatggctcccttaaatctccctgaaccccagctccattgtctttaagatgagaaaataatcgttccttcctgggaatgttgtgagtattgagtgaggcagtgcaggtcaagtgtctattaaacactagccacagttgtatcgctgtgtggcagagccagtctgacaaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaagaagccacatgccttgccctcaagttgcttagggtggaaggaaatgattagaaatgagccaagccgagcctgcactcttagagtaagtgtagtggcctcagacagaggagagatccctgggacctgggcagtctgagccttccactggacagtcatgtgtgaggagattgcatttcctgagcaggacactgtgttgcgttacattggtaaccccaatttaaggcagcataaatgcactgggaaaacagcgatattggttagccctgggaagtggtttttaggatgattataatttttttttgtgggtattcatttgatgtggatagctggggtgagtgctgctttccgtcttctgatgggggcctggagaaggctgaactgcattttttaaggtctgtgacgcctgctgcaggacctgcagtgggggaaaattccccagggtggggctttctccctataagggtgctcagggctgaatatcaggacccagaaggctgaaagtgactgtccctcccttaacggatgtcttccttgtttctgtggccagggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctactcaggatgctgaggcaggagaatcacttgaacccaggaggcagaggttgtagtgagctgagatcacaccattgcacttcaacctgggtggacagagtgagactctgtctcaaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggt

SEQ ID NO: 13493 - DNA, 46816 bp, Human
  misc_feature (1)...(46816): n = A,T,C or G
ccttaatcttttgaccatcaaggaaaattcaggattcaggtcagagtacatttttcactgaaaaacacagtgcaaatacaattaatgacaatgacttatttagcaagtaaggtaaaatataagttccacctgtatgaaaagataattttgactttgagagtacacttagatgaatgtcatttaacagatccaggttgtcaccttatattttacacaatatttcgagaactaagaactttctcttccatattctaaaagatgaataacatgaacatatcgggaagcaccatcgttttgcaggtccaatgggtgtcattttaaaaccacccaagtacactgagaccgctaacgctagtaatgtggtgtttggcagctagttttaatgactgtcattagagctttattttttattttctttttatagagacgagcccaggctggtcttgaactcctggcctcaagcgatcagcctgctttggcccccaaagtgctgggattacaggcgtgagccaccgtgccagcctcgttagtttgaaaagcaccaaaagctatccataggaatgtgaactttagcatttcctatcaagtatgtataaatacataactgaaccctcatacagcataaagcttataaatcatatactgaggccaggcgcggtggctcacgtctgtaatcccagcattctgggaggcctaggcgggcggatcacttgaggtcaggcgttggagaccagcctggccagcacagcgaaaccccgtctctactaaaaatgcaaaaattagccgggcgtggtggcgcgggcctgtaatcccagctaccccgaggctgaggcaggagaatcgctagaacgaacccagggaggtggaagctgcagtgagccgagatggtgccactacactcccgcctgggcgacagagcaagattccatctcaaataaataaataaaataaaaaataaatcatatactgaaccatttaacaaatacatatattcctgagaaagaatttcctgggggcattatcgcatttctagtttccttattttagactatttcagagggagatagggtctccctctgttgcccaggctggggtgcagtggagctatcgtagctcactgcagcctcgaactcctgggctcaagccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgcgcgctgccgccagcgaggcccgggaagaccgcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtgagcgtcggccgggccccgtcccgccctccctgcctcccctgcggccctcccctccggcctcctgccggtgcggggccgctgctcagcccagcccagcccagctggagcgggccgggtccccgcccgggtcaccccgcctcggatgtggccggctctgtggatggtgatttttccgccttaaaatcatcatgcgattggcctgccccctcccccgcgccgtcaccccgggcctctgtatatgctgatcttgcatgcagagtagacgctgcaccggtctccttttggtcccggtgtctgtgtcacacacggcgggtcctgccgaaatgcacttctaggaaagggaatgacctgcccgtgtgataatgcctcgtcagtgttcttgggcttttgtgagtctcccctaaatgcaagctgtcaaattattttctggtatttgttcactcctgttccaatagtgacagatgatatccgaacatagaaaatgacttggcttctaagtttgaaatctagacagttttattaaccaaaggaatttactaatcacgcgttaatcgtttcaattaagtaattttcccattctgacaagttctgttttataccaaaaaaaaggaaaaacacaaaaaaatcacaagcaatgtaatatctctgacaaataaacacctggcgtcctgacagtaaatttacaggttgtaggctgcggatggccagccagccaatggaatgaaatagctctgggggtgtgtactggtcctggctagccctgaatttgagcttcaggaaaaatatagtacgtgaagaaaggggtcagataatgtttggtagtcactgggttatcctgtggtttaaatcatttaatgtctgtagatttggcctctgtagtcagattgctttcttcgagcaaataagagcttttttccccccaatacattgcatcatacctctttagtaacataaaatggaaaggacaaaccacttttgtctactgtaaaaaagaaaaattatatggaataaagagcccagggaggcgaggagtcttgttggaggtggattggctgagaagcacagaggatgttgggctagacccatgtctcagtaaacctggttctgtggtctttcagttatgcccgctgacttatgaggatttttagaaatcctctctgtaccggaaaaaacttgagcggtgctggtgttcccagcaggggggacaaaggttgtttttaaagatttactaaatttgcattgaccccgcccacttctaggacttaactttggagcttaattatcccctagctctggttgcctcagccaaaaccaatgtttgaaccactttgacctctgatttcctttctagcttcaaaattgtataaaatgtacacaccgtcagtctcctacatttgcctgccttcttcctaccactcccttattatccaaaccaggaaaacaagttcagactccaaagaaaggcaaataaggatgttggaggaagttcaggcaatgtttagcaaatattgagttgcatcgttttcttaaaacggacatcaagtttattttttactatcttgctggcagcatttgccagtcctttaaaaggtgtacagataaatcagtgtatgtggttttctgcaggatgatttggtctctgaaatcctttttcttcgattcttcagatgcccagctctctcctgtttttataagtcgcagctccgcaaactcactgaagcaactcgtttaccatagtttgtgagtcctctttctcttgttgccacagcagttttaatgccaaaatattgaacctagcaacaaattgggtcagccataccaaagcactgttactgtagcacttgcttgtactagagtgtaagatacaattttctgttccgtttatcccatttacaaaaaaacatgctattaacccccagcatataaacagggagaaactgaattgttactagtaaactgttgcaagcattgatagaacatcaaagaaaattggcctctacaaagtgacaaatttattatcttcaggaatttgaaaggctttctggattggggaagattacatagctatgaaagcccttaaatattttagtttgcttaataaacagtatactaaacagatgatcagcaaaatttgggtactatagccttccatgctttgtgttcaagacatccccagatctatctacccatttatcacccttgtttgcagagaatgtgcattgtaagagagacaggtcttctttcttaaagcttttttaacgtctaagaaattgttaacctttgtagtcccactctagtcttagaaacacagaatatattaggtgattgagatttttttaaatgctttggataatccctatgaaattctgtctttccctcttaaacatattttaacacgttcttcttacctctccccactaacctgtcttctctcccattggttctttgccaaaaaaaaaaacctcatctgcctctctccacccttttaccaaccttcagctttctgtatctcattttccctcaagaacaaccttatccctgagttttctaaattaaaattcttgaggttgaagcaaagcaacaatctagcaataatctctaagggaaacagatggttataagacttggtggctgatgtgtactttttccaagtaaatatttaataatacacactgtttttgtgcttttcttttcccagttactacatgtacctgaggccgttagatttgtctgtgttaaggatttgaaagggtaagctaaaggatctgaagggaagtttaagtgaggccttaaaaatatttccagcaaaggggcatagtgtgagaatatgcgactgatttgagaagactggttcaaaagttctggtgggtttggaaatattatcaaagattgttctattaactttcccagagtaaattatctgtatttcatttgctatggttctgcctgagaccagtctacctttttagaaggaagtttattgttttaaagtcagtttggagggaaagtacagattgataatagcaatttattgatggtaggagtcaattaactttctcttccagtctgccccccccagttgtcttgatattaaaactattaaaattccctatcactgatgctactatcataaaattttctaaaattatcataatttacatatagttgatggaccgtagatggagttctctcatacattgaccctaagtcttttaattacaaatattagtacccaaaaaagtgtaccctatattaatccagtaactagtttttaaaagtcaaaatgccagaaggaaacagtggaatcttgatgacataatgcaagggaagaccggagtcaatgcagtgttaaagacgccctcagcctctgggatgtcattgtttagcgcttaagggaagactatagaaagcactgatactgatttaaaatgagatatttctctgccttcactgggggaaaaaatgtttctgacttattttgctgtgctcaattgacaaccatcaaaacttaggtaacttttaataaactcacagtttctaatatttttaagtggctgtgtgtctgcatctgctgccacagataaaatataacctttgtaggtgaatttaatttaggacttttctgaaagttcagtcagaggataggtaatttgtgtgtcttttaaaagcacttagccccgaggttgttgtttttaatacatcttatttaaatacggaaatgtgttgcccttatgcctttttatttcatggaagccaaatgcgtcttttctcccaaagtatactagaaaatgaagacccttggtaatggtagtgatctgtacatcagatttcagtctttctgtcacttgcgtgtatgaatccatttagcaagtttgcttttggcagtaaagccccacgtgcaggaagacaaacagctgctcactcattatccaaagtatactttgtaagaattagggcatcaaaaattggatcctaagcaccaatatatattaaagttcagtacaacttgtagtgtttaagtacaagaaataaaaattgagcctgaacttttggcatatagtgggaagaaattaggtttaccgctgttaataattcagagtgcttaggaaaatcggtttttatttacttatgttaaaaatactaagggttctgtaaccattaaaaactaaaatactaacctgtagatgttgaaaaaatcctagacactagtctctgccacgtgactgttcttcttttctatttattttacccaataattaggcttttacaatgtaagtaataaagagaaaaatctctagtatcactttagagcacattgattcataaatagcccataaattttgtactcagcaacccataaaatacacatgcatgattcacataatcaaatagtaacgaaagttacaaaatgaaaagtgaagcagctctaccccaagtccttcccccaatataaccatgaacagtcttaaatctaatgccgctgtctaaaactgactagttattcaaatgaatcaatattttcccctttccagaggcagaaattaatacagattcaagtgttcactatcaagtcggaattgttaatatgtgaaatactactgttaaaggcaggaaaggctttattaaggacaagaagacaaactaggagaaggagctactcaagaccttccgattatctttacaaaaaggcaactacacctagaagattctgcagccacacacattctgccttcacttgaggtcaactgccttcaccaaggtcagatattagcaaaggctaacatttattcagctctgtgtgtgccaggcattttattaagaacttttcatgcatcatcagttctatgccttatagcaacaatgcatgtaagaacttttcatgtatcattgcttttatgcctcatgcaatacactgttgtccctgatttccaaatgtggctactaaggttgaggagtgaagtgtcctttggcagggtgacacagctagtacgtagtggagttgaggttcagattctgggcatctgattccagcacccaccttaatcattgttgtctgggatttatttatgcaaaaagttacaaattgtatcttaggcttttaattgtaagcgctgattgagaaccacttcatgccattgacacaatgcttcctaatactttggatcatagatacctttgaaatttctgttaaaagctattagaagacctaccttcttcctagaaaaatacatattcaaacagctttgcatataaaactcagcatagatgatatctctagaggtccatttattctaattgctaaggaaatgaaataacctttttcccctacacccaactccgaagacctgaaataacattttaaacagttttccatcaaaagaggtttgaagactttggtgtttaagagattaatgtgttagccagaacaactcatttctctaccagtgtgtagtccatttatctttaaagattttctattgaataattttgaaattactttcttagttttcttcattaaaaactaagaaaatgctttgtttattatgaattgctatttctcttgattattattcttggagaaagtctatcagacgtaattcttctgatttgcttctaggctagaggaaaatgtgaaagatgacaaatgaaaatttcaaaggttgtcagtagtatgacttcttttatcgtttgtcattatcacaaatatatcaacataggacttttaaaagatattttgtacatattgggccttagtaggattttgcatgaattttttttttcttttatgccaagagagaaagagcaaagaaataaccaagggtgatgtactcgtattgaaggtttaccaaataaggactgcttttattatgaactatagtctatattctaagtaaatcaatttttctattatgtgttttttgttcctgcaggcaagatctctgaactttatgcagagggttcttttaaaaaaacaaagttgaatttttttatttcttggaatattttttttcattgatttctcccaagtagagcagattcaaatctcctttgtaccctatgtcttttttgttttgctataagctcagtattccatttctacattttcctttcctagaaccagtcaataaatgacaaaaaaaaaaacaaaacaaagtaaatcatgtgttgttgcagtaggagttcaaggaaaccaaggacaatcttgtttgtttatttgtttttttgtttgttttttttttgaaacagagttttgctcttgttgcccaggctggcatacagtggcgcgatcttggctcactacaacctctgcttaccaggttcaagcaattttcctgcctcagcctaccaagtagctgggattacaggcatgcaccacctcacctagctgatttttgtatatttagtagagacagggttttgccatgttggtcaggctggtctcgaactcccgacctcatgtgatcagcccacctcggcctcccaaagtgctgggattacaggcgtgagccaccgtgcctggcagacagacagtcttgatgtgggaacagagaaggctggataggagttggataaggccatttcagataaagagggggtggcttcacccaaggcaggaagtggaactgtgtgtaagggggtcatgaggacaaactacatttgtaaataatgagaaataagggcttgtgacagtaaatatatttggtctctttgcctggttcccaacacagagctcctgaatgtcgcaaattcctgagtgataggagcatcttttgttctaactaggacactcttaatgggcttctgggtagcttcaaggtggggactagtcaccaaaaagaccaagccataattagaaatttggaactttcagtcccaccctttgacctctggagattggaaaggggctgaagattgagtttaatcagcaatcagtcatgccctcataatggaacctctatacaaaccctaactgatggctggagtatggggagagttcagagagcttccaggttggtgaatgcatccatgtatgggtagggtggtaccctccaaattccaggggaacagaagctcctgcagtggggacattccagacatggccctgtgtacctcttcatgttgctgttgatttgtatcctttacataagtaacgtttccctgagtcctgtgagcctttataacattattgaacctgaggagggggccatgggaaccccctggttggtagccaagttggacagaagtgtgggtgccctgggcacccaagacttggaactggcatctgaagtagggaacagtcttgtgagactgagcccttgagctgtggggtctgtgctaaccctggtagtcagtgtcataactgaattgcaggacacccagtttgtatctgcagagaactggagaactgcttagtgtggaaaacccacacatttggtgtcagaaatgtgtgagaaaaaacaattttttcctttttttttttttttttttctttgagacggagtctcgctgtctcccaggctggagtgcagtggcgcgatcttggcttactgcaagctccgcctcctgggttgatgccattctcctgcctcagcctcctgagtagctgggactacaggcgcccaccgccacgctggctaatttttttttttttttgtatttttagtggagacggggtttcaccatgttagccaggatggtcttgatctcctgacctcatgatccgcccgcctcggcctcccaaagtgctgggattacaggcgtgagccaccgcgccaggccaattttttccttttatgtttgttggatgaataatgatgaatctagcagggcacagaaagctaggcagcagtggaactgagaatgaagttatagttaatagcagagaatgaaaaagaaaagacagataaaacattttgaagaaaggacagtaatgtattcccaacaggtaggatttacaggatgaaggagagaagaggcaaagataaccacaaaatttctagcctgagagactggtagaaaaaaatggtggtatcagggacagatggggttattaaggaaaaggattggatttttaaaataaagaagatctggtgtaaaattatccttagggaaattggaaatccaggcacgtacttctctccatcatgcccttgaatagtgcagtccctctgcctgtccatgcctcacttccccctccctaggattcctctgcctctcttaagacccatctcaaattatcacgtagacttgtaaataatttatatgaaactggatagctgaggtttcaagcctttatccctttgaaactttttaataacaagttattgttaccttttactaaatccaactttatattcaccattttaactagcatcatttccgattccaagacctgtttggtgtgaaagtgcagctaagttactgttaatcaagatcagaataaaagaatctaccaagaaaaattaacaaaatcccccttttaatgtataatcttccatctgtcaggctgtaagttaaataacacaaaacaaagctgtatgttttatggatatgtacatatataattgcagggaacatgatttggaaggatatacacttacattgctaagaatagtcacccctaaggagaagactggggtcataagtggaagtcaagggagtcttcagctttctttttgtatttaaattttgatagaaatacatacatatgtgttataattttaaatttttaatgaaaaaagtattcttccgttttttctttgatgtgtcaataggttatatttttctaatatcagctaaacatttgcttcccagaaagcttagttacctcttcaaaatttattcaggttaaaataaaagatttagactggattaaaaatctaagatgatatttgcctactttatacaaaacagtacattgatgctgctaaagcaattaaagtataatttttctggtttttttttttttttttggagacggagtctcactctctgtcgcccaggctgaagtgcaatggtgcaatctccactcattgcaacctcggtctcccaggtttaagcgattctcctgcctcagcctccccagtagctgggattacaggtgtgcaccaccacgcccagctaattttgttgtgtgtttagtagagacagggtttcatcatgttggccaggctggtctcgaactcctacctcaaatgatctgcccacctcagcctcccaaagtgctgggattacacgcgtgagccaccacgcccagcctaaagtgtgtactttttcttagctcctatatgcagtgctccttcccatgctgaatgtctgaatttttatctgagacgtagtatttcaggtggtcattacttgtgggtggtcattgagagttcctccctgcttctaaccttcctctcttcattttaaattaagttacgctacattattgtgggttagaaggtacattaatattaagtgaaaaaatataatctgatgagtaagtggcaagagtgttaacttataaatattaagagttgttctgaggcatttttgcttttctggtggttctgtgcttctggtagaactcttggttactgaataaatagttcctgaaaagtgagagagtgcagctggaaattagatttctgatgaataaatcaaaccctattaagagaaccaggttcaagtaattttaaaaccacttgaattttcataaatgttttgttaatgactaattataaaaaacagtgactagctggaggcttttgtgtgtttgcttttgagtcagctaggaaaaggaaaaaaaattcaagcttagtcaattgtggttttcactgaatcttttttaaagtaatgagctggtttgttttcttcatcactatagcaacttaagctagtttctgcttttgatttttatttctcctagagaaacttagcatgtactgctcattagacttgagcatactaaggaatatctgtggtaattaagttaaaaatcagatcagtgctttgtactgtatatagttgcagatgtctgcatttcactaatattctttggaaacatctggataccagttaacataaaataactgtttagtcggtttctgttcagaatagaaggaatgatttaaaagttcccattgtagtacatacgtcattctatccccagcccttcctccagctttactgagattgataaataataaacgtcatgggtggtgtgtctttagtttcctctggtgagctgagtgcacagattactttgtcagcagggtggccttgatttttaggccatgtttctaatggcatcagttctgtggctgacacctgtgtaccaagcccattcactgtctagcttagccagccgtggactcctgctctttgttaaaagtatttaccttcattcctactagcacagttgaccaaagacccagttgatcccaaacactagtaatgcatcaatggagtctaacagagttttaagatgtggtgtgtgcgtgtgtgtgtgtgtgtgtgtgtagagatgggatctcactatgttgtccaggctggtcttaaacacctgagctcaagttcttctgcctcagcctcccaatgtgctaggactacaggcatgagccaccatgcctaactgtctaagactttgggatacaaaaatataatttactttcctccatttctggaataaaacatctcttccttcctccttctagtttctgttctgtgcccctgtttgatctctgttggtcctgttcaccttcagccttctctgctgaaggaggaaaggcttggttttataaaaagtgacaatattcagatcacataagatccttcttgcttcattttggcttaaatattttaagattttctgattttcttgtatatgtatgtattttcctattatttgacttttttgaacaacttcaaattgagtatatttgaacgagagtaggcattcaaaagtgctaggctttccctgcctttcagaactttgaggtatatgtcacatcattttgtccttcacattctccagttgtgctaatttttcccaatccattgagttaagtagagtaccttcctttttgcagtcatattcttacttttttttttttttttaatttttttgagacagtctcaaactgttgcccaggctggaatgcagtggtacaatctcagctctctgtaacctccgccttagccttgtgagtatgggactacgggaatgtgccaccatgcccagctaatttttgtattttcagtaaagatggggtttcaccatgttggccaagctggtctcaaactcctgacctcaagtgatctgcccagctcggcctcccaaagtgctgggattataggcgtgagccaccacatctggcccctacataaatctcttcgtgtcccttagaatgtagttaagacttattttcaggtgacagtatatttttgatagttatctttggtttccaaacccagagaaggaagagtaactggcttcttctgtgtgtgggtacattgtgtcttattggagattgttttgtctcaagtattgctgcagagtattttattaatgggtgcactttaaaattttttgtttttcagactaccagtttaggtagcccagtactcaatatttgccaatttctagaattaaaaacatgtatgaatcactggttaactagaaatttaaaatgaaaatgtttcttctttagcccaggcaatatcacttgcattcatttctatcccctccctgtccctgttctgttggctctggggcttcttccactaagctggtactttctttatagctcctcctgtgcttccattcactaaacctttattggttcatagcctacagaaaatgcctgtggtgtgagaggtaatttgtgaaactgcttctcttcactgtttagcaggttgagctctctaaatgggtgtagctgggaaagaaaatttaactttacaaacaagaattcctgggttccatccagcggaacatgtcttttgttatacacacacagtttctgactcatatcattccatgacttatgataaaatggacattctgtttacactgttgtgtggaaggaggggtctggttcctaatttttagtaacatctatttctagaatattaggcttgccatttgaatgcttctgtttgatttatgaatatcattggttccagcagtttttagctccctgctaaatgcaagttaaaatttttaagtttctaagttaaaagaaaataacttttcctccacttaagaaagccaggaaaattaaaaataatgtagtgatgacttccacaggctctaaaagagcaatgaaaaaagtgatttatgtgtgggagaagaaatactagttcttaattaatacattgttttaccacttcccgtgaatttatgtagaagtaatgaaaccaaggtttaagtcatttgttcaaactcctgtcagtttagactttttaattgctttgttacatgccattgctttgtaatacttgttatagcagtggtaacagttgagatttgcctgtttgaccacttgcagggcaccgtgccagattccccatgtgcgatgttcctcgcagttgtgacgcccatcctaggagggtggcgttagcacccctccatgcaagcggatggtgcaggctgggtcacctgggcacagcgcctgactattttcctggcttagtgtagttatcattaaatatgtggtattacttagaagcattttgaataatttgaaaagcacattttagtgttaaaacaatttttttttttgagaaaaggtctggctctgttgctggggtggagtgcagtgacctgagcgtagctcactgcagcctgcaactcctgggctcaagtgactctcctgccccagcctcctgagcatcttcgactacatgcacatgcccccacgcccaactcaatttttttttttttttaagatacaaatgattcatcttaatattatttacagtttttttttcccttttctgtgggctttatctgactggaaattctttttaaattttttattttttaaattgacaaattgtagatatatatttatgaggtacaaagtaattttatgatttatgaatacaacattgcataattaagtcaagctgattaacctgttcaccactggaaacaattgcaaataattatcattttttctggtgaaaacatctgaaatttactcagtgattttgaaatgtgcagtactttttgttgttgttgtagaaatgaggtctcactatgttggccaggctggtttcaaactcctaagctcaagtgatcctcccacctcagccttccagtgttgggattacaagcatgaactaccatgttgggccaaatgtataatctattattatttactgtattcaccatgctgtgcaatctatctcgaagaaacttattcctcctgtctaattgaggctttgtgccctttgaccatcatctccccatcacccccatccccaatgttgtatactgagtcctttcatgatatgtatggaggcttatggtaagttatttaaaagtacatgtatgtcaaaattttttgtggccatagcttttctttcttttttaaattttaagagtcagaatattcgtatattaattcagcatgtatttgagtgcctaatgtatgccattttctatgttaggaaccaggaattaaagcagtgaacataacaaagtctgccctcgtggtgctaacttgccaggtagggaagccagatactaaacacatgtataatgcaaagtcagtaataataaacgatatgaagaaacaagtaaggtaggagaggcaggaaagtgggagtgagaaagaggtgctcttttaaatacagtggtcagggagagcctctcagaatgaagtttttaacagagacctgaatgagatgggggagtcagctatacagatatctgctgtgtgctagaaaaattacctgtaattttgcattctaaaagtttaatgagtacatttatttcacaatttgagaatcagttatgtacaagatatagttgtaagcacatactcctctaaatatgatttgtttttacagtagaccaaataagtatgttcagcttagaatatgctctttatgatctgtataataaatacattctcttaaaatattgttaatattaaggttgatgttttcagaaacatgtaagaaagctagcttttaaaattgactagggaagttctctcaaactgccagtccctgagatattgtatattttctatctgaaaaacttttaatctcagaattctttaaaagagctctccctggggctcccattacttacttgtgactcccagtggaaatcgtacccagcccctcgagaggggctgaatctgttgggagtgggagggtagaaaaaatgctgcagcttcttgtgggtatccttcacacacaaacacccagtgccccaagcactgtgcagtcaaacatcaaccccactcagactttcctccttgggattgagaagcaatggattatagagaaagaaaggtggcttagcactccaaaactttgaagagtaattgaccaagacccccaaagccaaagctgtgggcatccccacttccagtataccctgtaccaacacgtaatggctactagatacaggggcactagtacctacctgtctgcttggctacctgccctctttgcagaagtggtgaagggaatcactcaacctcagaaagggaaaatggctttctcattttcagattgaaagaggttggcagtgggtgaggagaataacaggtaaggatctcttttaatatacccatttgaagccaaaacctctgtttagacatacggtattttgaacctggtgattattcattgcccatgtttgtgaattatcagaaagcagaattcttgccaggcatagtggctcatgcctgtaatcccagcactttgggaagccaaggtgggaggatcacttgagcccaggagtttgagaccagcctgggcaacatggtgagatcctgtctctacaaaaaattcaaaaattagctgggcatggtggcatgcacttgtggtcccagctactcaggaggctgaggtgggaggattacctgagcccaggaggttgaagctacagtaagcagtgtctgtgccactacgctcagcctgagcaacagagcaagaccctgtttcccacccctacccaccccctaaaaaagcaagctgaattcttgaactccctgcaaccaggtcacgcaaaccaaaggtaaaaggaacataaaaaagccttctggaaagtgtacagaaattcattgcagggtgatttttgtcttgtgaaatcatagttactgttattagcagcttttttaaatgttttatattcattttttatggtgttctgatgtatgagctgcttcaagtgtttttggacatagcttgggtataaaatgtaaaaagtggatattttcaatttgtagctttcttttttgaagcttacttaagtttgttctaaatataaccccttctttctcacccaccccaacacatttttttaaaaacaccaccaggtatccgttacagcactgatgtgagtgtagatgaagtaaaagctttggcttctctgatgacatacaagtgtgcagtggttggtaagtgatcgcctttcttgctgcctaatgagaactctggggaaatatgtttacacacatgttactgttaagatgctgtagaaatataccttatcagaactgattttttttcaagttgtaatctttaagacctgcatcatttttcaattagtctaaattaagatatagccttttttttttacatgggggattttttaaaataggagataattggattttaagtctagatctttgttttcaattcctcaacacattctgtaaataagaccaaattatagtagaaggagagtaaataagctattatcttttagaagtggtaaagagcactgattaaatatatattagaacttggctagccaattttattgaacaatttctgttcaacaaaatgttgtttaaagtacagtttagaaaatgatggtaggtttatttcttgaattttcagaaattcaagcttaaagcatcacgtttctctaatattgtgtggtgctttctgtcattttacttttttaacatttatatggaatagcaaccatcagccttctctttcagatgtgccgtttgggggtgctaaagctggtgttaagatcaatcccaagaactatactgtaagtatgaaagtgatatttgttttttattgttgttgttgtttttgtttttctgagacagagtcttcctctgttgttcaggccggagtacaatggcgcaatcttggctcactgcaacctccgcctcccgggttcaagcagttctccttgatccagtaactgggattacaggtgcacgccaccatgcccgactaatttttgtatttttagtagagaggggatttcaccatgttggccaggctgttcttgaactcctgacctcaggtgatccacctgccttggcctcccagagtgctaggattgcaggcatgagccaccgcacccggcctcaaagtgacatttgtgcacacagtgcatttatgaaggacttgaaattactgggcttctctgtatcccccactatcagtgagatcagtagtccccattgcttttcaaatggaatagaaaaatgtaaagaattaactcatagcgtgttttgccatataaagatcacctacttaatatctatatcctttatcattttctgtttcatttggttttgtttttatgagtcttttgttttacttttttgctttttgttttattattttcttacttagttaaaacgtaattaatatcttcacttatatacttatacccatatttatataatgtcttcacttagacacttatacccatatttaagaaatactgtgatctgattagccaggcatagtggtgcacacctgtaatcccagctactcgggaggctcaggcatgagaattgcttgaacccaggaggcagaggttggctgagatttcaccactgcattccagcctgggtaacagagcaagactctgtctcaaaaagaaaaaagtattactgtgatctgaagtttttatgtcaggatctgattctagtgacacatatcttaactaagactataaaaaccttactttttatccagtcagttccaagttaattcaaactgattgtcacaatgctttacataatactaaattatctatatacaaacataaatgcatgatttttattctctttaaaattcaccatttaaatggaatataattatatttaaattaatcttaattaagatttagtgtatttttcagtggggaattaatagaatgggaatttgagccctagttctactatcttgtttttataacctacttttttgatcccttattttgtcacctttaaaatggcaatgcctactttatgagttgttctaaggattacatgagaagacatatgaaaatgtactataaatagaaaataagatgctagctataatctcaagcgatttttatatcaattttttcttttgtttttgttttcttattttacaggataatgaattggaaaagatcacaaggaggttcaccatggagctagcaaaaaagggctttattggtatgtgtagccacatagtttttggtataaagtgggaacatctaaaaatttttttttttttttgagacggagtctcactctgttgcccagactagagtgcagtggtgcgatctcgtccgcctcctgggttcaagcaattctcttgtctcagcctcccaagtagctgagattacaggcatgtgccaccacacccagctgatttttgtatttttactggagatggggctttgccatgttggtcaggctgggcttgaactcctgacatcaggtgatccacccatctcggactcccaaactgctggtattacagataggagccactgtgcccggcctcctactatttgttataggagcttttgccaaacatacaacatttctgaagatattaatctttgtttgcttgatgtttttgtatcttactattatctgtgtttatattttctttgtgcacaatctgaatattctttttatgatatgtaagtatttgtcatgtaccctttaattttcaagcagtttaaacctatattttttttaatctagaaggcttctaatttgtttgaatagaatatgcataactacttaatagaatgcttgccctatcagtatagttaatagaatgttaatacttactgccgagcgtggtggctcacacctgtaatcccagcactttgagaggccgaggcaggtggatcacgaggtcagatcgagaccattctggctaacggggtttagtaggaatcccatctctactaaaaacacaaaaaatttgccaggcgtggtcgcgagtgcctgtagtcccagctactcaggaggctgagacaggagaatggtgtgaacctgggaagcagagcttccagtgagccaagatcacgccactacaccccagcctgggcaacagagcgagactccgtctcaaaaaaaaaaaaaaaaaaaaaaaaagaatgttaattgttacttaataatagaatacttgtcctatcaatatcagtatagttaaacaaaataaggtctacttaaatagaaaataaagtgtatttttctctactttcctttcttagcatttcccccacaagttcccatgaaattaaactataaaggctgggcatggtggctggtgcttgtaatcccagcatttttggaggctgaggtgggaggatcacttgagcccagaagttcgagaccaccctgggcaatattacaagaccccatctctacaaaaaatgaaaacattatccaagcgtgatggtgcatgcctgtggtcccaactactaagatgggaggatcccttaagcctggggggttgaggctgcagtgagctatgattgtgccactgcactctggcctgccacactctggcctgagcaacaaaacgagaccacatctcaagaagaaagagaaatgaaataaagctattcggattcatttttaggaaaaaaaagtcatgaaataaatgtcatgaaataacctaatatagaaatacagtaagtataggtaactctaaaacttgactagatttggcctgtctttgataataaaaggcatttgggcctttgatgtgccgcatacccagcactactgtgaacttgtgcatccttacatggagtctgttaacgtaagttaatatgagttaactatctcgctcacacttttataggagtgcctactgattctgagatatggtgaattgaagtcatcttcagcctgttaatagccttcataatttttaaaaggtctttcctcttcccctaaatctcaaacacattttatagtcttgaatggtttcagactttattcagtcatatttatcacccatatctgcaatatctccagcttaattttatcagacttgacaagtacctaataattccaaaggtcaaaaagtgattcattggaatactgaaagaaaacacagcttaaactctagtaatttgatttatttgcttaatgtgcaaaagcctcattgacccaggatgcagttaaattgacgtcttggcccagaaagctttgaagcctaggaggtaggcaaagggagttttttctctcactcctcggcaaaccttcaaatttgatgttatttatctgttatttcctgactgcccattccacagagagtgtcagattgaggctcagacctgagcctgaaccctgatcctgtcacatgtgtgtttagcatcagcttgtaaatttctgcaaaacaaaagaaaaaaagaggctgggatttttataggaatttcattgaatctgtacactaatttgtggagtattgccatcttccccaccctccccaaaaaggttttgtcctttcacccaggctggagtaccagacagcagtcactgcaaccttgacctcctgggctcaagcaatcctctcacctcaccctcccaagtagctagaaccacaggggtgtgcaactgtgcctagctaattttttaattttttgtggagacacggtctcatcacgtatcccagactggtctcaaactcctgagctcaagcagtcttcccacctcagcttcccaaaattctgggattataggcatgagccactgcacctgaccagtattgccatcttaaccatattaagccttccaatgctgaatatgagatgtctttccatttatttaggtctcttgatttctttcaatgatgttttgtagttctcattgtagaagtcttacatagaagtcttacaactaaatattttactccttttaatgctattgtaagtgacattggtctatagttttcttatgatgtctttgtctagtctttgtatcaggacaattctagcctcatggaatgagttgaggagtgttccttcctcttctgcttttggaaaagcttttgaaaggtcaatgttcattctcttgtgtgagtgtaaatatcacctaagttctgcaggaccctgatgtctccacccttctcatccccttatatctctgtgtaccaaaattaccctttcatctcctactctatagtcacatgctgttagaaaagttgcttttttaaaaaagattaacttctgcctcatacctgttctctatataagaatttatctgttaggccaagcatggtggctcatgcctgtaatcccagcactttgggaggctgaggcgggtggatcacctgaggtcaggagttcgagaccagcctggccaacatggtaaaaccccgtctctactaaaaataaaaaaaaattagccaggcaggtacctgtaatcccagctactcaggaggctgaggcaggagaattgcttgaacctggaaggcggaggttgcagtgagccgagatcatgccattgtactccagcctgggcagcaagagtgtaactccttnnnnnnnnnnnnnnnnnnnnccaaaaagaaatatctgttatttatgaactacttgttttttggtttccgttttgttttgagacaaagtcttgctgtgtcacccaggctggagtgtagtggcacgatctcagctcactgcaagctccgcctcccgggttcacgccattctcctgcctcagcctcccaagaagctgggactacaggcgcccgccaccacgcccggctaattttttgtatttttagtagagacagggtttcactgtgttagccaggatggtctcgatctcctgaccttgtgatccactcacctcggcctcccaaagtgctaggattacaggcatgagcaccgcacccggcctcaggaactacttgtaatctgtgcatccctatacattagttttgtatggagtagaaaactcataagcctaataactaataccttgtgattttgttttggatggcagaagctgtttcacgtttagcatgtatagactgtttttgagaaggattttatcattacgtgtttctgatttacaaaccatgtgtttcagacttgccacttgccagagcccttctccaattggaattgttttttgtttttttgattttgagacagagtctcgctctgtcaccaggctggagctcagtggcgtgatctcggctcactgcaacgtctgcctccctggttcaagcaattctcctgcctcagcctcccgagtagctgggactatgggcatgtgcctccacccccagctaatttttgtatttttagtagagacggggttttaccacgttggccaggatggtctctctctcttgacctcgtgatcagcccacctcggcctcccaaagtgctgggattacaggcgtgagccaccgcgcccagccggttttttgttttttaaatgtattgtttaatcaagacaggatctcactatgttgcccaggcttgtctcaaattcctggactcaagccatcctcctgcctcggcctcccaaagtgctgggattacaggcataagccactgccccggcctagttggaattgttgtttgaggtaacaagcttatttaatcctaaagcaagcataatccttttgtagttacctctagaaagattcaggaccaatttgtcatttgtacattgggagaaaaggagtggttaaacaaagttgtgctgacctccagcagaggtatgtcactaaaggaatggaaagtgagcaaataggagctggagagcgccagagagcccttttgtcagtggatgaggctagaatatggcattaatctttccaagtgcagtggggattagacttcacaagattttgttgttgttgttgttgttgttgtcattgacttcatgagatttttaaggtgactaagggaagggtgctaagacatagagttacagattaggtgggaggtggagagggtcagggtataaaaagcgatccttgaccatttcaaagttatcttatactagccctgtatccattacatcacagcttgttcaaaaaagtttattatttaggccttgggcccctgagttatagaaaaacattacaatatactgattctgttgactaaaaagtaaaatttataggaataattgggtacagcccttagaaagaactttaattattttatggggagacataatagtttaatagtttaactttttttttttttttttttgaaacagagtcttactctgtcgcccaggctagagtgcactggcgcgatcttggctcactgcaacaccccccacctccattcaagcgattctcctgcctcagcctccggagtagctgggattacagacatgtgccaccacgcccggctaatttttgtatttttagtaaaggcagggtttcaccatgttggtcaggctggtctcaaactcctgacctcgtgatccgccctcctcagcctcccaaggtgctgggattacaggcatgcgccactgtgctcagcctaatagtttaaccattttttaagttgcgtttttcgttttgtaaaaacgagtttgtattttacagttgaaataatatagaaagttataaactatatatatggcagggaagagaaaaaaattataagtgggaacatgttatacatgctgtatgaaacctgcctttttccatatgtatgttcatgataattccaagtaatttacatggatataagttaccctttttaatggctgtttagtactttgcataggtataccatatttcatttaattggcatacaagataattaggttgtttttatttttactgtgtttgagaggagtatttctgcacctttacagatttgagtgagcatcacttaacatgtttttatcagagatcttactgtagccgtcagtagtagtatagtcagtgattcctgttattgcctgtaagctaatttattagcctaaacctttaatttcctatgatctgaggaactgaaagctaaggcctaaaaccttatatgtgctgaatgtcgaataataggtcacagccacattcttccacaagtaaaaataatatggggcttaacacaattgctttagcaatatgaccttctcccctttttctctacttgataaggagggcttatacccccactaagcagcatgttactctgctatctcatacatgtcaactccctaaccataataatcctgcttatatagaacacaatggtactgttatctctaattgcatgttagtgaaatgaggtcaagagaggctaaactgattaacctctggtcgcacactcagaaatcctatggagtggcttatatctgttgtgcatagctaacttccaaacatacagcaagtaaatgccagagggagaaattattatgtaatgttgtatgtgtctgcattttatagtgaaacatttaatgaatatttctatgactttgattagctacctaaatgagatctaaagttttctagccatggtaacttggttattacagagacttacaaggatctttgtgttcgagaagaatttttcttaaaaactggtgcactcctctttccctgtgcccccgcaggtcctggcattgatgtgcctgctccagacatgagcacaggtgagcgggagatgtcctggatcgctgatacctatgccagcaccatagggcactatgtgagtacccactggaagccccgaggcttctgcatttgctgtctacaagaattaacagtttgactgattatatcaaaagttgagaatccctgggtttttctctcattcaatcataatcttgatgtgcatattattttatgtctacttgtctattcttaaatcgtaatgaacacagattgagctttacttatatgctgccctatacttgtcactggaacaggaccagggcagcccactgtgctaagacactagaacgtacatcaagaagcatccaattctgatttttccctcagagggcttccatttaaagaggaactaaggtgcataagcagataaggtatggaaataatgtaatacaacagtggagattatgaattctgaaataagactttctagaggagatatttgggctagaccttgaaaatgggtagaatatgaacatttagagatttggaggataagaggaagagaaacaatagcgttcagtttgtctgaaggtaaggcatatttataaaggtaatagaaagtaagagtgagggctggatgcagtggctcattcccataatcccagcactttgggtggccaaggcaggtggatcacttgagcccaggagttcgagaccagcctggacaacatggggaaaccctgtctttccaaaaaatacaaaaattagccaagcgtggtggtatacacctataatcccagctacctgggaggcacgcttgagcccaggaggttgaggctgcagtgagctgtggttgcaccacagcactccagcctgggcagtagagtgagaccctgtctcaaaacaaaaaaaaagtaagaatgaagaggtaaatgaaccaggacaaaaacaccaagccccagtgtttgtgttttacatggtagtcagtggagaaattttgctgatccttcctggggaagaataggctggcagcagtgtccagctgtgctggcgccaggagagaacctcctatggtgtcagtgcctttccaccaagtccaggagccagaggaccaggagaggagcattgcacatgtgaggcacatgacagagagactcagcaaaactggattggatatatgtggaattaaggaaagggaccaggctgagtcacagagaaccaggagaacctgagtctggggactgagcagaggtagtaccacagaactgaacatgagaggaaacttaactcctgtccctgaaaggggtgcaaccttaaaaaatgaaacatttcaggagtaggaagagaaacagagtcaaaaaatacatttatgcctactacatgcagggccatgtgtaagcaaggtattcactacaattgggataaattgctagaagttgttttgaagctatgaaaaagaatcacaggcccatccagtcctttcagtcctttcaaggtaaggtcagaaaaagcctcctaggagataaaaccttctggtctgcacttagacgggtgtgtggacatggactagggtaggggtagtggcaagtgtttggaacagaaggaattacctgagggaaggttctgaagttcagaagctgggtgaacttgggaggataaggactgactactgtggccagagttgagaaagagaaaggtgggataagaaaggccagtagaaaaaagggtcaggccaggttactgcttggtaggtgaccatgagaactttggtctttgtcctgaaaacacagggaaacagcaaagagctggtttcaagcaggtgtgactcagctaagtgtgcatttgaagacttgagggcaggagactactacaggggcccggactgcaaggggatatgaagagggaagcagggcatgaaatatagcctccaactaagaaaaatggcaccggagagaagcagaaagaagacagcttgaaaagtggctgttacccagagaaaaaggttttttttgtcttttggcatgtttattggctgtaagacacagatttaccggtgcaagagatagacaatgctgaagagatgcaggctggtagaggtagtgaagtcccccaggggaatgaaggcctggggaattcttttcatagtgaaaagatgggccttggagaagaggaagaatgtggaaatggggacatttcctgaagtgatgtcatgctgtggctgggaacatgggcagaccacctgaagtccaaccctggcaccttcacccatcagtgctgtgacttgggagtctctgtgcctccatttcctcctatgcaaaatgacagtagtaatagtacctactttgtgagactcatgagcattagatgaataataatctaatgcacctagaactgtacatagcccttagtaagtatcagaaaataaatatctgtaggtattacatcaggtaaattatacaaccccctgaaataaaacaggaacgatatagacccttcaaataattgtggtttcaactgcccttcccaaaaggacagttttccacctgtcacctttttatgcatccttcccttagcccttgattttagatttcttatcacttgaaggaaaactgttcaccagtatagttcaaggggccgtgcttcacaggactttctcttgctgttagcactgagaatgagctacaaataacatactgcccattggtttgcactattcaatatagtgtcttgcttaaaaagaacaagagaccagctgggcatagtggctcacgcctgtaatcccagcactttgggaggcggaagcaggtggatcacctgagatcaggagctcatttagcaatgagctctgggtgtggtatttttttttttttttttttttttttttgagacggagtctcactctgtcacccgatctcaggtcaccgcaacctccgcctcccgggttcaagcaattctcctgcctcagcctcccaagtagctgggattacaggtgcctgccaccatgcccagctaatttttttgtatttttagtagagacggtgtttcaccatgttgaccaggctggactcaggtgaagcaactatactggtgaacagttttccctctttaagtgataagaaatctaaaatcaagccctaaaggaaggacacagttgtttttgttactcatttctagatgtgaactgaaacgtgccgccctctttgtcctagccccacctagaagtgcagtgtaggtgggagaatgtattcttctctgggctttcaggaccattacgtatgctggggagcctggcagttggcgccaggcctgaccccagacagtatttccttcagctccagcatttgcattctcactgtttaaaagcatttggcactcggtttgcatttctgtattcataagtgttaattattcatgaaagcaaactgtgggaaaactactaattctattaatcactctactagactgagtttttcttccttgctttcatcctttttgttggtaattacacaaataatataattctaagttctctgtgtaaaaatatttaaacaatacagataaagaacagatcactttttaattcagccagctggaatgttagggatatgttgggagttaggggtttggtgtgaagtagggcattttattttgtttacatggaaagcaaattgcttcaacaaatttattattttatacttttgccactgacttaaaattttatatgaattttcattttatattgattgcctatacaaaataagactgtctctagtttctcctgctccaccgatgagtttactctgcagtgttctcgtggccgtgcttatagtatagttgatgtcttggaagggaagccctacttagcccaattcttcttttttctaattacacctgtttctgtttctgaacaagaatatacacacatcttcaattgaaagaggacaggccaggcgcggtggctcacgcctgtaatcccagcactttgggaggccgaggcgggtggatcacgaggtcaggagatcgagaccatcctgactaacacaggatgttactctctactaaaaatactctactctactaaataccccatctctactaaaaatacaaaaaaattagccgggcgtgatggtgggtgcctgtagtcccagctatcgggaggctgaggcaggagaatggcgtgaacccgggagatggagcttgcagtgagccgaaattgcgccactgcactccagcctgggtgacagagcgagactccgtctcaaaaaaaaaaaagacaaagaaagaggacagaaagatggatggtgaagactgttaacccccatctccactttgcagagctaaccactgctaccaaagatactctgctcacacagaagcacaggactcttacccacacatacctttttaaaaatacttcattaaatactttcgttactctactcttagatgaacttgaatgtcatgttatattaagtatcaagttatattaaaaacttcctttttcaaaagtggcagaatacaacattgagtcttcccatccaagacaattgtaaagcctcttcctgtctcaggctctgttttggtgacatgctcaagtcttatagtagattttaagacactcatgaatgggatgtgtatgtaccttgatttagtagtgcttaaatacttgttgaaggaatgatagctttaggctgagctagctctacttttgtgatgttatttgtacttacttgatgttcaatccctacactcttgttttttctgtcagaaaatatggtctactttgccgggcgtggtggctcacgcttgtaattctagcactttgggaggccaaggcagggagatcacttgaggtcaggagtttgagaccagcctgaccaacatggagaaaccccatctctactaaaaacacaaaattagccgggcgtggtggcacgtgcctggaataccagctactcaggaggctgaggcaggagaatcgcttgaacctgggaggtggaggttgcgatgagccaagatctcaccattgcactccagcctgagcaacaagagtgaaactccgtctcaaaaacaaacaaacaaacaaaaaaaaaaaaacagaaaatatagtatattttattgtattttctaggaacagaaagctgaaaaagtgagtcttgtctctattggtaaaagtataccttaaatacattcatacacacactcctaattagcatatttttgattaaatgagaatgtgctttgactttaattcattatgttccttcaacagagaaattggacttgacatttcattctttcaattaccccctcttacaggatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcaggtaaaaacaaaaacaaaaaaagtttccttaataactgatagacattaagtaaagttttcaatgtttttagaattgtaattttaaaattaagttatctcaaatctcttaaattttagagtggtggttttcagagtaatagatattttgttttttgaaccttggtatgattcatgtaactagaactgatttaagtatctctcaagtacatgtgaaactgttaccaacttcaaccaaactatcaccaaattcaaccaaaatattggttagtattcaaacttgaaattatagctagaagggcaagtctcttaacataattttctaagttttgtaagtatatagaaaggtttacacactgacccaaatttgtttcatgtgttaacatgtattttacttaggagaatcttaattaagttgaaattacttgaaaatagaagtggtggctggacacagtggctcatgcctgtattcccagcactttgggaggccaagacgggtggatcacttgaggccaggagttcgagaccagcctggccaacatggtgaaaccctgtctctactaaaagtagaaaaattaagccgggcgtggtggctcacgcctgtaatcccatcactttgggaggccaaggtgggcagatcacgaggtcaagagatcaagaccatcctggccaacatggtgaaacccggtctccgctaaaaataggaaaattagcagggtgtggtggtacacgcctgtagtcccagctactctggaggctgacgcaggagaatcacttgaacccgggaggtggagcttgcagtgagccgagattgcgccactgcactccagcctgggtgacagagccagactctgtctcaaaaaaaaagaaagaaaaattagctgggcatgatggcggcacctgtaatcccaactactcaggagactaaggcaggagactcacttgaacccgggaggcagaggctgcagtgagccaaaattgtgccattgcactccagcctgtgtgagagaatgagactcggtctcaaaaaaaaaaaaaaattgtatttctccaaattagtgacatcccttttcacaacataggacatctgatcatcaaggactgaggacctggtggtgtacttaacaccactgccatttattgattgattgagatggagtctcaccctattgcccaggctggagtgcagtctcggctcactgcaacctccacctcccaggttcaagtgattctcctacctcattctcccaagtagctgggattacaggcacggaccccatgcctaatttttgtatttttagtagagacggggtttcaccatgttggccatggctgatctcgaactcctgacctcaagtgatccacctgcctcagcctcccaaagtgctggaattacaagcgtgagccaccatgcccgctcatcacattcttaaacagagaattttattgttgaagagaaaccagttagtacattgtttcttttggcaaaagaattttgagaattgcttctaaataaacagagtatggatttacattggtcaaaatatgactcttgctgtctataccaggactttaatttttgtgttatgggtaattgttcttcacagggatttggtaatgtgggcctacactctatgagatatttacatcgttttggtgctaaatgtattgctgttggtgagtctgatgggagtatatggaatccagatggtattgacccaaaggaactggaagacttcaaattggtattaatacatttttatagcatagacactaaatataaatatttaaaactctggtgcagctattaattgtgattttcaatcaatggcagcaacatgggtccattctgggcttccccaaggcaaagccctatgaaggaagcatcttggaggccgactgtgacatactgatcccagctgccagtgagaagcagttgaccaaatccaacgcacccagagtcaaagccaaggtgacaacattatagaaaccagaaccaacattatcaatgtgaatgacgttaggggggtcatagaagagtctgattgagttttctctttctttttagcagctttattggcacatactgcacataccatacagttcccccatttaaggtacataatttaatggcttttagctaccggcacagagttgtgcaaccattaccaaaacaaacgcatctgcctgacactcctgtaaaaaaaaaaaacaagcaaacaaaaaaaaaacctagataaatagaaaagtgaaaggtagttttatacacttggcagagaaaaataacctctatttaactttaactgaaactgtgcttctccccacagccccttgttcatatatgcacatctcttgccctcagtggaggggatttgacggtggtgttcgcatttctctatgttcctgactctcttgcagatcattgctgaaggtgccaatgggccaacaactccagaagctgacaagatcttcctggagagaaacattatggttattccagtaagtcatctatatttattaggctttatatgtacttagaatcataatagtcttttgcaaggaatttggaggaagagaggaattattagtctccaagctctagtgaattcatctttttcacttttgagaaaatatagtagaagcatggttaattctaagcctgttaattttcactttgatcgaaacatttattccaatttcaggctctttactgaatgtctttagccttctaagagtctggttatataaatgtgtactgtgttagaaacactattctaactaaagctcttaagattttctatatgattcctaaccttatgcatttcaagtgccctttccagctttactcagaaaactaatatgaggaacacgtgctcaggttttttagcaagtaaaaatgagtctacaccaaaaagttactagaaattaatgtgggcttggaatatattttaaagaaccccctttgctgaaagcacttaagacatttaatgtaactgaaatgggctacccttaggtaataggagaaagaatcctgtcttctgagaggccctgtggacagtccagtccaactggttggtgggcaagccatttagtctgagaactaacttctggtagagaagaggctctaaccaaagattattaactttccttgattaataagccaaaaaatgatttttttttttcctaaatagaaaaagccttagatggaattgggtgggatgggaaggagtgttaattaagtgtgaaattcctgatactggctaaaatatatttgcgatatttgaagtccagtctaccttggtattgaaattaaggtcttaggttcattttcagcttttacgaaaaccatcatcttctaatttctttgtcttatttttgtgcataggatctctacttgaatgctggaggagtgacagtatcttactttgagtggctgaagaatctaaatcatgtcagctatggccgtttgaccttcaaatatgaaagggattctaactaccacttgctcagtgagtatcgataatcttgttcgccaaaactcatcttttgagccagctgaaaggctgtaaaaaggtccacttaagagaactgatccctttgggaaagaattgagtctcagaaaagaaaataatattttgtctcatgaaacttagaccaaaaatgcacaatgtctttctggatattaactctcccatgtattatatccagagttttattctgtgatgtaatattcacagaatataatctacattttttttttctttttttgagagggagtctcgctccgtcgccgaggctggagtgcagtggcacgaactcggcttactgtagcctccgcctcccaggttcaagcaattctcctgcctcaccctcccaagtagctggggctacaggcactcaccgccacgcccggctaatttttgtatttttaatagagacggggtttcaccatgttggccaggatagccttgatctcctgacctcatgatccgcctgcctcagcctcccaaagtgctgggattacaggcgtgagccactgtgcccagccaataatatttttttaagtgtgattttaaaactccactgtcgatactaatttctgtctctggttgctcttagtaaaggcctatctagtgtcaagaattgtttttgagactcctgatgagaatacttgtttttctttgactagagtaagctccacagttaagagtagaatttctcatctagttgaaataagaccaagacctcctactgagcttctgtactcagcccactgtgagaatctgggtgaagtgttccatctatttccttttctttttcccccagcgttttctttttaatagagccaaggaaaaaccctggtaatgggtgttatggaaacagagcagtgacctaaattcacatttatataggaaattggcaatgtgttttattccttcctgactgagttttaaatgattaacccttttatgtcattaaaactctgtataaggccaggcgcagtggctcacgcctgtaatcccagcactttgggaggccaaggcagatgaatcacgaggtcaggaggtcgagaccatcctggctaacacggtgaaaccccgtctctactaaaaatacaaaaaattagctgggcgtggtggcgcgcacctgtagtcccagctactcgcaaggctgaggcaggagaatggcgtgaacccgggaggcagagtttgcagtgagctgagatcacgcctctacactccagcctgggtgacagaccacgactctgtctgtataagtttttgggttacagttatagtttgggactacttttgattctacttttttttttttttttctgttagcaatatcttgatctcttgttatttttttgtagtgtctgttcaagagagtttagaaagaaaatttggaaagcatggtggaactattcccattgtacccacggcagagttccaagacaggatatcggtgagtgtggtgaccccacagttgtacttcacacatgctccctgctctttccttcagacagagctggttagatggatttcatctgcggcatagtctttgtaattagcttgacagtaagtgcgtgacatgtgtgttttgtacctttccttttcattacattctaaaactggagtaagaatcctactgactactaacaaatataaaataaataaatttggtatttttcacgcacgtgttttaacagtgaaggattattatgtattttaattattttaagcttcagagaaataggaagaattgaaaagcaagcattagattgaactatatgggagtccaagagtttgagaccaacctggggaacatagtgagtccccatctctacaaaaataaagaaagaaacaagaggccaggcatggtggcacacgcctgtaatcccagcactttgggaggtcaaggcgggtggatcacgaagtcaagtcatcgacaccatcctggccaacatggtgaccccgtctctactaaaaatacaaaaattagccaggcgtggtgctacacgcctatagtcccagctacttgggaggctaaggcaggagaatcacttgaacccgggaggtggaggttgcagttagccgagattgcaccactgcactctagcctgagcaacagagagatactccgttcccgccgccgccacccccctccccccgccaaaaaaaagaaaggagggatggagggagggaaacttctttaccagtaaatgatggaagacaggaaaaacaaaagtccataacacataagcctgggggaaaaatttaacctcattgttaaagaaatacaaattgaaaaagagttttttttttttaatgtattaacaaaaacaatggatcttatgttctccatatatgtggtgaaacagttgtacctttattctagtgacggtgtagattggtgcagctctttggaaaatgtgaagttattaaagtgttcctgccctttggtgctatgacaatctcccctctgggaatttatcctaagaaaataattcaaaagaggaggaaccactccatgcacgatgatgttattgaaactatgtgtaggccaggtgcggtggctcacgcctataatcccagcactttgggaggccaaggcaggtggctcacctgagttcaggagttcaagaccagcctggccaacatggtgaaactccgtctctactaaaaatacaaaaaattagccaggcatggtggcacgcacctgtagtcccagctactcgggaggctgaggcaggagaatcgcttgaacccaggaggcagaggttggagtgagccaagaaatgcaccgctgcactccagcctgggcaacaagagcgaaactccatctcaaaaaaaaaaaaaaaaagaaacggtgtaaacagtttttaaatttggttttatttaaaggttaggagcagggaaatggctgacttatatcttataataccatcttagggaatattcactcatagttaaagaatatattacaaggggggaaatttatctctctttatttttggccctttatttttttactataatctgggaacaaagattccaattggtaacccaagttggaattccggggcttnnnnnnnnnnnnnnnnnnnntagtaatgattcgggctggtcggtactacctcatgtctagtcgtgcttctggagcatagttgtgtggcgcaggaatatacggagggatagggttgaagtagagacgtagcaaattcccccgggtcgtcatgaggataaacaattatcagcacagtggatggcggcggtcatcggtggtacgacaaaaagagagtgaggcgcgaaagatgcggacagacgggtaaggaagtaatggcattaacaaaaacacgtgcgcatgccgtcaagctggtgcggcaaggagggtaactacctactggaagaaaaaaaagaagaaggggcggtggagacagttttaaattgtggttattttagagtttaggaccagggaaatggctaccttaaatcttataatacgtcgtaggtaatattcactcatagtttaagaatatattccaatgggtaaattatatcttctttttttttgggttttttttttttttttttttttttgagacagagtctcgatctgtcacccaggctggagtgcagtggtgcgattttggctcactgcaacctctgcctcccaggttcaagcaattctcctgccttagcctcctgagtagctgggattacaggcgcccgccaccacacccagctaatttttttgtatttttagtacagacggggtttcaccttgttggtcaggctggtctcaaacccctgacctcgtgatccacccgcctcggcctcccaaagtgctgggattacaggcgtgagccaccgcgcccggccgtcaatatatctccttatgaaatattcagtgatggaaaacagttctgagactatattgcaacatgggaaaaagttaaagattttgttgtaaagaaagaaaaaatgctttacccattctaggtactaaccgttcccctcagtaaacttcctatttcctagagtgatgtctttgttctggtccttttatctggaatacactgatctcctccctgcttaagtgtcactgcagttctgtggctctctctgaaagtctcctgtgtgccactgtttcgtacataacatccatcccaagtggctagcagtgcatcggaaggacttgcgctgctactgtccctgccagagggctgttcacccctccctttggtcaccccactgcccagcatatgccttgtcagttaaaaaaataaaagttttctcaagctctctccctctagtttccccctgcccctgtttggcactatcaggacccacatcatgaccctgccatgtttccactgtccctcatccccccagtgccctcacttccctccttatctaacttaaattccgtgctccatcattacagtcactccccagtcttgtttcctttgtcatactcctttgttaacacctaagccctgattaaatcccagcagccctgattaaatccctgattaaatcccgtgcctctaccctgtaggaggccctgctggcagttcacaccctgaccactaacctcaagtaggcgctcagagctgcccagcagtcatactgcttttccgtgtttcattcattctccccgtctcctgagtgattacatcacattttctcctcttctcactgccctgcattccagctcatgacctgctatctgttcacagataaaactgatgcagcctgggagcttccgcatctacccagctcctggtacctgtacccagtcctgtgtcatctctcttcgaatagatcagctctttgtgctttcatttcttaggtccagttcttgttgtgggcattggatggtttttcctcagatacactgctctagcaagtctgctcctctctcctacatcagcagtttccctctgagtcattcccctcagcttaccaaatgctgttttaaaaaatgtataaatcttaatcccacttccccttccagtattgccatttgtttcctgtagagcaaacctccttggaagagttgtatatactcagcctccaattcttctttacttgaacctactccaccaagactattcttgtcaagacagccagtgacaccagcattgccaaatccagtagctatttttcagtcctcatcttgcttgacctatcagcagttcttgttacaactgacactcccaccttgaaacattttcttctcttagcttccaggataccacattctcctggttttctccctacctcactaaacatttcttctcaattgcctcttgctggtatctcttcaactcttcactctcctaacattggaaggcctgcgtccctaaaccacttctctatctagattgaaaacttcaatgatccacttagccttgtggtttgaagtccatgtatatacactctcttcccactacaatataaagtctgtgagaacagaattttgattttattctctactatgtcccctagtacctggaagagtatgtactcagtaagtgtccaaactatatcagtgacccattttaagtttttatcgggcatatgtgttttgtagctctgtatgtcaccttaagagtggtagtgagttaattgtccttaattttttagaaagcattccaagaaacaaattaggaaagagagaaactgacttgatggtggaggccctgagtcatatcccagctctgaaaatagctatctgtaaccttggccatcttctctggtccttagtttcctcatcagtaaaattaaaacgctgctgagatctacacagctttaaaagttgctggcactactgaatagatacacagaattctaccccaaagccgctatggggtttaatcagattcctttctgtgttctgtgtggtgtccctgttctctggggagctgaggcgaacgcaccgtggcatgaacagtgtaacacattgctcagtgcatctgcgtctccatgagtggagggtgctcatctcactccatgccctcatgtctctaggtccaaaaactgtcttcattgttgtactataatcttatttcatgagtatttgtttgctgtcaaatataataaaaataaattgtgatcaacaagcaactgcttcagtaagtatcaagatactgtatctttgatactgtgcagaaatgacatatcttagctaaaagacaaaaaattctgtctggttgtatattgacttgagaatcctttgtcatcttatacagggacacaaagcaggtctttgtggttttgttaaacttgtgttcttttccctaatagggtgcatctgagaaagacatcgtgcactctggcttggcatacacaatggagcgttctgccagggtatgtgtgcagatgctgtttgccttccagctagtcacatgaagtgcaactcaaccatgctatctcagccgccagactgtatgtgctgatagaaaacatcaatctgttcaatggtcctcatttgtgtgtagcaaaacacatgttttttcagtctcagatgataagcaattttttagagtcttcaaatatgtttttgaggctttggaaagaaataataaggctgatttaggaggtaatgatgttggcagctagcccagtatggagtagttagccaaactggattgtagctccatgtgccactatgttatagctacgggagtctaccttactatagaatttggtataagcaaaagttattttgactgcttgatccctactttaaggcctcaaccacagtttgagtccagttttcctaatttcttcttgggttcagattctatctgcttggatttatgatgaaatagcataagcagatattggtgaagaaggtggtgcttcttagggctgttgtttttcttgttaatttttgatcgagatagggtgtatgtggtataaattcatcctttcaaagtattaaattcggcatcctttattatatatttgagccatcaccactttataattctagaacattttcatcactcccttttttttttttttttttttttttttgagacggagttttgccctgttgcccaggctagagtgcagtggcgcactttcagctcactgtaacctccacctcccaagttcaagcaattcttgtcccttagcctcccgagtagctgggattacaggcatgagccaccatgcccaactaatttttgattttgttttcattttgtttagttttttgagatggagtttcgctctgtcacccagctggagtgcaatggtgcaatctctgctcactgcaaccaccgcctcctggcttcaagcaattctccttcctcagtctcccgagtagccgggattacaggcgcccacccccacacccggttaattttttgtatttttaatagagatggggtttcaccatattggtcaggctggtctcgaactcctgacctcaagtgatccacctgcctcagcctcccaaagtgctgggattacaggtgtgagcaaccgcacccctgcctaatttttgtatttttagtagagacagggttttaccatgttggcaagtccggtcttgaactcctgagctcaagtgatctgcctacgtcggcctcccaaagtgctgggattacaggcgtgagccaccgcacccagccaccccattgttaagtccagagaattaggccctcctgcctagaggttctgctgctagagtagtttgtctttggctgcccaagtcctgccttgaaacaatgagagggtaacttggaccaggcctgtctgggccttgtgtgtttatggcctggccacttgagtcaggatcatcttcactgcattttctctttcatttcagcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttacgtttcttttctgtgtttttacatgtggtagtttctcttttcataagttataatactgcaattggatttctgaaatgtttatagcgaccacctgtataacatttccttccactttattgtgagctgcccagattttattcttgaattgttttttttttttttgttcggtgctttacacgttcagagaaacttcccgagtaacgaactatagaaatgatccctgaaagcatagtctttattctcgaattattttgtattttattaaataatatgaacagctgttcttgagaaagaggctctaatgttgaaagctgatagtgaagtaacttttagtgccgtttttcactaaaggggatttaatgtggaataatttagccacagaatgtaacaactattgaagagagaatactaactgtaatcagaactggattctagacttgattccaccagttacttaactgccagtgtgaagcctggctttcatttggtctttgtccgtatgtcacagttctgcctctgcatgctcctggcatagggtcagtcagataaacaggcccccagtatatgggcatagtgagcccttccccagcatggtggtgtctatctgcactctaggtgggctactaaaatgtgtaagggggaaagtgatacaaaaaccagttccagaatgttagaataatggtggggcagcagatttaagtcatgtgaatgtgggataagtcttagtggtggcctttgactatatattggaaatactgatttttttttggttggggggttggtttttgttttttgagacagtgtcttgctctgtcacccaggctggagtgcggtggtgcaatcacggctcactgcatcctctacctcctgggatcaagcagttactctacctcagcctcctgagtagctaggaccacatgtatgggtacgacacctggctaattgtttttatttttttgtagacacgaggtctccctatgttgcccaggctggtctcacactcctggactcaagtgatccttccaccttggcctcccaaagtactaggattacaggcatgagccaccatgcctggccaatggtaattttttaaagattaatgttgaggagtattgttgatagtaatattagaaaactaaattgcctgtgctagctatataaagatgagagcactagtgtcagtaattttggctcctgaaggttttagtttttaaaaatctggtcaattactctttttaccttgacagaaattttcttttttttttttttttttttttttttttgagacggagtctcgctctgtccccaaggctggagtgcagtagcgtgatctcggctcactgtaaccccccgccccctgggttcaagcaattctgctgccttagccttcctagcagctgggactacagatgcgtgccagcacgcccagctaattttctcgtattttgattagagatggagtttcaccatattggccaggctggtctcaaactcctgacctcatgatccacccaccttggcctcccaaagtgctgggattataggggtgagccactgtgcctgacctattttcaattatttttaaaactcacacacgatactcaagttacttgcttctgaaatagccatagatgacttatatagcacctgaagaagacttaactggtgctttatgagcctctacaccagtgtattctaatatccctgattaaggagatgagaagtaaaggcatgaattttcagtgcttttggcaccctaactagtaggattggtcattccttttttctatattttttctcttttcctttttttttttttttttactccatgactagccaaagagctgatttacttttttaaaaacgcttggcatggctgagcacggaggctcacgcctgtaatctcagcactttgggacgcccaggcaggcggatcacaaggtcaggagatggagaccatcctggctaacatggtgaaattccatctctactaaaa

SEQ ID NO: 13494 - DNA, 46816 bp, Human; identical to SEQ ID NO: 13493
  misc_feature (1)...(46816): n = A,T,C or G

SEQ ID NO: 13495 - DNA, 52655 bp, Human
  misc_feature (1)...(52655): n = A,T,C or G
tgttgccctcccaacagtaattttattttttatagagatgaggccttgctatgttgcccaggctagtgttgaactcctggcctcaagtgatcctcctgctttagcctcccaatatgctgggagtacaggcatgaaacaccatgcctggctgctttttcctacattttgaattgttgccttcatctttctcacacagtgtttttgctcagctcttgccatcctatgtcttacatagcttattagcctaaacacccatccattttctttgtccacagtgtcagggtcttatgaaattcatcctcccttaagactgagattctgatgttggttactatctcaactctatttttgtagtgatgttccccttagaggccgcggtgtcttctccagctaactgtccttatttggggtaccttagtctaaccgccatgttcaaagacatatttgaaattcaggtttaaatcctttttccccctggaaactcctcagcagatgcagttatacccatcctctttcttctcagccactttcaagttaagcatgtagaccaagcttgtccaagccgcggcccagaacagctttgcatgcggcccaacacacatttgtaaacttctaaaacacatgaggttttttttttttttgcgatttttttttttaagtcatcagctattgttactgttagtgtactttatgtgtggcccaagacaattcctcttctaccaatgtgccccagggaagccaaaagattggatacccttgatgtagacaaaaaaagcaaaataaaataaaaaaagcaaagcaacaacaatagcaacaaaaagttgactgggcgcggtggcctgtgatcccaacacttcgggaggctgaggcgggcagatcacttgaggtcacgagttcgagaccagcctgaccatcatggtgaaaccccgactctactaaaaatacaaaaattagccgggcgtggtggcgcatgcctgtaatcccagctactcgggatgaggcacgagaatcccttgaaccctggaggcggaggctgcagtgagccgagatcgcgccactgcactccagcccgggcgacagagcgaggctccgtcttttaaaaaaataaaagaataagtaaataagtttaaaaggtcttttacttcagtccagttggtaactaaaaaataataatacattttttttacatccttcttccataatattgtgtagcctcttacatctacggaatcaaaagggatccttcccaaggttcattctagcaaaggaaaacgtttctttccaccatacaccctgcgacacgtgtcttaatccactcctgctcaactggctcccagtggatccctagggatttttttttttggagccaacgtgggtcagaaaaaggaagagggtgggtcagccacaggttttcagcggactgggctggcggtcgcaaattccccttacttccccacgtaggtaaaagctaacgctgcggcgaggcagccgcggtcggggcgtctccgctgaaggcgcccgggcctcctgcacgttggctgcccgggtgcgggggtgcgggctgcggtaggcgcggaggtgcagcggtaggacctccgcgcacaggcccgcctgggcggacacagcccgagttggacacgggagcagccgggcagcgcgtcttgacggaccggcgagcacttgggccggttcacatccgtatcccacttcaaggagacgtcttcgctgcatcctccggttccgggtggaggctgaccctgggccattccgtctccggtctctggtatttctgctgggtcacttcatcccgggggcctctgaggaggcggaactactgtgtcaggagtcgtggttttcaaggagaagtcgtggtcggattgacagaggtaggggaagtaggcggaacttccggctggctcttccatcagctgccttccccgggcgtctccccgcaacctcctcaacttccctagtcagtgacgcggcgccggccagaaatccgaccggaccgggctcgggggagcgtgagttgcaggtgtgtgcctatctttgcgtctctgtttgagaggacaaactgtggggctgggaccgcgaggtgactgtgactgaggaagagtggtaagtgacagcgagggcagtgggagccaggggctgggaggctactgtgaccgagggccagtgacagcgaggggactgtgacccaggagcagtgaatgcgaaacacggtgacctcggagagcgcgaggccggggctgcgacggcacttggaccgaggaagtatgaggcagtgactgcaagggactatgatcaaggggcaaggactccaaggagactctgatcgattggtagtgactgtgggggatccggacctaagggaacacgagcagcggccgcgaggggactccgacccagagcagtgacttcgaggggctgacttggagaagaggatggcatccgtgatgggcgatggcgctgtagggttgtgtttgggcacggggtgtgattggccgtgactgggcagagaaggtctttagtggaaagaacactggtctggaacttaacaggcctgagtttaatttttacggacaaacttcaccactgagttacagtttcttcatcagtgaatgggaagtttggactagtttaatgcctcccacactatgggtttcttcctagtattgagctgtgaaaccaatttagtggatggaacctgtactttttttctttttctttttttgagacagtttcgctcttgttgcccaggctggagcgcagtggcgcgatctcagctcaccgcaacctccgcctccctggttcaagcgattctcttgtctcagcctccctagtagctgggattacaggcatgcgccaccacgcccggctaatttttgtatttttagtagagatggggattctccatgttggccaggctggtcttgaactgctgacctcaggtgatccacccgcctaggcctcccaaaatgctgggattacagtgtgagccaccgcgcctggcctgaacctgtacttttcttttaaaaagtggaatagaatagaaactttcagtgtgtttacatagtaagggtaagtattgtttcatgtgatttgtttgagttatgtgtgtatgagattatgatgtaaaatagattttgtacatctcaaagtgtaagaagcaaaatgtactttaaaagtttgaaaaacattggaccggatgatttctgagttttcttttggttctaaaatgtaatgattctatgaatagggaactctttggaagtacaaagatgcaattgggaacaggctgtattagcctggcctaactggaggaggcttcctgaatgtaattgaggtgactagctgtgagagctgaaactcggcatctcagttgggagaaccagaaattatattgaaatagggacactgggcgggtgtggtggcgcatgcctggaatcccagctactggggaggctgaggtgggaggattgcttgaacccaggaggcggtggttgcagtgagttgagattgtgagactgcactccagcccgggtgacagagggagactctgtctcaaaaaaaaaaaaaaaaaaagggacagtggtatttgtgatatttatagaggcagtgaggatttaggggtttgtggtatgagaaactgctcatgaggaacgggaagctttgagcgtaggaacaagggttgggaaggaaactcaagataggggcagaaaataatctgccaacaataaaatggaagtaggaaggcagatatgacctccagagcctatttatcttgatatttagtgatttggcaagtacagagaattgctagtaaaaagacattgagaatgggatttagtgcagtaatagcagtaaactatgaccatgatgagaaagaaagggggacaaaatgatgacactcgcagtgtcaataatggtgattgggatgccacatgggagagacttcaatgtacttagctctctaattcaatgatttgtacactgaggccaagcctggcatgctaggaatgataccacactatgggtaatgtaaatgaagctttagctgctgactttatttcctacacattccctttctttagggctgtgagtgatgtagatgaaattaaagtgaatgttactacttccttctctcttacagccctttttattttatttatttatttatttatttttgagacagagtctcactctgttgcccaggctggagtgtgctggcacgatcccagctcgctgcaacctccgcctcctggttcaaagcgattctcctacctcagcctcctgaatagctgggactacaggcatgtgccaccatgcctggctaatttttgtatttttagtagagacagggtttcaccacgttggccaggctggtctcaaacttccgagcttaggtgatctactaacctcagcctcccaaagtgctgggattacaggtgtgaccaccacgcctggccttacagctctttttagaaggtgctattgattgtgccaccagtgctttttataataggagaagtatgaggtcatttaatttatcgtacagtgtattaatctgataaccactcctgccccctacactctgtaataggggaatagagttcagataggttcttgaatgggaatgagttgagaatggtgggggatagccttttcttggctaaataaattggttagttacacctttttctagcacattagatgtttacttgacttacattctacatagctaaaaggaactacccaggggtttcttctagaacagcatctatgcttcaaggtaacagactgtggaagaggcttgggattcagcagtactccctctagggtcttttttctttgctgaatgaaatgaatctttttgtaggacaaaagatttgctttgcaaattccctttgaaaactagcatgatggcctggttgataaagaatgagcttcattccccctcagtctatgactctcctcccataagcagtggggttttattttccctggggacctgctttttggatatgtgatcccttaagaagaatgacctcgtcagatagagcctggacttagcagtccctggtgactttctccgatgttaacatttactcgccctgtgactatgtatggaaagcattattgctttctcttgttgtagattttctaaccatggccagaggtaactcttcttatgattaaacagccctttaataatctgaaatatatgtgaacttaccaaattttgtatgtaatttcatagagtttgtaaaccatctgactccatttataattcagagctgtctggcctttaagttagacagtatttccctagggagctgaataacctctcctagagatgttataagtgctgatgagaattagtttttgaaatgctcaaataaaaagcataattttccattgttattaatgatggataatagcaaaatatctgctaataatagtagagttcttacttaagcatcatgcttttctaagtatttacataactgatctgaagcagaccttctgatttttctactaatagaaatttccctttctgaatcaagcagaaataggtctcccttacatcaaagtttgtgttaccttgaaatagattggaaagaatacatttttgtaaaagtcatttttttcttggatttgtttccagttggagaaaccctaaagtcagggcacttgccaattatcacaggactgtgagagtcccttttttgctcaagattgtggctggctgcttgtacatctttgacattatcacacatcaagcatattagaaaaaggggtgacttgggagagtgaggggatcagcactttaggccttgtcaaccctcctgcttatctgcttggcagcttctggcatctccttttccctaagtccttgaacctctttcctaagcgtaaacctttctgtttttagtcctaaacctctcttttcacagtattcctgtcaaatgagtacttaaacacatgtttcatctgtgatttgttttgttaattgctttgtggattatttgtggcagaatttaaatcctaattcctttctacaatttagccagtaaattcaaggaatgtacctttttacgtttgcagcatgtgccgaagcgccacctcagaagataaaaagaaatgagtctcatatttggcattcttttaggtttgttacctaccttattcattaatgtaaataattgaattacctgtattttaccattcgtaaaccaggttaatagatatatattaatagcaggctttctgtgtgtgtcttttccctcctttctttctatttatttatttatttattttttgagaccaagtcttgccttgttgcccaggctagaatgcagtggtgcaatcttagctcactgcaaactctgcctcctgggttcaagcgatctcctgcctcagctgggattacaggtgcccgccaccacgcccagctaatttttgtattttagtagagacggggtttcatcatgtgggccaggctggtcttaaactccagacctcaagtgatccatccgcctcggcctcccaaagtgttgggattacaggcgtgagccactgtgccttgccccttgctttcttttgggaattctcttgtaccacaagttgaaagttatattagtttgaggctttctatgtttggactaggatgactgccagtgagccaggggaacccatgaatctgctaggctgttatatcacattcacaactacttgcaaaccagttttgaagtgaaggctgccaaaaataatgacatatggtccctgctctatagaaaatgagcatatgacccttaataaaaaacaggtagtttttttatatacagaaaattaccctaaatgtgattatgtttctttattttttgaccgtagaacaggaatcttaatcttttttgtgttatggactcctttggcagtgtggtgaaagcttttagagttcctttttggaatatgtttttatatgcaaaaataaaatacatagaactataaagaaaaccagttatattgaattatattgatatatagttatcaaaatttaagaagtatgatatggtatgaaaatatccatgatttctactggtaacaaatccatttgtctaataagtctgctattactgctgtagcttatgttcatcactgaagtgaaaataaagatacagtctttttcatccaaattcacagacttcctgaattctatcatagaccctgcctcagagatatgagttccataacccactctaggaagatcacattctaaacacaagagtttactcaccaaatattctggtagaatagtggcagagtaaaattgttcaactgtaagaactattacatgtgtccctcatggttttttctttcctgaaatattctactacatgtccaggccgaagaagtataagctttattatgtgtgccagtggctaacccagggtctggcacagagtaagtgccgctcagtgtttgttgaataagggtttctctgacgaaattagagggaagagatccagttcaaagctaaggtcttaaatgtgacagtttatagggctcatgacaagtaacgttgaactttagtttagaactaatctgtcagagaagctcatgttttgaaattcacttttacatttataagttctcagcctggtgtgatagttcatacctataatcccagcactttgggaggctgaggtgggaggattgcttgaggccaggagtttgagaccaacctgggcagcaaagtgagacccccatctctacaaaaaattagctgggtgtagtggcatgtgcctgtagtcctagctacttgggagggtgaggcaggaggatcacttaagcccagcagttcgaggctgcagtgagccatgattgcaccactgtactcgaaataattctatttctaacactgtttttcactttagattgggtaaatttaggtagaatttgccaccaaattattaataaagctggtcctgatttcatctaggatgagaggtagcaaactttttcagtaacgggccagattgtaaatagtttagggtttgcaggtcacacagtatctgtgactactcagctctgctgttgtagcacaaaagcagccatggacaataaacacatcagtgagtgaacatggctgtgttctgatcgaattttaattacaaaaacaggtagtgggccatctttggccagctagctgtagtttgctgacccctgatctagattttctggttcttgagtccagctcttttccctactttcgcttagccatatactccttcaagcttcaaaggcctttacatagggggcaatgtccttacactgttatctccagaaagacctgagtgtacagcaagatgataggattaatgaatgccaggaatattagatgcactttaacccttgagtttccagagcttgcctcttagagcaccagctcattaagcaccaccacggtagaagcagagaaacatcccaaatgtaaagtctgcttgcgcactcggctttggaactgggcattgatatgctgatagaaaaatactgggcattgggttttagtggggaagataatgtaggcctagagatggggaaggcaggaatagagtgcaaaggaaaaattatgcctcatctttttgcaaatagttccttgtagtaattggtcaagtttgagttagatttttgaaatgtggaatagcatatgtaattgcaacttgctactacaagagctcacccttagtcgcagttttactttccgtggtttcagttacccacagtcagccacggtcagaaaataggtgagtatgatgtagtaagatattttgagagtgagagagaacagccacattcagataacatttattacagtatattgttataattgttttattattagttattcctgttaatctcttactgtgcttaatttataaataaaactttatcatagctctgtgtatatagggagaaaacaaagtagagtcagcccttcgtggccatgggctccacatccgcagattcagccaaacttggatcgaaaatattcagaaaaaaaaaaaaaaaaaaacaataaaaataccaatacaacaataaaaaacagtacaaataaaaaaccaatattgtataataactggttacatagtatttacattgtattaggtgttgtaagtaatgtagagaagattgaaagtatatagggggtatagattatatgcaaattcgacaccgttttatatatataagggacttttgagcatctgtggattttggcatctgcaggagatcctggaaccagtgccctgcagattctgagggacaactgtccatatagggtccatactctctaggggttcaggcatctgctggcgtcttgaaacatttcccctgtggataagagaggactctgctatatttagattgttacatagttcaggaagcaaagtccaactcctctttcccttggtaggtctgtttgcaataaggaagttgaatagaaaggattggataggccgggtgcggtggctcacgcctgtaatcccagcactttgggagactgaggcgggcagatcacctgaggtcaggagttcaagaccagcctcaacatggagaaaccccatctctactaaaaatacaaaattagccaggcgtggtggtgcatgcctgtaatcccagctactcgggaggctgaggcaggagaattgcttgaacccgggaggtggaggttgtggtgagctgagatcgtgccattgtactccagcctgggcaacaggagtgaaactctgtctcaaaaaaaaaaaaaaaaaaaaaaaaagaaaggactggataggagtccctaaaactacttgtaggagcctatcatctttcagactcaagcatagacatgccagcacctagattctgtctccttcaggacattcacattggaaaaatatgactagctgtatccttagtgtctcctcagtgccacccctccctccacaaacacatcttccacttgtctagcaaagctgatgtgcctcagcaggcatgtgttggaacgtggaggaacaaggcaagcagtgtgtactggtaggtgagtcagcagaaaccaaaccaggtctttgtgagtcggagtaaaaatcacaggcacagatactgcattctgtatttcgagggcactttggagacactaatgtacttagcaggcagggtgttgggggatgggtttttatgtccatatttagagtctgtgctcaaatttcagtgattaagataaggtgacttatctagggagtgaataggcagcagttggaaagatcaggtcttaacaattgctgtattctggctgtcagccctttttttttttttttttgatagagtttcactcttgtcacccaggttggagtgcagtggtatgatcatggctcactgcagcctccgtctcttgggttcaaatgattctcctgcctcagtctcctgggtagctgggattacaggcacctgccaccacgcccagcttatttttgtagttttagtagagaccgggcttcaccatgttggccaggctggtctcgaactcctgacctcaggtgatcctcccgccttggcctctcaaagtgttgggattacaagtgtgagccaccacacctggcctagctttttttttttttttttttttgagatgaggtcttgctctgtcacccaggcgggagtacagtggaacgatcttggctcactgcaacctctgcatcctgggttcaagcgattctgccaccacagactcccaagtagctgggactacaagcatgtgccaccactcctggctaattatttgtctttttagtagagatggggtttcgccatgttggccaggctggtcttgaactcctgggctcaagcaatccatccgccttggtctcccaaagtgctgggattataggcatgagccactgtactgggctgttatagcctttttgacaaagaaagtgttctggaggatgaaccactaaacaaacaggaagtgttggcccatcctagtagggctcttgagggaggttctctattctatctccaaatacttttcttcctgtctcattcctaagggtcagtctgcagggcattgagtaatgcactgccccatgttcgcctcctactgtattggctctgaggaggcgcgatcatttcccagtcccattgcccgctggacaaacagggatattaaggcagcctgtgtgtgtgcgtgtattttttttcccctttgaatgtagatatttaaagccacctccttttccagagccatcactgtaccttacttgaatggtattggttgatgacagaggcgcacttatcataaactgagagtccaagaaatattgttcctcattgttggaggtattccaaatggttactgggcagttatcgatgttgtaatggtggtgtggctttaggtacacctaagtttcagtgtaacaaattaagaagccaacacgatgttaggatgtatttactgtcttcagtacgccctcatcctcccacacaccttttctctacactttctcagtagcaaaggtgatgtgtccgggcaagcatctattggaacatgagggagactgggggtacctttttccatgattttaaacatcagttattattctgtatgctttggtgctgcggttataagttagtagatgtgagagaacattgggatggcataagaaggccgggaaaaaatgaaaaaaacttgtgagacctacagagtaaaagtttattattgttattattattttgagacaaagtctcgctctgtcgcccaggctggagcgcagtggcgtgcgatttaggctcactgcaacctccacctccagggatcaagtgatcctcctgccttagcctcccaagtagctgggattacaggtgcatgccaccacgctcagctaatttttgtatttttagtagagatggggtttcaccatgttggccaggctggttgcgaactcctgacctcatgtgatccacccaccttggtctcccaaagtgctgggattacaggcatgagccaccgcgcccagcccagagtaaaagtttaaacagcagtagttctagaggaaagtcatgaggagtaatctttgcataatttctaaattcttttagggttatcattatggaatatctgtgacccagatgttttccatctcctgagaagtggatgagataaagaagtgtcttacactaaaacccaaaaagcagtgggtgtgttttattttaaatccgaaggatctaaagacttcagtttaaagaacagtgtagaatataatgtaaaacccaaaagtcatctttagaaaatagaagaactgtatgtaagcagataaggaatagtataaacacataatagtgtaagcaggtaaagaaaaaaatatatatatttttttgaaatggagtctcactcttgtcacccaggctggagtgcaatggcatgatcttggctcactgcaacctctgcctcctgggtttaagcaattctcctgcctcagcctcccaagtagctgggattacaggtgcccgccaccacacctggctaatttttatatttttagtagaaacggggtttcaccatgttggccaggctggtcttgaactccagacctcaggtgattcgcctgccttggcctctcaaagtgccaggattacaggcatgaaccactgcatgtggccttttttttttttgagaaagggtctcactttgctgtccaggctggagtgtagtggcatgatcatggctcagtgcagccttgacttgctgttctcaagtagtcctcccacctcggcctcccgagtagctgggactacaggcatgtgccactacacctggtcaatttttcgtaactgcaaatatcctattcctcagcaaactttcaccccatggttttagaatcctgtagagcatttttatatcataagcatttttgaggtggagctctgtgtgtgttttccatgccttaattgaagcttccttgagaaaatagtttgtacttaatttttttttttttttcattttttgagacggagtctcactctgttgcccaggctggagtgcagtggtgcgatctcggctgactgcaacctttgcctcccagattcaagtgatcctcccgcctcagtctcctgagtagctgggattacaggaatgcaccaccaagtctggctaatttttgtatttttgtagagatggagtttcaccatgttgcacaggctggtctcaaactcctgacctgaggtgagctgcccacctcagcctcccaaagtgctgggattgcaggcgtgagccattgtgcctggcctttaattttttaaattgataaataatagttgtttatatttatgggatacaatgtgatacttcgatatatgtttacatgtggaatgattaaatcaagctaattaacaaattccttgccttatatacttatttttttgtggtgaaaacatttaaaatctactcttttagcaattttgaaatataaaatgcattattatttattttgttttggttttttttttttttggagacggagtctcactctggcgcccagactggagtgcagtggcacgatctcggctcactgcaagctctgcctcccgggttcacaccattctcctgcctcagcctccccagcagctgggactacaggtgcccgccaccacgcctggctaattttttgtatttttagtagagacagggtttcactgtgttagccaggatgttctcaatctcctgaccttgtgatccgcctgccttggcgtcccaaagtgctgggattacaggtgtgagccaccgtgcctggctgcattattatttattatagtcaccattctgtgcaatagatcactaaagcttatttctccattctttttttttttcttttttgttgagacagagtcttactctgttgccaggctggagtgcagtggtgcgatctcagctcactgcaacctctgtctcctgggttcaagggattcttctgcctcagcctcccgagtagctgggattacagatatgcgccaccacacccagctattttttgtacttttagtagagatggggtttcaccatgttggccaggatggtctcgatctcttgacctcgtgatccacccgcctcagcctcccaaaggctgagattacaggcgtgagccactgtgcccagcctgtttctcctttcaaaactgaatttttgtactcgacatctccctttttgctctccaccctcttctgtccatctcttgtaaccaccattccattctgtacttctgtgagttccactcttttagattccacaaataagtgaggtcatttgtggtatttgtctttctcgtctggcttatttcacttagcataatgtcctccaggttcagtttgtacttaaaaattatgatacagtactttgtaagcagtaagtactcatatttttgactgcctgatattattgacttgccagatgccaaattgctgattatatttctcatagtggattttgtctctctacacttagaagaattgagcagatacttacagaagagtactgtgcaaattagaaaacaatcattaattggatggattaggcattttgagtagttcactcagaccactgagatgagagtattgacctctgaatattatgaaggaatcattaagaacaatagtgaagacaagctctgatcatcatcactgaaagaactcggagtgaaatgtatagaacccttcttccattttaatttgcatttgtgatgaaaggaagtttctaggtggtgctcatctttcactttcgactctgacattttttcatgttggccatgactcatggggtgtcaccttcagcttctaagaattaggccagtttcttgtagatcttgtcatattgccactcggagttgagccggaggaaagaaagtaaggcacagttgcagttgtttagacgaacatctcagtcaggcttatgagaggcagtagggcagagcagactgtcctcattctgtctggcattggttttccacctgttctgaagatttttctctgaaccgtatcttgtgcagagatgacagtttatcatagagtttcccctacccccaatttctggctgattcctaaaatttcatcagtatcaagaaagtaatttatttgtacaaattgtgttacttaagaaaaacgcaactatccctgcagggggctgaaaagccaacatctaaatgatggcagcggtggcctgtctggatgggctgctgccatgatgccggctgcagtcggggaggcatggtctgtgctgcacgctccatggagccactgggagctgggagtaggtggaagccctgcccgtttccaagttggcagggcgggagcagccgtggctacatacccgggcttccctgtgcttttgggggcccaggaacctcccctgcccctgcaggcttgaagtgcctgctcccactgcctggcctctccttgctcctggtgcctgctctgattttggagcaaagttgaggccaagcctgggcactgtcatgacctggctgggtttgcgtgtgctaggggcagtgctgacatgccagcccccttctgccttggccccctctggattttgggtgtccagcagcacaggaggggacgccaaggcggagctgagagcagctccattcaggcctgcaggcgccccttcgtgaatagcctgggcgctgtggacagcaggttgatgacagcaggaggcagacaggctcctaggcggaaatgggcgggtccctggtgaagccccaccttcaagccagggatggcctgaagcctggggcccaggctgccagttctgtggactggaatgagaacttacgatgctttttccgggctgcctgtggctgcccatggaccaatcagcatgcacttcctgcccgctgaagcccgtagaaaccctggactcagccatacttgatgggatgacctgcctgcggataggagcttcccactccaggtctcctctccactgagggctgcagagacgtcaggatgacctgcctgcagataggagctatccactctgggtctcctctccgctgagggctgcacagatgctgggacgacctgctgcggaaaggagctacccgcttggggtctcctgagggctgttgtgttgctcaataaagcacctcttcaccttgctcgtcctccagttgtccatatacctcattcttcctggacgtgggacaagaactcgggatctgccaaatggtgggactgaaagagctgaaacacaaacagagccgaaacacgtcctcccctcccccactgcttgccacgctgtgggcaacagaaagagagaagagaggagagagaaagagaagagctgtagccctttgggaagcccagacctaggagctccttgagccagggctgtgacaccctctttggagctctgtggttcctggcctctccaagcttctgggcagcaccatgttccccagtgcctgcagtggaagctgcttgtagtacgcctggttcagctgcagcctctcagggagctggcgcctcgagctgctcaccccctggcagctggcgtgcctggctgtgcgcagtggccggaccctgtgctggctcgcctgtgcacctcttgccgctccgtgcctggcttgtccttggcatgcatggaatctgtgctggtaacacaagctgagcatagcctaccaggctgagtggacggaacgagcccggcgggcctgagcaaaactcaggcaaaggtgccactggccacagaggtttctggctagcgaagtgacaccccaagtattctgtgacttaaacatgaaatacagaatattcagaactttgctgtaatagctagttgctagaaactctctgctaaatgagacaataataaataagttcctttgggggaaggagaatccctgagggggttttaatagctggaaactgtgaacaagcttgaggtgttaagaccctgaaagaggaaagggaaatgagtactgagaaaagaaggggaagggccaggtgcagtggttcacacctgtaattccagcactttgggaggtcgaggtgggtggatcacctgaggtcaggagttcaagaccagcctggccaacatgacaaaaccctgtctctactaaaaatacaaaaattggctaggcgccatggctcacgcctgtaatttcagcacttttggaggacgaggcaggtggatcacgaggtcaggtgttcgagaccagcctggccaacatagggaaaccctgtctctactaaaaatacaaaaaattagccaggcgtggtggtgggtgcctgtaatcccacctactcaggaggctgaggcaggagaatcgcttgaacctgggaggcggaggttgtagtgagccgagatggtgccactgcactctagccagggtgacggagtgagactctttctcaaaaaaaaaaaaaaggaaagaaggagaaggacatttaaaaaatacattatgctggtcctagctattctggaggctcagatgggaggattgcttaagctcaggagtttgaggctacagtgtgctatgattatggctgtgagagccgagatcgtgccactgcactctagccagggtgacagagtgagactctttctcaaaaaaaaaaaaaggaaagaaggagaaggacatttaaaaaatacattatgctggtcctagctattctggaggctcagatgggaggattgcttaagctcaggagtttgaggctacagtgtgctatgattatggctgtgagtagccactgcgctccagcctggacaacctagcaagacccctaaaaaaataaaaacaataaaaaagtaaataaaaaccattatgctactccacaattttcatgcaagtaactctggtgaagtggtcactgaaatctatagaacttttagagttaagaaattcactcagtgatgtggttcatgcctgtcatcccaagtctttgggagtttgagttgggaggatcacttgaggccaggaattcaagaccagcctgggcaacatagcgaggcctgtctcttaaaaaaaaaaataactaggtgtggtggcatgtgcctgtagtcccaactacttgggaggctggggcaagaggatcgcttgagctaacgaggttgaagctgcagtgaggcaagatcataccactgcaccccagcctgggcaacagagtgagaccccgtcttaaaaaaaattagagttaagaaatccgtgttttgttaatccaggacttggtgagagccatccgtttacaaaaggctcttttctctacctgcaccagtcataccttcacattgccttatacctgtcatatcgatgatgcggaggatagtgggagagtctgtgtaactatctttctcagccaaattattccaatcttttgcatgcaatcaggatttaaaatgagcagttagtatgtaggctgcactgtgagggggaatgacttccgacttcaggcaattcactgtggccattgttgcacagagaggcgtttcagtatttctactagagcctgtgttttgtgaagcttcgctggttttgccagatgccattggctcatcttggtgaagtgcagctgtagaattggtattttgctgagtgtatccacgtcaacgtctctgaaatactggtgacaaactttttcccaccccaatgagaaaatttttgttttcactttctatgaccagttaaaagaagatggatgcacagtgttcagccaaggtcaatgcaaggaagaggagaaaagaggcgcccggacccaacggggcaacagaagaagatggggttccttccaaagtgcagcgctgtgcagtggtaagtggagattaacctggcagggggagggtagaaaccgatatgacattgatgatatcagtgttacatgtcttctgaaataatgaaaagaaggaatagtaagtgtattttcacagtcactggaaatctgctgcctttttactggattatgactcacagctcagttgtagaagctttacattgggtttagaaaaagaagtgttaggaaaatatggaagttgcatgtgtattaggctgaaactattgaaatatggccaggtgcggtgactcatacctgtaatcccacactttgggaggctgaggtgggaggatcacctgaggtcaggagtttgagaccagcctggtgaaaccctgtctttactaaaaatacaaaattagccgggcgtggtggcgcatgcctgtaatctcagctgcttgggaggctgaggcatgagaattgcttgaactcgggaggcggaggatgcggtgagccgagattgcaccattgcattccagcctgggcaacagagacagaccctatctcaaaaataaaaataaaaagtaaataaacaaataaataaaactaatgaaatagaaaaattggggctctaggcagtgatttgatcttcgtatcatctcatggtgtctagtgcgtcttttctgctgttttttctccctctatcattcctccatcctgttactagttgtatcttagatgagaacctttttccgtttatgcctaccttatgctcctttatctctggaaaattatctttgtatttcctaattattgccaaaccttagatgaaagaccccattccacactgcctatcccatctcagcttgctacccttcctaaagctttcctccacactgcctatcctgtctcagcttgctacccttcctaaaactttccataataaaaacatgtcagagaacacttacacacaattgaagctactgttgttaatattattatgaaatctgtgtttcaaaatcccagtgacagaattgtatgtttctttacctatattgactattagccattgatcaaactcagtttccactgcttagttctagagcttcccagcccaaagggaaaaatctattctgaaacagttaatacttattccaaatgaatgctctgtcttgagcaataaaagcaaataataccctacaaatagacaagtgcctgcagggctgatattgatcataagggcaagtatatatatttgtttcctgttgcatttgtaacaaattaccataatacaaatatacaaatgaattatcttacagttctggatatcagaaatctgaaatgggtctcagagggctaaaatcagggtgttggcagagctggagggtccaggggaaagtccatcttcttgccttttccagcttctagagggttcccacattgcttagtgcttggcaccagccagtgctcacatcactctgacgattgcttctgccatgtctcctgctctgattctgaacctcctacttccccttttcacttacaaggactcttgtgattacgttcggtatacccagataaaccagaataatcttcctttatttaatcatatctgcaaagcctctttactatttttatttttatttatttttatttgtatttttgagacagagtctcgctttgtcacccaggctggagtgcagtggtgcggtcccggttcactgcaacgtctgcctcttgggttcaagtgatttccctgcctcagcctcccaagtggctgggattgcaggtgcccaccaccatgcctggcttactatttttatttttatttttatttttagagtaagggtcttgctatgttgcccaggctggtcttgaactcctgagctcaagtagtcttcctatctcggcctcccagagtgctaggattaccaggcgtgagccactgtgcctggcctgcagagtctcttttgccatgtatggtaaaacagtcacaggctccagggaatgggtgtggccatctgcaggggggcattattctgcatactacagcaaataagctcagaaagtgactcagcaatcaacaaaacagggcattgttagtttctgaatatttcttagataattcagattaaagaaatggtggtgtgtaccaattcagcaacatcacttggagtaggaacaagttataaccaaataggtgatactgtcagctaatcagccaatcactgtagctaggaataaagcaaaggaagccagtcttttcagtggaatgagctctgagaaaacttaaatttcttggtctttagactctgggaatcttttttttttttaaattcttctggggagtcttaatgctttaaattactttgcttcatatattcatgtgaaatcagttcagtgacttgctgctacctattccacattcctccctgaaacacacagactatttggcataggtgaatggtcagagatccacccaacagcctggcccaccttagtgaggaggaatgtctgctagtaaactttctgccatctcactgtacacctgtactttctagctctgaatctcctttgaactctataacaaaagcaagcaagacttttttctttttttaacagctttattgagttataattgacatatcatttacagtatacaattcagtggttttcagtttattcacagagttgtgcaaccatcaccatgaccaattttagaatttttttctttttttttttgagacagggtcttggtctgttacccaggctgcagtgcagtggtgtgatcatagttcactgcagcctcaactttctgggctcaaacagtcctctcacctcagcctcccaagtagctgggaatataggtgcacatcaccatgcttggctaatttttaaatttgtttttgtagggatggggtctcactatgttacccagactggtctcagtctcctggatcaagcgattctcctgcctcagcctgccacagtgtgggattacaggtgtgagccaccatgcctggcctgggatatttttatcaccccagaaagaaggcctgtactcattagcagtcactccccatttccccccagtctctccagcctctggaagccactaatctgctttctgattctgtggatttgcctgttctggacattcatacaaatgacatcatacggtatgtggtctttggggctggcttctttcactgagcttgttttgaagattcattcgtactgcaacatgtacaagtacttaattttttttttttttttttttgagactgagtctcgctctgtcgcccaagctggagtgcagtggcatgatcttggctcactgcaatctccgcctcctgggttcaagtgattcttctgcctcagcctcctgagtagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgacaggcgtgagccaccacacccggtggagctcattagctttagaaaaaagtactttccttgcatgtaaagaaaggaataggaaggatcaccaagtagtagatacctgggttggtgggtcaggatgaaatggatagaaaagagacaaaggagttaagaaggaaaaactaggaaaaactttatggctattttgtcgataagtataaatcatttattgatacagatgtttctaaaggttcaatcaaaaggatcacaaaagtatttacaaaacataagacgtttagcttatcttaatatatatcaggctgggcgcaagtggctcacgcctgtaatcttagcactttgggaggccgagaagggcagatcacgaggtcaggagtttgagaccagcctggccaacatggcgaaaccccgtttctactaaaaatacaaaaaaaaattagctgggcatggtgatgtgcgcctgtaatcccagctactcaggagactgaggcaggagaatggcttgaacccaggaggcagaggttgcagtgagctgagatcacaccactgcactccagcctgggcaacaaagcgagactctgtctcaaaaaaaataaataaataaataaaataaaaataataataaataaaataaaataacttacaaagaatatcatatgtatgaatgagtcatgaagtatctaaactgtgggggaaattggccatagttctgcttatggcaaagtaggcctcacaatctcatttcaaccaaaatgtttcgagaacctctacttgccagttgcattggagatgcaaggatgaaaagatgaccttgcccttggaaaactcacagacaaaaaagagaaagaaacagcagcaaataattatgatacagtatgaaattatgatacgtatgaaaagtgccaaatagacggaagttacaaagtcaatctcttgagaaaaaaggagtaggaaggataccaggtattagatgcctgggttggtgggtcaggatggccatagttctgcttatggctaagtataggcctcccaatctcatttcaaccaaaataatcttgagaagcaagagactgactttgaccaagaggtaggggcagtggtttgggaaaagcgtcatcaaaagggttatttctgagctgaactttgaaggatacaaggaattcaagaaatgaacaagagatggggtacaagttcagaatcatgaagtagggcttaaactatgacattaggtacagagagtgcgagataaactttgcacatttctagaaggtaaaatcggctgggcatggtggcttcacgcctgtaatcgcagcccttcaggaggccaaggtgggaggatcccttgagcccaggagtttgagagcagcctgggcaatatagggagaccctgtctctattttaaattaaaattgtaatttttaaaaaagatgtaaaatggacagttcttggagattactgagatatgaaggacaaaaggtgttaagagtgactcctaggtttcagtcttaggtacgttgtgtagatggggtacttcccattgagataagaaataccaggaggaaaagcaggtttaggaggaagacaaagagtttaacttagtacaggttcaatttagagggcctataagacatccaaatagtaattggacagatgagctcattgtttacattcactgaaatggcaataggagtcagggagaatgattgcttttctttcatttttaaaaccagatcctggctgggcgcagtggctcatgcccgtaatcccaacactttgggaggccgaggagggtggatcacgaggtcaagtgatcgagaccatcctggccaacatggtgaaaccccgtctctactaaaagtcacaaaaattagccgggcgtggtggtgggtgcctgtagtcccagctactccggaggctgaggcaggagaattgcttgaaccctggaggtggagcttgcagtgagccgagatcgcgccactgtactccagcctggcgacagagcaagactctgtctcaaaacaaaacaaaacaaaaaaacagatccccggggggtggaatctttcagctctgttctttgtcccttctttctcataccacatggtattcctcttgactctgtagcgtttcccgtggcattattgaaagaattgggccaagcacagtggctcatgcctaaaatccaagcgccttgggaggtggaaggatcccttgaggccaggaatttgagaccagcctgggcaatgcattatagagagacactgtccctacaaaaaaaatggaaaaattaactggatatggtgatgtgcccctgtggtcctagctgctcaggaagatgaggcaggaggatctcttgagcttaggaagtcaaggttatagtgaggtatggatcgcactgctgcattccaacctgggcaacagtgagaccctgtctcttaaaaaataaaaaaaatagaaacaattgggatctcgggaggaccctttatcattaatacagaatgtttgggtgaaagggaaataaatgtttttctgtggcattcagaaactttttgctgaaaaatatttaagaatccttagagttggatgcggtggctcacgcctgtaatcccagcactttgggaggccgaggcgggtggatcatgaggtcgggagttcaaaaccagcctggccaacatcgcgaaaccctgtctctactaaaactaaaaaaattaagcaggcgcagtggtgggtgcctgtaatcccagctactcgggaggctgaggcaggagaatcgcttgatcctgggcggcagaggttgcagtgagctgagatcgcgccactgcactctagcctgggcgacagggtgagactgtctcacaaaaaaaagccaaaaaaaaaaaaaaagaatccttagaaagtaaaaagtgtactgggaagacaatatcaagttctagtctatattatttgaattatgtccattttcctgttagtgtggatgccagaatctcttgttttcactgaaattttaaggaatagtgaaataatgtgtgtgaatatagtctggaaaaagttgttatggaagcaatattgcattcagagacaattcataatttggggactgttgatttccattataacttttagatgcatgcatttggaaagtttatatagcattttagaagctaacctcttagattaataggagttaattttgttagcatgctgaaatctgtgttctatagaatacaagaggaaatgagctaacgacaaattcgtcgagtgcctacttttgtgaaacattatgctaattactttgcggatgctactttgtttaatcctcatagtaaacttgtagggcaggtattgttgttttctattttgtagaagatgaaatgaaagctttagaaacttgctgtgatttcacaggtattaaatgatagagttgggatttagatctaaattttccaagtcctaaccccatgttctttcatttatacctcactaccagatagtcttaagacttgaaagcgatactgtggcattcccttgaggttaaaatgaaggagatgtgttttaggagaacacagaaatatttagtcctacttttataaacctcagcttctagagacactgttctttgagaataacacagtgttttaaaaaaatactaccttttctagctggaaacaactctagaaaaaaagattttgctgctttgttatagctgcacaacgttaggtttcactccctatacttaggagaaacggattcagcctaaaccccagccaggaaggacagctgtatttgtcttctacctggaaatatacacagtatgtgagaaagactgaagaaacagttgtgaaagataagatacttaaaatatctctttttttttttttttgagatggagttttgctccactgcccaggctggagtgcagtggcgtgatctcggctcactgcaacctccgcatcccgagttcaagcaattctcctgcctcagcctcccgagtagctgggattgcaggcatgcaccaccccacctggctaagttttgtatttttagtagagatgggattttaccatgctggccaggctggtctcgaactcccgacctaaggtggtctacccgcctcggcctcccaaagtgctggtattacaggcgcccaccactgcgcctggctaatttttgtatttttagtagtgacggggtttcaccgtgttagtcaggatggtctcgaactcctgacctcatgatctgcctgcctcggcctcccagtgctgggattacaggtgtgagccaccacacctggccaatgtatcttttaaaatttgggtaaaattcacataacataaaattcactattttaaccattttaaagtatataagtcagtagtttatagtctagtcatactgttgtacaaccatcacaaccatctaattccagaacatttcatcaccacaaaaagaaaccccctgtattcattagcagtcactccctattacccctccagctacctcctggcaaccactaatctgctttctgtctctacagctttgcctagtctgaacatctaatgtaaatgaaatcatacaacttgtggacttttgtgtccgacttccttttttggcataatgttttcaagatccatccaagtggtagcatgtatcagtactttattcctttttatgggtaaataatattccattgtgtggacataccatttgtttatccattcattgatggacatttgggttgtttctactttttggctattacgagtaatgcaagtgtgaacatttttcatgtataagttttttgtttttgtttttgttttgttttgtttttttgaggcagagtctttctctatctcccagacgagtacggtagcacaatctcagctcactgcaacctccacctcctgggttcaagtgattcttctgcctcagcctcccaagtagctgggattgcaggcatgcaccacgccacctggctaagttttgtatttttagtagagatgggattttaccatgctggccaggctggtctcgaactcccgacctaggtggtctacccgcctcggcctcccaaagtgctgggattacaggcgtgagttaccgtgcctgacatagttgtttttttcttaatatatgttttcaatatctgggtatatactagcggttttttgggccccccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtacagtagttcatcatgggtaaataatattccattgtgtggacataccatttgtttatccattcattaatggacatttgggttgtttctactttttggctattacgagtaatgcaagtgtgaacatttttcatgtataagttttttgtttttgtttttgttttgttttgtttttttgaggcagagtctttctctatctcccagacgagtacggtagcacaatctcagctcactgcaacctccacctcctgggttcaagtgattcttctgcctcagcctcccaagtagctgggattgcaggcatgcaccacgccacctggctaagttttgtatttttagtagagatgggattttaccatgctggccaggctggtctcgaactcccgacctaggtggtctacccgcctcggcctcccaaagtgctgggattacaggcatgagctactgcacctggccaaaacaaaacaaaacaaacaaacaaacaaaaaaaacgtgttttaatgttaaaacaattttgaaaatctacacttacctgaaaacaaaacagatcttcccagtttctggattcagcccatcatgatacgatctttttagaacggaacatccctgcagccatacagaaattagaaggattataagggagcaatttcatgccaaaaatttgacaatttaaatgtaatagacaatttcctagaaagagacaagttgcaaaaactaaccaagacaaaggagaaaatcttaatagacttatatcaagttaaaaaagaaaaaaaaggaattagtcattaaaaatcttctcacaaagacaggtccaggcccaaagttaaaaaattagctgggtgtggtggtgcatgcctgtagtcccagctattagggaagctgaggtgagagaattgcttgagccccagagttggaggctgcagagagctatgatcgtgccgctgcactctagcctcggtgacagagtgtctttacaaaaaccacaaaaacatttaaggaataaataatacgaatcttacacaaaaataaggtaaagagaacacttcacaacttattttgtgaggccagatatcaaagccagacataaacatcacaagaaacaaactatagttaaaaatcccaggccagaggctgggcacggtggctcacgcctgtaatcccagcactttgggaggccaaggtggaatgattgcttgaggccaggagtttgagaccagcctaggcacgtagtgagaccttgtctctacaagaataaaaaatcagctgggtgtcgggtagtgtatgcctgtagtcccagctactcgggaggctgaggtgggaggatcacttgagtcggggagttggaggttgcagtgagctgaaatggcgccagtgcactccagcctgggcaacagagctggaccctctcaaaaaaaaaaaaaaatccagattggaaaagaataagcaaaactatattcacagatgacatgatattatatgtagaaaatgctaaggaatccatgaaacaacaacggatactagaactgataattaactttagcaaagttataggacataagatcaatatacagaaaatttcagttacacaaacacaaatacaaatcaattgcactgttacataatatcaaggaacaatccaaaaataaaattcagaaaacaattccattcacaacagcatcaagtagaataaaatacataggaataacaaaaactcttttttttttttttttgaggtggagtcttgccctgtgggctaggctggagtgcaatggtctgatcttggctcactgcaacctctgcctcccgggttcaagcgattctcctgcctcagcctcctgagtagctgggattacaggtgcctgccaccacaccaggctaattttctgtatctttagtagagacctggtttcaccatgttagccaggattgtctcaatctcctgacctcatgatccacccacctcggcctcccaaagtgctgggattacaggcgggaataacgaaatctcttaaacgaagccatctataatagagagatcaatctcctttctctcatcttttttttttttagtattacagtgtatgccattgagttgaactttcttttccttcactttccatttcttaagggcttacggcaaccagctcctttttctgatgaaattgaagttgactttagtaagccctatgtcagggtaactatggaagaagccagcagaggaactccttgtaagtaaataccttcttaatttgttgtttgactattgtttttagcattccattgtctttatcaaatacacacctgctctctatatactgccctctgtttacttgcaaaggccagcagcgaaggggttcttctcacctgtcttgatgttctatttagaagggtaactccactccataaactttcattttttttcttattattatgcacctgtttcctgggctgctgttgtagctgtgagatacagtaaaacagaaacaatatgatattatattagcttgagctgagttatgatcttatctatttctataaagtccaaatcatgtgtcagggtgtcacattcttcatagccttcagaattccccaccacctctctacgttctgtcagctggctatgatgctgccgattgatagaggacaaaaatatcccaagttgggagatgctcgtcacttaattttatttttactgatattataattttccaggttttaaaaaatactttattttcaaagcccttgctctttatttgcatgcttaatttacataattaattagcagtttttgacacataaattactaatatatattcgagatgcttttcttatgtggggcaattggttttagagatcattataaaaagaaacttccaagagcatttgttatgaatacaaagtcctataggcaaatattctttcttctctgtaaattccccaattctccctttttttccaatcctttttcacttcttctgattactaagtgttctctctaccctgtaaatataggactgaactaagactcagacagacaccagggaataagagggatttatagccacaaatctgtgcatttgcagcatatacagtatatttgtggttacttcttaattgtgttggtatgtttgctctctgtagtaactgaagaacagtgaaatacaaatagaagtgggccaggagtggtggctcacacctgtaatcccagcactttggacaccaaggcgggcagatcatcacttgatgtcaggagttcgagaccagcctggttaacatggtgaaaccccttctctactaaaaatacaaaagttagctgggcgtggtggtgggcacctgtagtcccagctactcgggaggctaaggcacgagaattatgtgaacctgggaggcagagattgcagtgagctgagatcatgccactgtactccagcctgggtgacagagcgagaccctgtctcaaaacaaacaaacaaaaaacaaatagaagtgatgtacagtgtcatactgggaaatttttttttcttttgaggcagagtctcactctgttgcccaggctggcatgcagtggcacaatcttggctcagtgcaacctcctcctcccgggttcaagcaattcttctgccccagcctcccgagtagctgggattacaggtgtgcaccaccacgcctggctaatttttgtatttttagtagagacggggtttcaccatgttggccaggctggcctcgaactcctgacctcgtgatccacccacctcagcctcccaaagtgctgggattgcaggcgtgagccaccgcgccggccaatgccgggaattttaacacctatcctttggccttatcttgggtatatgtattgtgggtttggggtcctcaacaaaaaagaggctaattccagagaatcctttccttttgaaaaaatgtgtagatatagttcatattgatcacaaccttctgattcatgataagatttttgagtttggcttcccttatttgggtaataggtaggctcctggaggcagggtaaaatgacaaagaaaaccagagactatggattgtgtaatggtagccaggtctaacttcaaaacgccagaagatagttcagggttcacattcagatgtgatagtagaggctattgaaagcaagaactttttacatactctctaatgacacacatttacaatcagctattcatttagatttgatctgatgggttgcattatccagtttgttgctaatttgtctatatatcatttgtggtacataaaatttgaaaatatgtgtactgtttccaagttgatcttttgttttgttttgtttttgagacagagtctcgcttgtcaaccaggctggagtgcggtggtgtgatctcagctcactgcaacatttcccttctgggttcaagcagttctcaaatctcagcctcccaagtagctgggattacaggagtgagccaccgtgccgggcctgtttccaagttttaaagcttataattaacaagtcctgactggtataattgtttttaattttagaattataggattttacaaataagtcattttcaagattatctactttatagtttcttcattaagtacataaagcaattaaggtccatagtaaccaagaagcgaaggcttcccctacagtaaaacggatgattagtggaatagaattgcagctcaaacctcacccgggaatggtgctactcattgtaagcattagaatagaaggccttcagcaaaataattgtatttttggtggaacaaacagccacaaattagcctataaatttgccagcttaatttgaactctggtttttctcttagatctcattttgtctgactgttttatgttaaatcaccaagtaggtaactgcattcatgccagtgcaggacaaggaataaagcaataaagaatgcacctgctctagtgaagtttcaacacctccctcctgctccccaggtttttacgagggaggttgtataatctaggagaagattctctacttagagaaaaacaaatatgatttgagagacaagaaggtcagctctaggaatcttttgggagatgaaaaaaatcagcaatatgtttaactcagagaaaggaaggaaaagggagagtgtgaagggcaatggaaatgttaggaacagaatgtttcggtggtaggtatttgggagagtaaatctatcaaaagagatcattaactgaaacccaggtttcttctgcctaaaggaggacatatggttacttagtcaccagtggtgcagcgtataattcataacccacataaaccatataatttatcatccaaatcaggacggttttgagcatgaaagggagttgctgttaataatatacagaggttgagtgtggtggctcatgcctataatcccagcactttgggaggccaaggcagaaggattgcttgaggctaggaattcaaggccagcctgggcaatacagtgagatcccatctctacaaaaattttaataattagccaggtgtggtggtgtgcatctatagtcccagccactcaggaggctgaggtgagaggattgtttgagcccaggaggtctagaccacggcaagtcatgattgcaccactgcacttcagcctgggtgacagagaccctatcttaaaaaataaataaatacataaataaaaattaaaaaaatatatatataggccaggtacagtgactcacacctgtaatcccagcactttggaaagctgaggtgggtggatcataaggtcaggagatcgagaccatcctggctaacatggtgaaaccccgtctctactaaaaatataaaaaattagccaggcgtggtggcacacacctgtaatcccagctattcaggaggctgagacaggagaatcacttgagcctgggaggcagaggttgcagtgagcctaggtcacgtcactgcactctagcctgggcgacagagtgagactccgtctcaaaaaaaaaaaatctatctatctatctatataacatatatacatatgtaatatatgcataatatataaatgatattaaatatgtattatatagtacattatataatagaaacaggaaaaattatattaaaagtatataatttatataaatatgattatatatactataacatacattaaatcaggggtgtgtttatcctggccaatagccacttggtaaaagaatggctaacgctagctttcttcccagactagttcaacagtgaccccttctggccgtttggttaatatatcagcctgggtttgccaaagacttgggatggaatggtggccagttgagatgttggtaggctggggaagcactggagagagcaagaggcgcatctgggattggtctgagaaaaggttcagtgatctacttggcctaacataggatgattagctgtgctgcaagcagccacttgatcaacagcattctgtgctattgccaccatccaggcaatgtgtttcttgagcaaaatttccctgctgtatgctgtctagtagcaaagaaacaacaaagtagtcttcatttgtatattctatcccttgtgtttcaggatcgaatagtgtgagatcatagcccctctggacttgtttagggaaaatggaactatgttagttacttcatggacgtgacttctgggatacttcaattttttttttttttgagacagagtcttgctctgtctcgcaggctggagtgcagtggcgcgatctcagctcactgcaacctctgcctcctgggttcaagagattctcctgcctcagcctcccgagtagctgggattacaggcgcccaccaccatacccagctaatttttgtatttttagtagacacagggtttcaccatgttggccaggctggcctcaactgctgacctcaggtgatccacctgccttggcctcccaaagtgctgggattacaggcgtgagccactgtgcccggcccaaaaatctttttaatgtattattttttaataggcatagagccaatgcagtgatttctgggacatagaagggggattatatgctcaaattttgttttattttgctttgtcttattaaaaattatctttttaaaaatatttttttcttctttttttttagttgacacatgctggcagtaaaaaataattttaatagagatagggtttcactgtgttgcccaggctggtctcagactcctgggctcaagcagtcctcctaccttggtctcccaaggtgctggaattacaggtgtgagctactgtacccagcctgctttctctcatagatgagaaaactgaggcataaggaagttaaggttacagaggaagaaagctggttggaaagcttggtcaaagcttgagctatgacctttctgactcttaaatccattaattaattcttagtttttcattggattggtatatttaatttaaaatttttatttcctgtattataaaatcaatacaaccagcctgggctgggcatggtggctcacgcccgtaatcccagaacttcgggaggccaaggcgggcagatcacttgaggtcaggaaattgagaccagcctggccaacatgggatacgaatataaaaatacaaaaaattatcccggcttggtggctttcgcctgtaatcccagtgacttgggaggctgaggcaggatagtcacttgaacccaggaggcagaggttgcagtgagcctagatcatgtcaccacactccagcctgggcaacagagcaagactccatctcaaataaataaataaataaaaatacaactagcttgggcaacatgtgaaaccccatctgtacaaaaaatacaaaaatcagctgagcgtagtggtgtgcgctgtagccagtggggcgtggcggtgtgcactgtagccagtggggcgtggcggggtgcgctgtagtctgcggggcgtggcggggtgcgctgtagtcagcggggcgtggtggtgtgcgctgtagtcccagcttctcgggaggctgaggcgggaggatcatttgagcctgggaggtggaggtttcagtgatctgagaccatgccactgcactccagccagggtgacagagccagaccctgtctcaaaaaatcaaatcaagtgaaatcaatacattcccacagtttaatatccataaaatacaaaaagggcataaagtaaaatgtctccctctcaagacctgtctcacagccacctggtatccctataacaggccaccaatattacccatttctgtgaatatctaagtaaattgtttatatatcctcccaccttttagtgggtgtattatgctatattcaatcttccgttgaaatgtaggtcgtttcctgactgttgctattataaacagtactgcaatgaataacatctatatttactgtgagataattcccagaattagaaaagctgggccacagctataagcatttgtcgtttgtcttttgatagatacgacctaattgcccttcttgaaagttgctgatactcctttcagcagtgtatgatttcttggtttaaaatctacttatttatgagtaaagctttttgaaaacaaaaattcataaacctcctgagaactactttccttctccttcattcattgccctgaagacaggaaggagatgtatctgatcctcaacctcagcatggtgtatctgatcctcagcctcagcatagtgtatctggtcctcagcctcagcatagtgtatctgatcctcaacctcagcatggtgtatctggtcctcaacctcagcatggtgtatctggtcctcagcctcagcatggtgtatctggtcctcagcctcagcatggtgtatctggtcctcagcctcagcatggtgtatgtgatcctcagcctcagcatggtgtatctggtcctcagcctcagcatggtgtatctgatcctcagcctcagcatggtgtatctggtcctcagcctcagcatggtgtatctggtcctcagcctcagcatggtgtatctggtcctcagcctcagcatggtgtatctggtcctcagcctcagcatagggtatctggtcctcaacctcagcatagtgtatctgatcctcagcatagtgtatctggtcctcagcctcagcatggtgtatctggtcctcagcctcagcatagtgtatctgatcctcaacctcagcatggtgtatctgatcctcagcatagtgtatctggtcctcaacctcagcatagtgtatctgatcctcagcatagtgtatctggtcctcaacctcggcataatatatctgatcctcagcctcagcatagtgtatctgatcctcagcctcagcatagtgtatctgatcctcaacctcagcatggtgtatctgatcctcaacctcaacatagtgtatctgatcctcagcctcagcatagtgtatctggtcctcagcatagtgtatctgatcctcagcctcagcatagtgtatctggtcctcaacctcagcatagtgtatctgatcctcagcctcagcatagtgtatctggtcctcagcatagtgtatctggtcctcagcctcagcatagtgtatctgatcctcagcctcagcatagtgtatctgatcctcagcatagtgtatctgatcctcagcctcagcatagtgtatctggtcctcagcctcagcatagtgtatctgatcctcagcctcagcatagtgtatctgatcctcagcatagtgtatctgatcctcagcctcagcatagtgtatctggtcctcgcctcggcatggtgtatctggtcctcagcctcggcatggtgtacctggtcctcagcctcggcatggtgtacctggtcctctgcctcggcatggtgtacctggtcctcagcctcggcatggtgtacctggtcctcagcctcggcatggtgtacctggtcctcagcctcggcatggtgtacctggtcctcagcctcggcatggtgtatctggtcctcagcctcggcatggtgtatctggtcctcagcctcggcatggtgtatctggtcctcagcctcggcatggtgtacctgatcctcagcatagtgtatgtggtactcaacctcagcatggtgtatctggtcctcagcctcagtatagtgtatctggtcctcagcctcagcatagtgtatctggtcctcagcctcagcatagtgtatctggtcctcagcctcagcatagtgtatctggtcctcagcctcagcatagtgtatctggtcctcagcctcggcatggtgtatctgatcctcaacctcagcatagtgtatctgatgacactttgacctatctttcccaaatgatgtaaatgctcctgtcagtttctgctgcagtaaaatagctcttcctttattcacagaaagggaataagttacatggactccttagatttattatttaaagcatgatggaccattatgctgattctgtttttaatgtttatttcactttggaattagtcttgttccccgggaaatcatttcctggcttctaagttgacagttctctgttatttgttgtgcctgaaaagtttggtacaaccaggctaacagaggcagttagtgcagatgatgatgtcaaaaatctctttataggctgagcatggtggctcacacctggaatcccagcattttgggaggccaaggtgggattgcttgagtccaggagttcgagaccagcctgggcaacatggtctctacaaaaaaaaaaaaaaaaaattagctgggcatggtggtgtccatctgtggtcccatctacttgggaggctgagatgggaggatcacttgagcccaggaggtcaaggctgccgtgagctgtgaccacatcagtgcactccaggctggatgacagagtgagaccctgtctcaaaaaaaaaatgaaaaggtctttatagtcatttttcataacccaacctacccctaaaatcagggtgaatacccagagaacacctaaagaaaggagtatgcagttgggccgggcgcggttgctcacacctgtaatcccagcactttgggaggcttaggcgggtggatcacgaggtcaggagatcgagaccatcctgtctaacactgtgaaaccccatctctactaaaaaataatacaaaaaattagctgggcttggtggtgggcgcctgtagttccagctactcaggaggcggaggcaggagagtcgcttgaatccgggagttgcaggttgtagtgagccgagatcgtgccactgcactccagtctgggtgatggagcgagattccgtctcaagaaaaaaataaaaaaaaagaaaggagtatacagtcatggaactgtcacacagagccagttccatttgccaagtacaagatatcgaatcaatgtatttttgtggcttggcatggtggttcacacctgtaatcccagcactttgggaggctgaggctggcgggtcatttgagaccaggaattcgagaccagcctggccaacaaggaaaaaccccatctctactaaaaacacaaaaattaggcaggcgtgatgacatgcacctgtaatcccagctgcttgggaggctgaggcaggagaatcacttgaacccaggaggcggaagttgcagtgagccgagatcacgccactgcactccagcctgggtgacagagtgagactcggcctcaaaaataaaaataaaaatgacaaaaaaaaaggtatttttgtgatcaattctttcatttggatttaggtgagcgacctgtgagagtttatgccgatggaatatttgacttatttcactctggtcacgcccgagctctgatgcaagcgaagaaccttttccctaatacgtacctcattgtgggaggtaagaaaacatttggtgacttcaggtgctgtgcagaaaaagatgatagtacagtctgtctttctcagctgagtacactggctcttgtttccatttttaaatgaaggatgtagtacagcctctctaacacacatgaagtatatgggtaccagcaaactaaacctggagagaggagcttcaagctcctcgactgtgccatctggcatttattcactgcttgtagctgagtttctgtggtcacaggagcagccgtgacttccgttgtccactttaaaacatttgctttagatttcagtttatcattttgaattaactggagtacaaaagtctgccaaggaaatgttaggtggtccagtccagtgtgaataaaacaggaaaacatgtttaaggacttaattgatgcagacacgcacagcaggtttatttcagagtcaaagatcttggtcacctgttgtactgtcccttctccaaagtatgaacatactgtttagtgagtgttgctcctgaaggtatacgctgcattaggaaaagcgttatcacccaggttcaaccacctttagaagacttttttccagttggggaagatggttgcagtcctaagcagtgggagaagatgggagaggtcggtggctgaggaggtgctaagcaaagaggactccaacacacaatttatgatgtggtgaaccagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccgggtaagaaactggacacatattcccattccttgtttcagaatcccctcaactctcaaagctgctggcacgtaggctggttttccactagccgtgttttacttctacctcttatgtaagtttcgtaggagatgacagtgatattactagtgataacagtcacccctgacgtttatatggggctggatggtttgcaagcacttttacatccattctattccattttctgcccacagcaatcctgtggtgtgtttgtcatttccgctttacatatgagtaacaagggctagagaaaccaaataacctgctccaagttacaccattggcagggctgggaactgaactcgccacaagttacaccactggcagggctgggaactgaactcgccacaagttacaccactggcagggctgggaactgaactcgccacaagttacaccactggcagggctgggaactgaactcgccacaaattacaccactggcagggctgggaactgaactcgccacaagttacaccactggcagggctgggaactgaactcaccagttacgagaccttccccccacaccataggcacatctacccttagaacatgccagtctcctgagaatatccatagccccaggtgaactctgaagacggtcacattaccaggaaataagacggattaacatagacttttcttggcttaagtttcatttcagggctttgatcttatgctagaaattgggtggaatcagaaatcaaggatatttctcactgtttctcagtaagttattatcaaccccttacctccttttaattctcccacattaaagtaacagatttcagccaggtgcagtggctcacgcctgtaatccaagcactttgggaggccaaggtgggaggatcgcttgagcccaggagctcaagaccagcctgggcaacataccgagaccctgtctctactttaaaaaaaaaaaagccacaggtttcctgcaaaaggtgggtacaaaagatgagaaggattgattaggccaggttagaggcccccaagcctgaggaaatagcaagcatgttgtcagttctctacaggggcgcgtggaatgttgtaggtaaattgttcagtgaggcagaaagaatgaaggcagccaaagtgcttctaaagcaatacgtgggtaggcctgaagaggggatatttattaaaactattgaggattaggacagaccttttataattctctggcttttctacatcaacacctagcagccagtggcaccaaaggtggtaagcaagtttattctcagcaccacagcccacaggcccagacagaagtatgaagttagaggaatttctaactccccttttctctttgttaacaatatatactcaaccttgagttttgcttgtcccattctttttttttttttttttgagacagagttttgctctgttgcccaggctggagtgcaatggcgtgatctcggatcaccgcaacctccgcctcccgggttcaagtgattcgcctgcctcagcctcccgagtagctgggattacaggtgcgcgccaccatgcccggctaatttcttgtatttttagtagaggcagtgtttcgccgttttggccaggctggtcttgaactcctgacctcaggtgatccacccggcctcctattctttactttgctgcctatggatccctgacaagttgttcatgagtaattgagatgctggctgagagtctctgacatagtcccaatgaacatgcttcacactacagtggtctctcggggatggtatagtgatcttagtaattatcagcaaaaggctggtggcccatacaggaaggagtaagtgaagtttagcacgcctccgaacaacattattgatccccagtatcattcatctcttcttgcccttgcaaaggatattcatagcagtaaaatggccaggcgctgtggctcacgcctgtaatcccagcactttgggaggccaagtcaggtggatcacttgaggtcaggagttcgtgaccagcctggccaacacggtgaaaccctgtctactaaaaatgcaaagattaaccaggcggggtgacatgcgcctgtagtcccagctactcgggaggctgaggcaggagaatcgcttgaatccaggaggcagaggtttcagtgagccgagactgtgccactacactccagcctgggcgacagagcgagactcggtctcaaaaaaaaaaaaaaaagtagtgaaatgatagatcctgaggataaaacttcttttatttatttatgtatttttattgatcattcttgggtgtttctcgcagagggggatttggcagggtcataggacaatagtggacggaaggtcagcagataaacaagtgaacaaaggtctctggttttcctaggcagagggccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaattgagtctcccatgtctacttctttctacacagacacagcaacaatctgatttttctatcttttccccacatttcccccttttctattcgacaaaaccgccatcgtcatcatggcccgttctcaatgagctgttgggtacacctcccagacggggtggtggccgggcagaggggctcctcacctcccagtaggggcggccgggcagaggcgcccctcacctcccggacggggtggctgccgggcggagacgctcctcacttcccagaccgggtcgcggccgggcagaggagctcctcacatcccaaacggggcggcggggcagtggcgctccccacatctcagacgatgggcggccgggcagagacgctcctcacttcctagacgggatggcggcggggaggaggcgctcctcacttcccagactgggcagccgggcagaggggctcctcacatcccagacgatgggcggccaggcagagacgctcctcacatcccagacggggtcgtggccgggcagaggcgctcctcacctccaagactgggtggcggtcgggcagagacactcctcagttcccagacggggtcgtggcctggcagaggcgctcctcacatcccagatggggcggcggggcagaggcgctccccacatctcagacgatgggcggccgggaagaggcgctcctcacttcccagactgggcggccgggcagaggggctcctcacatcccagacgatgggcggccaggcagagacgctcctcacttcccagacggggtggcggccgggcagaggctgcagtctcagcactttgggaggccaaggcaggcggctgggaggtggaggttgtagcgagccgagatcacgccactgcactccagcctgggcagcattgagcactgagtgaacgagactccgtctgcaatcccggcacctcgggaggccgaggctggcggatcactcgcggttaggagctggagaccagcccggccaacacaccaaaaccctgtctccaccaaaaaaatacgaaaaccagtcaggcgtggcggcgtgcgcctgcaatggcaggcactgggcaggctgaggcaggagaatcaggcagggaggttgcagtgagcagagatggcggcagtacagtccagcttccgctcggcatcagagggagaccatagaaagagagggagagggagaccgtggggagagggagaggggagaggggagaagggagaggggagagggagaaaacttctcttatggccttcggtttgtatttctcaggccaatagatgtatctattccagtcagagggctcgtggttgctatttttatattccctcttttctcacggactgagagaaactagttaagaaagaagtaacctctttctcatactttttttttttttgagacagagtcttgctttgtcacccaggctggagtgcagtggtgcgattttggctcactgtagcctctgcctcctgggttcaagcaattctcctgcctcagcctcccaagtagctgggactacaagcgcccgccaccatgcctggctaatttttttgtatttttagtagagacggggtttcaccatgttagccacgttagtcttgaactcctgacctcgtgatctgcccgccttggcctcccaaagtgctgggattacaggcatgagccaccgtgcctggcctttctcatacttttagaaacccttatttgaccaaatccttccagacccaggacagggagatttccttctttcctaggctccacccactaaccggttcaccagcaaaccctctggccctattgaccacagcaagatgactggtatacagagtgagggtaacagttctagcagactaggagaaatagctacaaaagcagctggctaacttcatatgtatactccataaatcattaggttgggtggtttgtgaatagattgtagaatttatgagcaaagcaaagagagatatgaagtccactgaggcctggcctctgcctattgtcctttttctgggcctgagaacattgactgggtctttctgaatggcagttatcatgggttttaatgatgtttccttattttcagattgattttgtagcccatgatgatattccttattcatctgctggcagtgatgatgtttataagcacatcaaggaggcaggtgagtgagctgtgcttcctcactgtaggggatctcagggcagctgcagatgttcagccatgttgctgctttacagaggaaaatgtgtacattagaaattcaacatcctctttcaggccacattttggataaaaggtaaagatgagcatagcacccatcaattctttgtcgtcagttcatgacatccatcaattcttggtctaaacatctactttggatatctctcttaatttcaggaaaccctttctcatatttttcttaatattagggctatgtaactcttctttgccttacctctggcctttgattcggtctaccttctgtatatcagtatctttcagtttcatttagtaataacagattctgctttttgaggaaaggaaaggaatgttgcccccaatttccatttagtcttaatacctgagctaaccagaacctcacagtgtttgtctgtatgtgtttctgagttaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgtgagttccagccttaccccagagttccctgactctgtaggagacatatcacctcccactccatctcagctgaactggctttgcagttggctttgatgatcactcccaaaagttcagtgaatgaattaccactatgttaactgttcacaaaaagaatgaaacagacagtttctgccgttacggtctggtaccaacacattcgtataaagccatacagccaactaaataaatgagtaatttatatagtgcagtatttctgtcaataaatggaaaacggtgtctcttaaacttcctctctcttcttcggttggatgatgtcttgggaacctgcgaaaggctatgagccctcctcgtgtggatagtgacacccgacacaccacttcccacacagacctgagttttaaatttggattgacgaaagttaagtttatcttagcttaatattgccttttagaaactctatatatttttctgggcatggtagttcatgcctgtactttgggaggctgaggcgggaggactgcttgaggccaggagtttgagaccagtctgggggcaacatagcgagaccccatctctaaacaaacagacaaacaaaaaactctaaaagattcatgcaaatatatatatatgtagagtttctttctttttgagacagggtctcgctctgtcaccgaagctggagtgcagttgcgtgatctcggcttcactgcagcctctggctcctgggtgccttagcctcctgatagctgtgattacaggcatgtgccaccaggcctggctaattttttttttttttttttttttttttttttttagcagagatggggttttgccatgtttgccaggctggtctcaaactcctggcctcaagcgatcggacccccttggcctcgcaaagtgctgggattacaggcatgagccaccgtatccagccaacactatacattttgtatgtaaattagacctcaataaaatcgatttaaaaagaagaaagctgctaactttaatgtcttctacataaccagtttaccatgctccctgacctactcccatctctgtaaattgtgctataagaatggataaaatgattacatctaaatatgatttatctaggcagataaaccctagctcttgttaatttacttactatagctttatttttcccataaaaatcaggtgtttaaaaattctaaacataatcccttttctctttatgatctggaaattttgagagtacttttctttttctttttttgagatagagtcacactcagtcatccaggccagagtacagtggcgcaatcttggcttactgcagccttgacctccgggctcaagtgctcctcccatctcagcctcctgagtagctgggactacaggcacaggccaccatacccagcttattttttatatttttatttttagtagagatgaggtcttgctatgttgtccaggctgctctcgagttcctggcctcaagcagtcctcccacttcggcttcccaaagtgctggtattacaggcatgagccactgtgcctggccaaggatacttctcatttgactaaatactcccttcccttccaccggagggtttataccattttccttatctttagcaaagttggtaagaccaacgagtatcatcattttgcaaatgagtaaatggaccttaaaatactaaaggaacaaaaagcaaaaaacacaattcatttaaaataatagaataagccagtgatagaggggaaaaatccagtacaataagcagattaattaagtaaaagatctagtattttctctttcaatctattgtaattagtttattcttggcagtattgtgcagtgatcttttagctgcctctgtatctccgtctggaatgaggttcgggccatgctgcgcatgtttatgttccaagtttatgttttatctttaaaactctgactttatttggctacgtgcctgttactgggtatagcctatatttttagtttattcccaaatgcccacaatattagaattaccacttcttgtgtgtgcatccacagcatatcttatctgttattatgctgagagtggggtagattaaagcaaagcaaaattctagactgaaaacagtgtcaattgagtgcttgagccatgttttttcgttctcttatggtagagaagtttaggatgagcattatttctcagaagagttatttctttatctaggagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactggtatgttctttcccactggacaatgtagggagttccatgttgtggaaagaatgacagaatcattgagcaggaaggggcatcgacactgagaagttatctagtctatccccttatctgggcagaactatctttcaactgtccccagcaaggtttttgaaacctttacagaaagacgttacacattctcctagataattttgccagctctctctcaaccttaaagtctggtgacaagataagcaagtcgccttgcccagcttttatctgtggtatgattttagatagaaggaaaggaaagaataaagaacaataaaaagaaagcagcctccactacaagtagctgcagcaggaaccccaggtaaggtgggaattctgtctttgaggagtagcagtcttttcaaccaaataaaagattgagcaagtgagtcctaggttagatatcaggaaggatctgtctgtgaaggtgtttggataaattagaataatcctagactagattattgaggaagaatggggaatttcccgggtgatgacagcaggggagaacccttaaataaatagtacagcatagactatcccagtcctagatgcttcagtgatgattaagtaggatccacggtgtttttctgactcttcctttcggtttctgcagaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctaggactgggggaacccaaacagcctgtcctgcaagtgacatcactcacccacacgaaggagggggactgcaccttagaagcctgctctgcatccatttacccccccccaagggctttgtttcactgtttatgttcacgtgatctcaacagggaaattgtcattttcattaattttttaaaaaattcgtctttcaaatgtagaactaattttttgcccctgaggagtgggcagaagaaggaggtagtgtaatacgcagaggccttttcttcccggtatactatagcatttgccttccgttctgaagctatgtggcttgccaagtccttcacgaaatgagccacgctgatgggtaatttgtggagaaatatcttaattttgatttccttaaggaaaagcgaaaagcagagttacagtcacaaatcccctgaacgtactgctgtcaccagtgtcattgtggctgcgggaaggagatctgaacctaacttttcttactccctgaggagtttcttgttggacccaatggggtccatgaagacactgatggggatggaagcagacccatggcatcaactgcagtgtttctgctgtgttcatcttctcagaaaactctgtgacccagttctttgggagcttttgtcagtctctttcgtgccatctaccttcgaaggaaggaacacttttagagttacaatgatgaggagaggagcgggacaatactcaatcctataccaagtcgattgagattagtttcctactgggagtaagtgcctggccctgctactcctatttgaatgctattaatattacctagccttttacaaaggatactttgtaaatgtctgctgttggaacttgatgttaatccattttggtcatagccatattagagagatttgcacagaatgtaaaggcaaaagcataggaaacaccttcctttctaaagcaacagccttatcaccttgacctctgtccctcttcagaacattcttccctggaaccagtgctccacatctttcttttcctctgagagctgcagctggcagggacctccctctgctgctcctccagcaagccacagagcataccctcacgtgacaagagtgtggtaggttttctccccacttttcacacacgcctggtggttgtggttccatctgccttgttggcttgcccggggggattcaacacttgactttcaaatcaaagaatgctaatgcttagcacttgctgttgagcatgctctaacttttaaagccctggcctcctgtctccttagctgcttagctacgcggcctagcagatcatcacccatcagtaatcctgtggctagatccaggggaaaattgcttatgtccaggccccacccctgtcactcataaataccccttgtgggggtggaattttagtgttttcagctaagaaaaccacattttctctttccttgcctctgctaggactgtgagcatctcatagtccactccctaaacactttctggtaacacctagttttccgcctgagggtcagaggctagaatcattgcctgcacagcaggactaccttggttcttaaaacttggatcacccaggcaaggcgtggtggctcacgcctgtcatctcagcactttgggagactgaggctggtggatcacttgaggccacgagtttgagaccagcctgaccaacgtggtgaaaccccatctctactaaaaatacaaaaattagccaggcgtggtggtgggcacctgtaatcccagctacttgggaggctgaggcaggagaatcccttgaacccaggaggcggaggttgcagtgagcagagatggtgccgctgcagtccagcctgggtgacagagcgagactctgtctccaaaacaaaacaaaaaccacacacacatacagaaataaagagaaataatcaactagaaaaaaaacaaaacttggatcacccagaaagagcgtcacagaggcgagggagaatgaagcctcttgttatcctgatcgc

SEQ ID NO: 13496 - DNA, 77388 bp, Human
ttcagcaacaaattgttaccaaattgatgaagcttcattagtaactctactcctttccaataattatttaggatagtccctggtatattatctaacccattgttaatatgtgcacactcttcccttgactccataaaccaaagctactctacgtccttccctcccttcctggcaatgggcaaatagtgcttcacccataaaagcatctggtcaggctactggaccaatttgataaacatcacttttaccaccaatttttttttttaattttaccctcaggtgagtcattttgtacacagctcattaccttttgagcagtcttctgctgtagttttgttaaatttatcctcaggaaatcaacccctctcatggtcacacctttctttccacttctatggctataattacctcattgtgtcttaattgcttttatgcttcggtatctctgccactacagtataagcaccttgaggacaagcactgtggcttgatcactgtagtgcactcagaggacagcgtggtcctggcttgatcactgtgatgcgctcataggacagtgtgatcctggcttgatcactgtggggcactcaaagtgtagtagggttcctggagtatgaaaggcactcagtaaaggcttgttttgtttccattcgtttatttttaattggcagataattatagtgtatatttatggggtacaatgtaatgtgttgatccgtgtatacattgtaggaagagtcagtcaagctaattaacatatccatcacctcaccaacttattttttgtggtgaacatgctgtttgttgagtgagtgctcagaattgaaaggcattgtgtgctgtggaggtgcagaggacaggcaccaaacccaggcagttgtagaaagttggggaagatttcagaggaagatagacaaactgagatttgaagggtgacagcaagttagcttggcatagggagaggacaatcctgtcaaaaaagagcatggacagagtcctagatttgagaaagagcaggggccatagccataggcaaaaaaccatgcagctacaccttttgttaactatgcctgagaatcaaggcagaagtcagtgtggtagacatacgtgtgcatctatatatgtgcacatgagaggaaactttggtttttgaaagtttaattagatgcaataaaaagtcaaatccgtcagcctctaaaactcttgatatttagcccaaagccctctacatgattaaacatatccattaactttctcattattttctttttcctcaagctgaagtttattttttctatcacattttaattctctgttttaactgttggcattttagtagtatattttaaatagttccactgcagacaatagtatggttaaggaaagatatttgaatctaaccaccttgcatgaagttgttatatacaggaactgttgcaagttccaaacactcaacttagaaatgaacatttagaaaattacctgtttataaattgaggttttgagtgtataagggacaactggcaacaggatgagatggaagccatactggtcttagaatccaaacgtctgcatccttcattcaccaagtccatcagactcttggtttcatcatctgttgaatgggatccacaatatctgttctccagtcataggtattcttaaaattgaaagagaaactgaatgggaaacgagtcacctaacagatggtagattgttgtatttagttatagcacaaggtcatttgctacagtagttatttttatgttagacaataaaaattttatcccccctccaacaactacaacaataatatatatggaaaaatatgcgcagcaatttaggttagtaaaactaaagctgtactttttaaaacaaacagttttaaataggttttctatgtgtttgtgtcacaagtacagcaagtacgtttacagagaaatggcttcttgcctcaatagcgtgaggataatacgcattgtaactattttgtctcatagaatgattgaagatagtgggaaaagaggaaataccatggcagaaagaagacagctgtttgcagagatgagtaagtatggatcttttaaggaacaccctatagtttccattgaatactcatggaaaggctagaaataaccatttatctttatgatatttgtacttttccttaggatcctaagttcctttcatgaagtgtacattttggccttttttacttcttacttggcaagagttcagttagtcagtaattcatcctaatttgctattagactgtctattttatgtggaagaaaatgtttatagatttatatatttacattcacacatatatgcacatacacagacagttgataaacactatttagtgttgacattaatacagtccactaaactttaaagtctgtgttcatcaccctgaactgtcacagcagctggcatattgtaggcactagataaaatttttgaaatgaattattgactttcttccctgcaaagtgatatcatatgtttatgtggaaaggagaagttaggcacaattactggaccaaactataaacttgtcattcagacctcatgtagaagaggagaatctattctgcaaactggtttttttaaaaatactaaggaaaataaaagataaaaggagcttagagttgacctgctacacaagggaaaccaaactaagttactgactccagtgaagaatctattcaataaaggctattggtttatgtaagtgcacagttgctgtataagtaattggttggtagcatctcccttgtagaccatttttcttattcataaagaaaaagaacttgacattagggagaaaaccacacatctcaagttgaatattataaaggaaaaagcatggttctcttcatgtctttttatctcttcttcctgcatacggaatgaggatgagcaagagtgagtggtaagcctttttccctaagaaggcagtagacaaaattaggtttctactaaagattggaagtgactggcaagaatgagggtcagaacagaaaaaggaaagtcccagataataagattcatattttcctttatcattccccaataatctggtggtaccaagatagcattagaactaacaaggaggaaagaaaattaaaattgatgtggggaatctcagtcgtgttccttgctttttccacttttagagatgtgcttagagtgtttgggagagtttcagccaggccttccaatttcctagaccccatgtgtggtactgtgtcttcacctggaattgtgacctttgtgcagttacaaatccaacagagcaaggagcctagtgagtacttgtccatctaaacaaaatccaaagcagcacaggtatcctccaacagcacattcttatattaaaaaggcataaaattatgtcttatattataagacatcatgggacaatgtcttctcagacacagtagaaaaaaaatatttaccataaaaaggcaataaaatctggggaaaaatatttgaacttatcattataacactaaagactgtatcagacagcacactgtaagaactataaaagtatgcttattcaatgattttgtaaatccttctttgagtttaagtatcccagtgctttctgaacctgatatagtgcctggctcagacaaatacatatgttacaaatgtctattggattaaaattgcccaactcaaagaaagctcgatatgatttttagagacatagaaataagacaactctaagtttttcttcaagtgacagagacttaggaaaattgtgcattcggttcccaaattataactttgtgttttcatagaaacatcacagtgatgtcttgcagctttattagttctgtgagttcttgtgattaacggtcagaatagataaacaagccaaacaaatatatatctttcctccctgggtgttccaactcaaatgttggcaaaaacagctaaatacgtctgaccttaataattcattagtttgagcaacatgtttatatcagcactaagtagggcacatccacaataagtaggattcggctggataaaacaattggctggtttcaaagggagcaattgattttgacaggtagactgtcatacaaaagagaaaggtaatatcactgcgaatgtgttaaatggttgaaaaatatatgggtatcccagctgtatcagcagcacaccaaagaaaggaaaggaaactcttatcagagaagactgacatcaagattcaaaaagtaacttctaggaatctgtgctttctagacagggagcaaaaaaggactagacttgtaaatcttctcatctaagtattatatagaaatatttaaagaaaaaacaacaaaagaaagtgccaatgagattctttgctttagaaattagaaatgtgaaagaaaagttgtaatggccagagttaaacaggcagggaagacttttatccaagactattgcaacaagggagaaagactgaactcaacttccctggaagaaaaggcaggaagtactttaagcactggggaaaaatactggaggacttcagggaggagattggtcaatgtgattaggccatctgtttgctaattgtcacatttaaaagttaggcttctaccctcctgataagacttggagatagaggtgataagtccttcaattattatatttcaaagggctggcacccaggttcttgagaaagacattcctgggttgtaaacttggcaagatatttacatctcaaaggggcagagaaagaatttacaatgaaaagttttctaaagtaaatgctgtaagaaaacagaggtcagaagcctagagcaaggaagaagtctatctaaagttaggcaagttgaggaggtctaggtcttagaaaaggtaaagaacagagagcaattgataagaaaaatggataagaaagtttggcaaattcaggtgattgcagcacatatgtgttaaacattcactcttagctcattactataagcagcagaagcaggaagaaacagcaaagaaatgaaattaagagaagcatagactaaaaaacaaacagaaaaaaatagctttatataaaaaattgggtgaccacctactttgatttaagaaattctgtacaagttctcccttaaccaaaaattctcttcacaataatgccttaattatcagtttgcttagtaccttggattaaagctgaaaaaaacaaaaaaacaaaaaaaccctctagttaaatataaacatcatcctcaccttggctttttcagccatcatataagtttagcagcttaaataagtttatcagactgtcttttaacagaataaattgtttgttcttggaattaaactctccttttctgttgttttactctcagagcacatttacttagccttatatggtagttacttgtgaacatgtccacaacactcactgctgtgaactcctttttagggacagacctaggacatgtaccttcaaatccattccccttagatgctgaatcaagccttgtttaaaagccgattgggcacaggatgggtaggttttaatggaagggaagtgattggaaaacacactttgagaacattgaaggctgcctaacaaggtaaggaaggtcctggggagaaatgagagtgatgccactggcctgtcagcagagacaggacttgaaatcaaaaggaggcaaatgaaactactcaacaaataccatttttggcttttgtttttgcttttgttttgagacacagtttcactctgtcgcccaggctggagtgcagtggcgcgatctcagctcactgcaacctccgcctccctgttcaagcgattcttgtgcctcagcctcccaagtagctgggactacaggtgcaccaccacacctggctaatttttgtatttttagtagagacaccctgggtttcaccatgtctggccaggctggtctcaaacttctgatcttaagtgaaacacccaccttggcctcccaaagtgctggaattaccacttgagccactgtgcccggcctaagtactgttgaattatttgaaggcaggccatccttgagagtgttggctgaagtcggcacatgcacgattggaaaggaacctagggcatgattttgaaacgcacactatgagtttaagaaaaccgatctcaaaaattcagaaaaatgacatgaatgaccccaccaccgtaggttcatggatatggtgactgttttcacttgcttcttcatttctcatgctcctcagtctttttaagatattaacaccatggatcgccaccccagaaattctctctatgtcatcaccctaacatagtctcctgctttttctgtcccctctacttctctttttctgtctcttagtaccctgtagacactgaagtcagagaatttaaagatttcttcttgaccagttgtctccatatacaatttgtctttctctcaagcctttacctttattgctataacccttgagtgttcagagtcccccaaaacaactctcatttctcatgagccagcttatccaaaataggcagcacataaactaaacttcccttccagccttgcctacttgttttcaagtgttctgctaatgaagcagtctgaggagggctcattgtcactccactaatagtgcccatcacaaaaatacctatcatccctgccaaggcggctgccttctagtgttcccaaagcctgcggtctttgaacaactgccaagcagctgggcacagctcagaagtggggagagcactcctgttcccaagtttgtgcctcattttgtcactagaaatatagaatagccctacttgtgcacagagtctcctgttggcaatcttggcccagtcacgcacactactacattttgtgtgcttgttgataatttctggaatatactaaagctctaatccttatatccaactgtcctgtggatatcttacttggacatcttacaagcaactcaaactctttagcccaaaactatcttcacccatcaacaaacctattcctccctgtttgtaccttacttagctcaatgagggatactctattccactcagctacctaaggtagcaatcattttttacccccaaactcctttatcttcctgtcagtatctctctctttctctctctcagtatctctctctctccctccatccttcacacacacacacatacacacacacacacacacacacagagccaatgataaagcgtggcagagttcaggcagcaggttcatcataggcttcatttttattctggaaatatgtattgagcaaaacttttaaatgaatgagatatttaagaatcaaaatggctatatattaatagagctatcaaaaatggctatataatgagctatcaaaatatagaaggcaaaacatacaaaaattgtgtgaaaatgttcagagtgcaaaagctaaaaccaaaagttagataagactggttcgttgatttgttggttgattggttggttgaatgaacaaatgaatgggtagggaaaaggtggaaggaaagaagggagtgagagagggagagagagggaagtagggacagagggagaagagaagaaagagaatcttttcaaaaagggctaaagaaaggaaaaactgctgttgataacagtgtaaacaatctgtgtctttgctgtcctatttattacttccttccaactatgacatgggtacaagaggcttgaggagacggtgcaagagcactaagttgccttaaataaatttgttttagtttttttattatgaaaagtttcaaatatatgtagaagtagagaaaatagtatttatctcaactcttaattatgtatgccatcccccactgtattagtatgaagcaaaactaataaatcacttagatcagttgaatcaccagatttaacgaattatattccagtgatataattcagaaaacaaccactatccattattttgaaaaataatgaagagtacattgaaaaaaaatgtaacgagaaaattctgtacttttttattaaaaagaaaaagtatagattctttggagtttagggtatgaactggttataagtttcataacaaaatggatgttttttagatcttggccaaaatatagtggtaattctagacatatcaacatactaaaagcaaagattgccctgctgattttatttctttactcatttatttaaattccatctttttaatagataaattaagtcagctaatacgctttttaataagactaccagactgctagatcagaaaaataccatctgataaaaattaaccttaatttcagcaagatattgaccaaagctgttggactgtgcatgtgttggggaattgtggactgggtcacaatacagttaggtagatttatgggggatgtcatgaccatgtctaaagccacaactaatgggtctatcaacttggaggaaggcgtctagtagtatcctggaaggctctgtttgtggacctgttctggtccttggttttaatcaatgactcgaatgaagacacagaactaatcccaaagtaggtttttgggtttataaactttcaagaaaagaccacacatgtaaaactgggttaagttcattgtttgctggggcaaagaaaaatacatttattttgacaaggcagataaacagagtaagaggctatgtatcatatctcagcccagcttcttctggtccctttctggatggatcctgcagctaacacatacattgattgtgcacggttgtgtgctgctatatctgacacactaaattgtattgttcaccacatcccttttaatattcagggcttacatcatcagccaggaagaatttatacagcatttatagacctacagacctcttcctgattcttgaacaaaacacagggtcagttaagtccacacagtgatacgacaggagagagcagtcagtgcacttcaggcccaaagcagcatctctacatccctctttactgcatcctggagaagtgcacctttgccgtatttcccccaggacttcaatcagaggaaagtgcagaggtgccagggttactgtgctcagagggtaaggtcttgcagaaactgagaaacttaactatgtgccacatcacaaacattttttcatctggagcttaaatcattatgcttgaagaacttacacaaataatctgtgcccctaatgttttcttttaagtgattatttacagatattgagactctcctgattgctgagccaaacttagcaccaataaaagtacatcctcatctgggagcaaaggcagatttagcattcaggtatttctaaaagtctctctgtctctggttatcgggcatcttagagagctcattccccacgagtcacatttacagagggcatgaaactaggaaagatttttgaagttccagtgacaacttaagaattttaaaagattcagaaaagttcctagtatgagctaaattttaaaagtaactaaccagataaatatgacgtcctacccttagctccaaaataggcatttaaatagcaaatagaaaagatttgacttatatagaagtgcatatgatttttcaaagcagttttttaattaacttcaaacttaataaaagctggcataatgagccgtctatttttaaaaaaagatcacattagttaggagtccttatcaaaggtagtaataattgctttctgtatattctatacaggtaaagcaatagctatttggattaattttggacacctaattttaaagagatattagccagtcacagaacagggtgactagaatgtttaagggtttcaaaccatgcttgatcataatgaaaataataataacaactgccatgaattgaagccctactgggtaccagacagataaacagtatacctgaaatggctgtggagttgaacatcttttaccctaaaaaaagtcaaggagaagctacctccccagctaaattttaaagtccatgatgacaaggactgttgcacataattttcagatggtaatgaggatgctaataatgataatgtagctgctttgcaatatttcagaaatgaattctcaaatggcagggggaaaggagtatgtgactccaggggaaactagatcaaataggttgaagttacagggaggtaaatcaaagctcaaatataaaaaagaaatttctatcacatatttttgttcagaaatggcacatgaagcctcttaaggggcccatttactgttaagtggtcattatgttctcagtgcagaagtcaagactttatatctgtgtattaccagccagtaaagttgatattgttatctcgctttatccatgaggaaattgagatgccaaggaaaaacttggtgaaactcacacaactgggaagtgacagagttaaattttacttcctttaaagttcatttattttcacaagtaataatcttctctgtcattggaaataatcctacgtggccattggctaaatgttcatctcttgagaacatttctaagggaattcctgcattgggtgagggtagttccccatctctttgatccctcaagtgctcagtgtcactaagcctgtttgtcaaagaataagctttattaagagtgaccgtttaatgatctgctttgtaaaaccacaaagtaataggactattggcaacacttcaagtgaatctgaagatatcggtttgagttgaagaaatgctaaatcccctagtgggggacacttgctaattcatgctgagtttcactgggaaagcacttaattggccgtctaatatcatcgcttccaggatagttcatttactttctattctgttttactctaaaggattcacatagcacattttattagtatatgactggtaaagataaaagttcaatacatgcctttatatctgttatggaccataaacatgggcttagaaaaagaaaatatgtagaaatggagaaaagcagacatttattgatagtctaatgtgttctagacaaagtctagagattaactcattcaaaggagggtgggaggaatactaggagctcaggtcttgatgtaacaagcagcccatctgcagggtattgagatgagactgaccaaggctacgagagattctgtggtagaaagtggtgggcaatgtcgttaggcaagtaagctggaaagaaactgcagacgagcttggattctgagcagagcttttagacctgatgttctgggcatcaggagccatgctggactcctaagtgggagagtgaaataaggaaagtagtttaagaatatagggaatgtgttccctctaagttaggaaggaactggaagccacagtaaaagaaaggttgttttagaaaggcatctcttcctctgagattgacaggaaggatcacaagaaagttgttagtaataaaaatgaatacttatgcagcatttactgtgtgccagacggtgtttaagtgccttaggtatattcactcatttatccttacaacagtcctgtgcaataagtactattattatcatcatccccatcttccaagtgagaaaactgaagctctaaaagcaattggcctaagggcacacagagaagatgctcagcagtcagtacatggtcacctaacagccacattctaatgaccaatagcaatgcactttaaatgcttatttgatgatagtatctatatcatctagctgtttcactgtaggtcacagcttgagcagactgttttcagaagtggtggacacaacagggatgacattgtgtttcttgatccaagaatatggtttacaacctaatctccaatgttgattacatgtgtgtgctctttttccctagaacctgaggaacttgtccttgaataggacagacctgttcaagtcttaaagttatatttatattctaataaaaataaaattaggggtaaggatcatatctacagttgttttatttgtaaacattgtaaatttctttctgcacacatggcataccttatgtgtcctttttccccgcactaggggctcaagatctggatcgcatccgactctccacctacagaacagcatgcaagcttaggtttgttcagaagaaatgcaattgtaagtatgccagttgtttggactaattaccatcatgaatcctatagtttacatttggtactaagtttattaaactagattctgttacaaatattgctaatattgttatatatgtttacacaacaataaaaggggtattatgatgcacaaatggtagagatgactcctaagtagtcttgaaatctgaaaatgcttaaatactaaagcatatgaaccgtttagttcatactaaaaggatgaacctctggatacatatacaatataattctgaccttggaatggtttaaatctggatggatgtttttcttcttttctctaaccttggtatcataaatgcagtgccatcaaaatggtttccaacatcattctcagcaaactatcgcaaggacaaaaaaccaaacaccacatgttgtcactcataggtgggaactgaacaatgagaacacatggacacaggaaggggaacatcacactccggggcctgttgtggtgtggggggaagggggagggatagcattaggagatatacctaatgtaaatgacgagttaatgggtgcagcacaccaacatggcacatgtatacatatgtaacaaacctgcacattgtgcacatgtaccctaaaacttaaagtgtaataataataaaataaaataaaaatggtttccaagaactttataaaatatcaaacattaaatcccccttatatttgtattttcttttacaagcacaggaaaatattttaaagcttttggaaaacatttaagtttttttctgaaagaacaaaattagctctttgtgtcagagttttaaccacatttgtttacatgagacaaaaataagaaaagagacaatacttaaagaaacaaaggaacttgctccagtttttttttcaaatttaaaagtgtaagcaataagctagatcactagtcacaatgagcagtcttattctctgctgggtcaacacttccattgtattaccatatccattttctcttggaaaaaaatattgattcatagttcatgtgtaagaacgttttcttttctttttaaaaagtttacttattaaaaaagtctcattttttaattaatattggatgaatttttaaaaatgaaaaccgtaatgttctcctgatacatacacatagttctatgataactggcatggtaattagactcatggtaagggtagaaaccggcatctccacatgtctaccctctcagagtctctagaagatgtttcctagggccctgggcaggtcaccttagccccaggcttctaggcttacagctaatcatgactgtgaggatgcaaagtacgcatctattcctcaagtttctcctctacatcttattccccagccccagtggataaaaatggggctgaagtttggggaaggaggggatggaagaaaaatataagtaggttgtcttattttcattttctgtggcttataacagaatacttgaaactttgcaatttataaagaaaaggaatttatttcttacagttatggtggttcagaagtccaagtcaaggggctgcctctggtgagagtctgcttactagtgggactctctgcagagtctcaagatggtgcagggcacacatagtaaggaggctgagcatgctaactcaggtctgtcttccccttcttataaggccaccagcctcactcctgtgattactcatggattaatccattcatgagggcagagcctgcatgaccaatcacctcttaaaagccccacctctcaacactgcctcacagggggttaagtttcaacatgagttttagaagggacaaacattcaaaccatagcattggtcacacatcatatatgtgttttgactcctcacaggaagctaaagcaatctaaaatgagtagtgagaaaagcattacagatgttgaaagaatttgttactgtatttgtagtcctaatgagtcaataaaagccatttccactgcttgcgataggggccaaggaaaatgttcccacagaagaagtttcctcttccccttcaaacacatcacccagattacaaataaaaggaagaatctccgtgttttcagcaattaaaagggatatgattgtcccacgttcttatcatgtgttaccactacaatggcctcagaattggaggggaaggcagagggtaagtggtagacactctgtcctccttagagctttgccaagcggagccttccttaggctcctttcaggagagctagagatttccaataaaagactacaaaatggtaagaaggaacgcccccaaaaaaaaagcaaaaaaaggaaaacaaagaaaagaaagaaaggaaaaggaaaaggaaaggaaggaagggctcagggaatcagggacttggcaacactgcactcaacattaaggtggacacactgtgttgtccccactcaacattaaagtggacacactgtgttgtctgcagctgtggtccacaggccttatcccatgcctcctgctctctgagaaaggcactttctcattcttgggcatttccttttcctctttctgttcttttctggtccacatccttatcctgcatccagaattgtcttggaatttcttgaaaaacagtagagaagaagtgaggatgctaatccatccctgggtgaaaatagaagcttatacctgtccagtggcccttcagtctgtccattcattgacctcttaattcagttaagtgtataatgagctcctgctatgtgtttgacattgtgctaggtaccaaggatagtgtgatgatgaatgacatgcaataccttccttcaagttgctcaaaatctaactgagaatatgggcttttaagcagatttataaaaccatgtagaaagataatgatagaaatatgtacatggtatgtgagagcttcagggagtcagtgccctgagttgttgggggtgagggtcactggtaggactttcctagagaaggagatatcaggaaagtcttatttattttataatgtaccttataaaattcctgtatttcaggatgagaaaagatattacattctacaaaattagacaaagttaaggcccaaggaagaaaaacaagcatattttgaatgctttgctaaattaaggttttaaaaattgtttctaccttcatcagaggcattaaatgcaagtactatatgtctttgcaaagttttcctttctaacaataaatgcaacagttgtgatattcagaggtatttgtaaaatgcttacataattgatcttggcttatcttaatcaaagttgaaaccttccttctagaaagttagccaaccagaagcagcaatgtttacatgacataacattagtcaacattgaatatattcgctgattagaggaaagtaattttagtctgcaataaacctaacccacaataaattatgataccttataatggagtttttccctacagtaaaagaaataagaaacaaaatgtaggtagcatatttgtaagtgcatttttttattggaaagtgtcaggctgctctaacaaaaataccataaactgggtggcttataaacaacatttatttctcatagttctggaggctagaaaatccaaaatcaaggcactgccagatttggtatctagggagggcagccttctggttcataggtggccccttttcactgtgtcctctcatggtggaagaagcaaggcagccctctggggctttttttttttttttttttttttttttttttttttttttttgacagagtttcactcttttttcccaggctggagtgcaatggtgcaatctcggctcactgcaacctctgcctcccaggttcaagcaattctcctgccttagcctcccaagtagctggaattacaggcatgcaccaccacgcccagctaattttgtatttttagtacagacagggtttcaccatgttggtcaggctggtctcaaactcctgacctcatgtgatctgcccgccttggcctcccaaagtgccaggattacaggtgtgagccacaacgcctggcctggggcctcttttataagggcactaatccccaccatgaaagttctgccctcaagtcctgatcacctgctaaaagtccccacctggtaataccatcgcattaagggattaagtttcagcatgagaatttggtggggcacaaacattcaaacaatagcagaaactcattatagtatttacttcgtagaaatcagtggatctgaagtgaaaatagattgtttacttttaggtccataccttatttaaaatttattgcgtatactaacaaaactaagttttaaaactacataaaggaggaaaaaacaaaaacggctgttgtaaaactatcacctagaaaaaaaatgaatactgtctgcatacagcacagactgtgtaggttttcaggagatttcttttttatctattatctaaatccaaatttcataaatgttggttaattccctatagttctttccccacagcccttgcctactttgtttatgattttgcatgtggacaactggttcctatcactgacattcatgtttattttcttctgttcaattcctaatgtatgctgagaatagtcagttcccgggattctaaaaggactctgaacaagaggccactgtcacccatgaactaaatgaggcccagaacctacttttttatagagaatgaactaatggattttatagatgaatatttgtaatcgatttgataacagggaacactaacttgtaaccccaatttttaaaaatgcgtactcccaagaagaattatattcttttttttttttttttttgagtggagttttgctctttttgcccaggctggagtgcaatggtgtgatcttggctcactgcaacctctgcctcctggattcaagtgattcttctgcctcagcctcccaagtagctgggattacaggcgtgcaccaccacgcccggctaattttgtgtttttagtagagagagggtttcaccaggttggccaggccaggtggcatgagccactgtgcctggccaagaaattacattcttctcattggtagaccagcattttcttaatgtacccaattattggatatttaacttcagtaaaaatgttgtgtaaattctttttctctcttgttatgtatgtactgatataatatccctgattttgtcccttggtccacaaaaagaatgttgaccaatccctgctataaaagacacttgtaagtccaggcgtggtggctcacacctgtattcccagcactttgggaggccgaggcgggcggatcacaaggtcaggagatcgagaccatcctggctaacatggtgataccccatctctactaaaaatacaaataattagcggggcgtggtggcgggcgcctgcagtcccagctacttgggaggctaaggcaggagaatggcatgaacccggggaggtggagattgcagtgagctgagatcgtgccactgcactccagcctgagtgatagagtgagactccttctcaaaaacaaaaacacacttgtaaaaaacccatcttctttttgagtcaaagggttctcctttccaaatcgcttcttccccttaccattcatctttgtaccctgccataccttccccatgatgtaactagcacattctctaacagaataaaagaatgagtgtttctaaaaaattaggggacaccaagttgattatttgatattctaggaggaatggagcagaacaaagaatacaaataatattttaaataatcctttctaatcagtagtcttctcttcagcttccagattttttgttaactttccacaaaaattaataccccataaactcttataaggatatataaaatggcatcatctcagcctttattttagacaaatagctgtttctaccataacattatttccttggtcagcattgacgtggttaatgatccagataccctgtaatgtcagcagatcttttttttttttcagaaattactttggagtcaatgaaatgcagccctaaaatcatgaacaacaaaggacaacaagagaaataaatcagaaatatctaatccctcctgtttaatagtaggaacaaaattaagaaggcaagggaatattctatcctacacccacagctaacattgcaccatcttttagtcctactggttacagcctgaattttctttccattagtcatatcaactaaaatttaattaaaattttgtttaaaaggcaaagaggagaaaaggtctataattatatctcggctgtcagagtttctcaacatactctttttctagtaattgaaatattttaaaggtatccttcattcagatatgttaagttagaacacctgctttttctatgttactgtctctaaatttcttttcaaatttcttttgaaccaaaaaaatgcagttacctttttacctaaatgtttctctatcaccataaaagtaagccaagtgagtcccatataactagtcggtcctgaatcaatattctatgaatgaacgaatatgctccactagattcatttctcaccagtcaggtgactagaagaacgctggtcttatgtggcaggagtgccttgagctatgtttttagtagtaaacactaatattccactcatttttcttccaactagtgtatcagtattttcctcttccctgcttcatgtttaaatatgtggatttttagctgccactatgaattttctattcttggtaaaaaattaccataaatttagcagcttaaagaagcacacatttattatcttacagtttttgtaggtcagaaatccaatgcagcatggctgggttttcggcttagctttacactcaactaaaatcaaagtgctggttgggtctgtgattctcatgttgggatcaaggttctcttctaagtgcattcattgtgggaaagtgttattttcttgtggttgtaggattggggccccgtttccttgctggctgtcagctggagactaccttcagttcctagagcctcccttattctttgcctcatggcccctgtgggctgctcagggcatgggtgtttgtggcttcttccagcccagctagagtgtcctctctgacttccccatttatgactagccagagaagtctccttgcttttcagtgactcacgtgtttatatcaggcccactcagatgatatccatattttaaggtcagctaatttgggatcataatatcatctgcaaaatcccttcactgcagcccctggattcatgtttgaataactaggagaaagtatgtgacaccatgcaccaggaatcaaccacactgctcaagaacatagactcttgtatttctcagataacgatgtataaaatcttggatgtaaaaataaagtttaaagtcggaaacacaggcaagagaaatcgaaccagagaaagatatgtatttaaaagagagggatcagaggattctccctagtcaaggagccagcaggaaaagcaggaatattcacagttggggaaataaactgcagatgactaacccttggagcacaattatctatgttagtgttgttgcaaatgtttttactacatattttcattcctgatgttgaatcattctagacacttgtttagaataaaggaaggtgcattgtgctagaatgcaatgttcccaaaaattccctgtgggaaagttggtggtggcagtggaatataaacaaacctattaaagatgcctatgtaataggacaatggaaaaactgctcctctctggcaccctggacctatggcaaaattatttccccttaatcagagtaaacctctggatgagaaaagcaatgattttaaagtcctgatgattatgatatgggtttaattaaagctgcttcttccctttaatggtttttaagatcttaaaaatcagggttttgtttccttgttagtagacttttgttttagagaatgccagaagctttgcttaaactgctgccactgcataacctgtgagctaagccacacctgtagtctcgtttccaggcatctggatgtaacacacagtgacttccttccctttcttctgcttctgcattagacgtgaaagctgtgccaactaagcacttttactttcacagctgaggaaaaaccatcatcttaaaatgctcctgtcagttgggaaagagtgatgcatacagaggaatgcgtttcaagcttcccaaccctatctaacaggtgccaaggcaagattcgatgaccttcccctggtggcctgccaagccctgtttctgggaaactgcctgcttggcttggagccagtcagcagagcgatgaagggatgcccagaaggggttctcccactgcctggctcccaggatctcaggactccagcacacattgtaagaaaacagaagtcagtcgggaggacagggatgggagagcagcttctcccatgaaatcacacctgagattccatctgaaagtcactcctgatgtcacctgggttcactcctcactgaggttttgttaacattcattgttattagcaatcactcatttatgtattcactccataaatagagacagcacttactgcatgccaagcattattctagatcatggggagaacagtgtgagtacaaagtggaccattcagaaattcatccctatttgcatattctcttactgaaactttacataaatgcatatttattttagtgtacttcttcagcaataaaaatttcattttcaatatatcactctcacctgtcgaagagtaaagcaaaagagagatagaagttggtaatagaaaagtggaagatttattcagcgaatccttttaaaagagaggttgcttccacagggtaccaagactcatcaagtttctcaagtcataaatctgggcatcatctttgacctcttatctcaacccagattgaatcaatcataaaaatctcatcagttatgctttcacatatatctcaaatctatccacatctttctgtgctgactacaaatgcctagtccaaaacatctttacctgaattacaatctaaaatggctcctaaaacttcctatcccctgagcaatcccatgcataatccccaggactgggaatttcgtggaattcactcctgtgattagattatgttacattgcacagttgcaacaaaccttaaaataggggaatcacctgggtgggcctgaactaatcacctgagccctttaaaagcagagagttagccaggtgcagtggcttatgcttgtaatcccagcactttgggaggccgaggcgggcggatcacaaggtcaggagatcgagacaatcctggtgaacactgggaaaccccgtctctactaaaaatacaaaaaattaaccaggcttggtggtgggcgccagtagtcccagctactcaggaggctgaggcaggagaatggcgtgaacctgggatgcggagcttgcagtgagccaagattgcaccacggcactcctgggcgacagagcgagactccgtctcaaaaaaaaataaaaataaataaataaataaaaataaaagcagagagttttatctggcagccgtagaagagaaaatcagacgtttgaagggacagatgaatttgtcatgccattgctggcttgaagatggaaagtgccacatgctcaatcactagatgttgggagacagctggctgacagccagcaaggaatagggacctcagtcctatggtcacaaggaactgaactgtgctaacaaatgtcttgaaagtattttttttcctcagagcttctaaaataaaactgagttcagccaacaccttgatttaatcttgtgataccctgagcagggaaccagtcatgccatacttaactccttaactacagaactgtgagttaataagagtcttgttttaagattatgagtttgtggttatttgccacacagtcataaagaactatacacagtaaagcatggacctgtgctttctgctatacacagtaaagcatggacctgcactccagtgacatctgtgagaaagaagactgctcagatatgtaagagccactgggacatatactttgtataaaattcaaagcaggactgagactgaataaccctgtaggtttagaaggggagtggacactttgttttacacaactgatgaagttcagcgctatttaccgaaaacttttcccttatcaagttccaagtcccttatcatcatagagggagaaaaaggaaccaaaggcaggatctggacaaggagcaggataacaaaggtgggagagagaagtcaaaagtcaaccattctgagtaatgacacccccaaagcatcctccaaacacggagaagccacacagggaaataacatatgagtattttctttttgagacagagtcttactctgtcgcccaggctggagtgcagtggcacgatctcagctcactgcaacctctgcctcccgggttcaagctgcatcagcttgattcacctgcatcagcctgagtagctgggactacaggcactcgccaccacacctgactaatcttttgtatttttagtagagacggggtttcaccacgttagccaggatggtcttgatctcctgacctcgtgatctgcccgcctcagcctcccaaagtgctgggattacaggcataagccatcgtgcctggcccacatgaatattttctaccacaaaatgaattcaatctcaaagggatatctaaacccagattagatcttgtcacttctctgctcagattcctgcagtggctccccacttccctcatggtaaaagcatagccctgacaatggcccagttggctccactggatcaagtctttttttgttctgccctcatctcctcccactctcctatccggttactctgttccatccaccattggcctccttacttcactgggaacataccaggcatgtgcccgcatagggccttagcactggctgttcccttcacctggaattctcttcctgtagcgaactcaatggcggacctcctcgtctttctcaattctttgctcacttgtcatcttctcagtgagctctactaccttggcaaccccatttaacactccagttcccctatccgccttgtcctattgtttgtatttttcctaaagtatttattacattctaatatacgctatgctatgtaatttacttagttgttatgtttattacaccttcccaacttgagtgtaggcttctttgggcaaagatcagtgtatgtcttgtgtactgacatatcccccatacctggaacattataagtgttcaaaaaatacttactgaattagtaaatcaacattttgagactactggggaggagctcttgaacaagaaaatgatgtcaaagatagtgtatggttcagtacctattaattttaaatgaataaaataccactggaggtctacctagtgtgttgacattaagttgtatttcagaaatgaaaaatatttatagatatcttctgggtttaccccaatgctcagtatccatccattttcacactgtattagttcgttttcacactgctataaagaacttccctgagactgggtagtttataaaggaaagaggtttaactgactcgccattccatgtggctggggaggcctcaggaaacttacaatcatggcagaaggtgaaggagaagcaagtaccttcttcacaaggcagcaggagagagaagagagcaagagaagaactaccaaacacttataaaaccatcagctctcatgcgaactcactcactattatgagaacagcatgggggaaactgcccccatgatccaatcgcctccctcacttggcacatagggattacagatccctctctccacatgtgggcattacaattcacgatgagatttgggtggggacacagaatcaaaccacatcaacccctaagtctgttttcctcttaagtgatctgaactttgacttttcttgccataaggcttctaaaaatcttaaccctcatcattgtgttagtgagggaactgcagtagctttaagaagcctagctattgaacctatgactagaaggccatgtgacaaaacccattacagagaaagccctatggatttgtgaggttttacaggggcagaaggatctcgcagcagattgaggttttcttttcctaagttatttgggagacttcagaatcaactggaacttaagagcatcattctaaagcttgatacatagaagctcctacaggagatggggagggatgattacatcaaaccttaaaaatataaatatcaaaaataaaccaagccaatttactatccaaacagctaatgtatttaggcaaaagacttttaaaaagacaattgcattttttattacattaagtgcaatgtagagtggcaccgattgtctccacttcactctttttatagcatattttatctttttctagttaaatgtattcaatgctttttaaaaaggttgttaaaatgtacataacattttaaccatttaactgtatggttcagtggcattgaatacattcacaatgttgttcaagcatcatcactgtcaatttccaaaattttctcatcatcgcaaacaaaaattctgcactcattaatttttttaatatcctggaaatattgtctcagccattcttttcagtgatggccaccaaatagactaacctctggggtatagactaaaatggctaaaagtcaagcacatggttaagtgaccttcatggtacccctaaaaaatgttcgtgaaaataaagttactttacaaaacaaccctatttgtcaatgacttgtaaaataaaagctatatatatagggaaagtttgttgttgttgttgttgttgttgttttgagacagagtcttgctctgtagcccaggcaggagtgcagtggcgtgatctcggctcactgcaagctccacctcccaggttcacaccattctcctgcctcagcctcccaagtagctgggactacaggcgcccgccaccatgcccagctaatttttttttttgtatttttaatagagacgggatttcaccatgttagcgggaaagtatttttaaaaatcattctgcaaatatgtatggatcaccctccatgtgccaggtgctctgtagacagaacagtaaacaaaacagaaaaaaacattcatgtagcttgcattctagcaaacaacacaacaatttcagataggagcaagtaatctaaggaaaacaagacagaatgataagaattgttttgtgtcttatcactgtttacatcctccacagtgtctagcacacagaatgcatttgacccatattcatgtgcagatgggttcataaaatgtctattgagtaatgactctatgcatgacatcttactgagtaccttgagggacatggagattattcagacttggagcttcacttcaagctccttgtaaatgatcataagaaacctgatatgcacattctagaggtagctatttgataacttatttagctttttccttggcctaaacccagtttttatttcatttttctttccattactctaatttcccaggccctttctaaagtctttgctcagcatggtctgtacaacttactttagcatcttcaaaatgttcagcagtagcaagaaatctaaaagcctgaattgtccaataaaggattctccctttcttcccttttcaaagccccctcccccaataataacaacaacaatccatcctcaggaacagttagatgtgtgtcaatcagataatgttggttcttggcactatctttgcatttaaaagggaaaaaatttaactggggcagcataagaaaacaaatgcaatgagatttttccattagtttaaattattctagatagtaatattccttagtatacaaatttagtaatagaataacctcaagtttacaatccaacgaatgtgttctatttattataatgctcctgattttgtagattggtagtatcagacagtggatagtggatctactatcaaatagtaattcccctctcatgctttgctgcataaactgatatctgccctatcaatctcatgagccaaatgtcattttctgaaggaaaaaggggttacttataattatggtagttacaaaatcaagtatatatatataacatatttaaataaattgtcggtagctgtttttaaccattgatggtgttgggctaggacgtctgctttatctccttgtctgtcagaaattataaagttctatttgttcaaggtgaggagagcatagtacaaaagatattaagtggcttcccttgggtaaataccagataaaatcatgtaattaaagagccttacttctaacttcccaatattatccaagtgttatagtagacagtcagtgtcctacaatgtctgtcaagccttgtcaccaaaaaacactggaacattgagaaaagcatgtggaccagcaaacctgctgtaaaactgatagtaatggcaccagccctaagcagcttactttctcagaaaaataatcagcctttttgatataatcaagtatgatacattttatctttcaatttaaatagtgctaaataaaaaacaatgatattatattgtggagaaaaataaagtgagaaaaatttatgtaactaaacaagaatcagaatctgcttcaaacatggtcataatcatcattttcttctcatttattgttctgggaggattcagccaggaatagacagagactttattaggatcagtgcttagtctgtttccccaggaagcagacctcaggacaaaacttgcatggaagcagctcactgggatagtgaacccagaacaaactgaaaccaggaagggaggaaagctgatagacagtgcaggaatttccaagaaaccttgtccaatgcactccagaactgtccattcaggagacaaaaggagagagttctaacctagctgctctgtcctgcattggtcaatggttgcctacaggagttaatgtcctcatgcttctaggttgcacatgtgtgagtggtagctaagttccaggtgtttgtactgagatgtcagaggtattcagaaagaggctgaggccagccattgtccggttgcagctgcatcaacctggttaaaatctgtgtggtaccagtcacgtgtgcaggggcaggagaaagaggcagggccaagaggatttccaaaggtacacaagaaggatctgaaatatcactcacttgattttcattattcagggttcttcatcactatttttcatgggctttttaaaaaattttgttttaattgaaaaagagtagtatacattaatatgtatggagtacaatgtgatgttatgataaggtagacattgtgtaataattaaaacaggctaattgacatatacatctatcttacatacttatcatttctttgtgattagagcatttaaaatctaatcttttagcaattttgaaatatacattattaactttagtcaccatgctgtgcaatagatcactaaaacttatcccattggccttaaaagttttttttaacaaaagatacactcctcatgttctttatactatattgatttatggatgacctcactcaagatacctataaatgacctgtactgctgattaaccacctagagatctcttcatcccaaattctagtcctatttcccaagcaattttctatgcactagggagctgggccacagctattttctgaatgaatgaatgaataaataaataaataaagtggattttctgttatttatttgtatttattctcattgcacagagaattgtatagatatatagtacagaatgaatgaagtaaaagtaatgcagttgctacttactcacttttttcaatggccaggtatacttcatctatttgagtttatgttggccagatgggcacataattcagggtcagtgagttcaaatttctaaaggacaagtaggagacagttcctcatggctgccagccctatcggtgctctttcagaatgtggcctctggcttctaggattctggccacagttcaagttactgcataagaaataagaaaggttctgtggaaaactatgcccaataaagccttgtggagctttcttagaacactgaggtaaagggaaagcttctaaagattatgtgtaatgctgggcatccagtaggtgccctactctattccattcacttagcattattgagaacccagtttgaacaaggtattatgcagagttgagaggaatgcaaagatgaacaagacatagcccatgccctcaagatgctagcacgtagttctgtggtttttaagtttacccccacgtatcttctggagaaactgatgaaagccatggacctatgtttcaaaatatacatgaccctgagcataaaatttagctcatgattttatattaagtggaatttataattccaattatggaatgatataaaacattcaggaaaaaacttgtttattaataactatggaaaatatgtagtgtcataaatggtccaatagatatgtgaagtgctctgggagcaacaaaagggagaaagtaatcctacctgagggtataagaatgagcatcctcagggacatggcatgtgagtggtaccttgagggatggtgattgtagggcacacctggtggagggagcaggctaagtaaaggcacatacaagaaagccaagggaatgtcctggaatttaagaagtccagtgtggctagagcataggactcttggaagaagctggagaatagtgggagatgggactacagactagtagactgaggtccaaacactgattttcatgcttagcctgttgggttttactcaataggcaatggagaacggcatggccagagcagaaccttataatatttcttaggatagatagaaagagacagaaagtggaggtgagtaggaggctttcttctaagtagaaggcttttacaagcctagattagggcactagaatgtagggaatgataagaccacattaaagatgtgagctctaaaagccctttataaaatgactgtccacaggagaaataagatacaagattttcttgcttctaaagtgattaatattctgaataaagttaaacactggcaatgagaaattagttatcattcagatctgtcttttcatttaccttctcttattatttttgtaatccttggtataatactttaaaaataatgggcttaataaatccttgttcaattgaatgtttttagatttaatttatagtgtgacagctactgagtcaacaattttcatacctcactttgaataacgattctggtctgcagacacaatttaaggaatactgaataccttttcctaataggcaatggatgtactaccagggcctgtgaagattggcatgatattcaatttgattttacaccaaaaatatgttgtagaccttttcatgaaggtttattacatcatcttaaccaggaaattaaagtgaaactaaaatgttatctctgtaagacatgatgcttctctctaaggatccttagcaaagagaactaccttggagataaaagcatgctttcagagccagaaagacgttgagattggaagcataaaaacgcctagtgagctactcagctgttgtttgggttcacattttataaaggtatagctcatgctcactaatggaaaacaaatctgaagattgtgcctttagtaacattttctttctgatttcaatgtttggttaatgtgggtgatggcggatagcttcagtgtaatcacataaaaatgtatctattgaccctggaaaagcataccatttaattgagtccttcttccctaaaagatttttaaataccattttctcatgataagaggcctgaacaagggcataaaaataaattatttattttagagctcttaacaactaggtaatttgcacctggctttcttggccacagtgctcccaggaaattcctctgaatcaaaggagcatctctattcttcctgtctcttgtctaactccattctttaagttgtgctccatagcagtggttctcaaactttattgtctaacaaaatcatctaagaagctgattatacctagggatgccctggccacactctagacctatggattcaaactcgatagtttgagacccacttatggctctaaagaacagcccgggtttccaccaccatacctcttagctttagatggggctctgaattaactcacatagtagtctgaaaatgaaattaaacatttaactttaggagattcaaatctttaataaaatataaaaacaaagatattccctcattgaaaaattaagagtgttatatactgggcagtataaatgaatagttatagaccctgctttcctctaagctccaacacaaatttctctggttctaggtcaatataaaatctaaatgcaccatcatcgttctttgctctgtgccattgctcactgaacccacttcttcctggaatatccttccctccttatccccatctatgcactttctgctgtgttttaggaatcaacttgagccttacctcctcttccaaatctttacatagtttccagcccataaagcattcctgtattttgagctcctgtagcacttttctttttaatctgcactgtggatgtgggctttggataacacagtgtcttgtggtgatcttcagttaggtcatctgagtgtgtctttccccatgagacttacaatcttttttgtagtcaggctctcatattttgttaaatcaccaataacatcaaccataatgcattgtagagccttaaaaatgctggttggatttaatttctttgaaactattatggaatctagctgcttgttccatttcccaactctgtgtgtatatgcatatggcaatctttctccatatgttacagcctgcatgtatgattgatgcatggcaactagtgatacactgaaatattcttttttttttttttttgagatggagtcttgctctgtcgcccaggctggagtgcagtggtgcgatcttggcccggtttcacaccattctcctgcctcagcctcccgagtagctgggactataggcgcccaccaccacgcccagctaatttttgtatttttagtagagacagggtttcaccgtgttagccaggatggtctcaatctcctgacctcatgatccgccctcctcagcctcccaaagtgccaggattataggcgtgagccaccacaccggcccctgaaatatttgatttgaaattgaactaaactcgtaatcactgtgatacagtctctcatggatttataacatcatttcatccactaaagggaaaacaaacctcaagttatagaagaaagctcatattaagggacaaatatatttataccagacagagtgaggcaaagaattgaaagaatttttgtgagtggaaaatttttataattctacctgaatatgacagtaaattttaatgcctctctgtttgctctcaaaaataagaataatgcctaaaatttatatagtactttatattttactcttttcccatgtacattttcactgttcctcagaactctatcagaaaggatattattattcccattgtacaaatgaagaaacacttgaatcccagtgtctcagttcatgtttctctataagagaatataaatagtatgtatatataaatgtcaaatcccattgtatacctctgaatatatacaatttttatatgccgattgaatattttgaaatctaaaaggagagaaaatagattattattgcatgctcaatgcacttatttaatatctctatctcctccctctccgacacacatgtaagttctgtgtgattagggacctgtctattttgtacactccaattctagaaaccagaacagcactgcaacacaataaggactgaataaacacttattgtatgagagaagttataagactaagatggaagactacaaaatgcagccagtgagcagcttagggtaatgagtctcaggaacctagtgtcactcctgacattctcaaggggctaagttcctctccctacctcctcacaccccagttctgtgaagcctggcccacatgtgagctccttaaaagcaattttttcttaaagtctacttggtgcttagaatactgaatgaaactttccatttgagagttgtcgtaggaacaagacaatgcttatatgcgtgttcatctgttcattctaaggacattggaactttgtttgataactaaaagaatgagtctccataattaacttttctacaagctagcaaatgtattttaagaatctgctatatgaaagaacataatatggcacttcaaacccggtgtgtaaactaatcagaaatactacctgaactttgttcttgtactctgaagagtgtaattgcaatggaaattcatgccgggaatattgcactgaaggtcaggaaatttacatctagggaggggagaactgaatgcattttcaggagaaactatttatctttgttgctatggggattcctgcatatatctgcatatctcaaagaggggaaaacaagtcataacagaaacctcagacaccagtcaccctcactttaagcacggagggcagggtggagattgagggagcatgcgcatggatatacacacacacacacaaaaccacacacaacactgtctacgcacaagaagatatatgtattcccaatagcagatcaacagattatatccaatttccagcataactacaatttcctgttctcctaattaaagcacatcataatgcaatgagtgaccttcttagggattaagcctcaaacccttctaaaataatatgtatatatatccttatacaaatcactgttaaactgcataaattaatttatggtaatcagcttcttgcaatacacctcacaacctacgaagacatttcaggctgtcttgatgccaaaggactgagaactactgacttcaagaagcgcttcttatacttaaatgtgaatacaaactgcctagatatgttgttaaaatgcagattacgattttctaggtctgtgtgggagcctaagagatgcagcatttctaaatagcctgtgttttgttactacaagtgtgatgttggaccaccagtatcaccaggaatccattttacatccttgcaggtgattccattgtgaagccacagttaaggatcactattccataatgactaaagctaagtcactataattgtctactgacctttctcagctgcaagccctttgaaaaccttctaaaagtttataatcagtggttgtcagaatcacctggagagttttgtcaaaacccttttccactcttttatattttggactcaggaggtggtagagtctgggtttgagaattttgagatcatcaaatgctttagaaaaagaacatcatgcttagattcagaaacttggacccagcctcagggattcaagaaaggctggccctggataaatcataaaatagactaaatcttgaagttgtctttttgatatttttctcccccatattttatctaacttatatgattctactatttctaataaagtttatgacatcagccatctctatctagatataactaggtttgtcattttagcacttttcctacggatgcttggatttaagtcatctctgtgaatgaaggactccatctcccattaaaatagtgcaagatgtcagaaaacacattaaaaatatctcttgagataaacaaactctcctttacccatctgcaactctccccccaacacccgaacctagcccttttctacctgagattgcctggatttatagaaaaccattgaagctttgtctatttccatttatgtatgtaaagacaaatcttaggtcttaataattaatgcctgaaatcaacactattatcgttacttttaagattccatgaagaactaaatattaggttaagaatgcattttgtctattctcgatgtggttattgttaactaaggaatttcgttatgcaaaccgttgcctttcctagtatattaatgtaaaatatatgcaactgtatagatgagggaattcctcctatctcctgtgcctagtagcaggtgctctattaatggacgactggtttgatagctatttagtaaaatgcgcgcagtgccatctagtggttcatagtcattattacacaacctaaatgtcatctaaaatgatttaactagcacagcagtaagcaacatatttatacaactgtcagacttttaaaacaaacttcttaataacttcttaatgaatctcaacttagcatttctcagtgtcactatttaaataaacaaaaggcttatgttacttaaatttctcaataactaatgtatactgaatgcttattatacaatgcttattataagcactatgtggagtgctttatgtgaagtatctcatttgacccccccaaaacaacaatgtagtagagaaaatagtattgtcctcattttacaggcgaggaaactgaaacctaaggaagttaagtgacttgcccaaggtcatagggacagtcagtaggggaccccagccactgccccggttcctgcaccttctgcactatgcttacacctcccaaggtagtcgccaatgaaataaagtttccatgaaacctttgtgaaagatagcctcctcaccaggtttctaatgacccgatatggtaaaatcaacttaaactccactaactcaaaatttatgacaacaaaactaagtgtctgcttttgtggctgcaatgcactttgtgattcttttacttcacccacataatacgtcatcaagattatgggttgattaatttattgaaattgggatacttggctaaaatttagttttggactcacagatcttataaattagtagtagaatagtatggctttagatcagagtgtatttagttattttatcacaaatagctcatttcttgatcatctattatgtaaatacacgttctcttttaatctcactataactgcctctggatggcattcgtttcctcattttaaaaaaggaataatacaatgtataaacaaaatattattacattttatttttattaataaaatttgcccagttttgcagttatttccagagccaggaatgaaaccttaatctctgtggctgcaaaatctgaattctttccactatgccaccactggaaaataaggggtacaatgtgcgtgactgcagttttttctgcatagtaccaccttgtagacaaaaataccaccatcccttactggaactaaaacaatatgctccaactacttcccactgtgtgcctgtccgtctccgctcctttcttcccttaaagtcagaaatgacatttttaagctgcattcctgatcatgttgctgtcctacttaaaacccatgtcttcatactcagcataaagagccaaatccttattgtagttatggtgctcctgcaaccttatcttgttctggcccaatcaagaccatatcgtaatcccattttatacctagcatgctatatgtcacagtatgtcactatttctgatcacccgtttgtgtgattgtgtgagtcatgtctgtattcccaccagactgttagctcccataggcaggaaccacatctatattgtttgtattgagtcctcacaatctaccatagtgtttgcatataattatgaaaactagttttacttaaatcatttttaattatctattctcacagttagccagaattattttatttttcatgaaatatttttcttttacgttccttatattaggaccttcaatatgtaagcacataaatgcagcatatttatgtttaatacctttcatataatttctaggtatttgattataataataaacaactattgtctcctacatgacatgccctattccaagtgttttacaggcattattttattcagctgtcatagtaatcatccgaaagtagatgctattttcagttccacttttctaacatgaagattcagagaagttaattagactgacagtatacctaggattcaaaccagtgtctctgtgattcttcatgactatgccttattgcattttagaaagcaaatgcatccttagaaaaccctgtttcactgttgagtcatttctttgtcattctctcatttagtcaaaagacatttaccaagttcctatgtgtaaggatgtgtaaggcagtgtgaggggcactaggggtgtgaacagttatcacaatagacacagccttgtcctgtgccacatgcaacgcagaatgggaaacagacaaactgttggtctacacaagagtgcccactacatgctgtgatggggaaggacagagctctaaggtggtgcatgcaaggggtataaaacccggagacagggtttctgatccagcccagaaagatatccttgaggaagtaatgttgacgccaaggtatagtagatgagatgtagatgagaagtacacaggggctagatgaaaaaagaaaagaaagaaaaaaaacttcaatccttgtttagatttcaaattaatgggaagttattaaaggactttaagcagcatactatatatatatatattttttttttttttttttttttttgagacggagtctcgctctgttgcccaggttggagtgcagtggcgcaatcttggctcactgcaagctccgcctcccggcttcacgccattctccaagcagcatacaattttaagcagcatacaagtgatatgtcaaattacggtttagaaatcacactctggctgcagtgagtagaaagggagtacagaaagaatgaaaaaagaactgactcagccaaacagtaagcgtgatagcattgggtaacgaaattgggtggtggcaataaaggttcatggaaatggtgggattacagtgatgtttaggagatatacagtccataggactaggtcattgatagaacccagaaagtaaatctccctggagggagaataggcagcgggaggatggtggcattcaccaaggaagggaatcccagagccggcaaggggagagatgagtatgggctgctcaccctgaggctgaagtacccaaagaacccttacatgggcatgcctatgtgggaacccttatgtgggccactcctgtggtcactcccatgggcctggataattccaccactgggaattctaaaagggtttcctattccttacaatggctcgtcaagagaaatttaagcatccagattccctccctttgccaacagccatttagctttcttgacatatacccatctccctcccatgctcaagttcccagtccatgctcctctccccagatgtctgttccacatcatccacaaccaggaactaggtgaggataggtcacagggaccaagcaggacgacaggctggatgtcatcagcactgctttctttgcatcctgcacccagacacatcctgatgactagatccagaagattcacagatcaaatctatagggagtaattagaggaatcccagctcttcccaactagaatttaaataaataaataaatttagtttataaatgccatttccctgggagtgttttgcttgctagatagaagagttggataaataacaccaagaaatacaaataatttccttgttgattaattcttgatatacagaaaaggttgcaaatttgaaatcacttaaatctgaatttttccaaaactaataaatatttattttagttggtatgtgatttgtactcatctgctccaaatcagagatatattgcaatatatttttcttttgacatgactcacattatttacttgttcatctataatgcattgtctgctaggtaccaggaactaccactttttactctatgcatttttccattttaggaatgccagccccatttcatagatgaaggaagtgagactctaagtcttagaggtcatgcacttgtcgtagaagagccagatttgcaacctaggtctttggactccaagtccagtgctccttgagcacaggtatcttcccttcataacataaaacattattttgagtaattgttaaaattaacagcaaaaatccaagtaaaggacacagtaacggttctatgtaacctgttgttttttttttttagtttaaggatttgcataatctactcatctcttggatctcaatgtgcacacaaagttagttatgagaaccatactttaggtttttgtttttctttatgcctaatttgaaaataagaatgtctgaacagattgctctctctctcttagggttctgtggttacagatcctgcagttaaacctagcctgggaaaagggtctgacttcaaaagactgttggctagttggctcatttgttattataatggaagaaattggtgacaagttctcctataccaaaagtcagaaaccatagatctgttctgaaaagcaaaagtaagagagaagtcaagaaaaaagtcacatagctcaattcatagtagaagctgatgttagttttgcttattaggtatatagccaggagagagcaatgaggtagaagacaaaaaaatagggagctgttagtgaaaaaatatatatacagtgcatatttctcaaaaacggaaactgttatatttcattgagaataaacaaaatatttatttgcaaatgcaaaagcataatgaaaagtcaaccttaaatggtgaagatgtggaggaactggaactctcgtacactgctgatgggaatgtaagatggttcaactacttttggaaaatactttggaactttctttaaaaattaaacatacacttactgtgaaacccagccttttcatttctaagtatttacttaatatttttaatgattttaatattttgaatccctcattgtctaagagaaatggaagccacatatctatacaaagacttgtacgtgattgttcatagcaattttattcataaacaaaaactgaaaaacaacccaaatgttcatcaacaagtgagttgataaccaaattgtgatatatccatataatggaatactactcagcaataaaaaagagaaaactattgatactttcagcaatacatgtatgaatttcaaaacagttaacactaagtaaaagaatccagacccaaaaaagagtgtttaccatatacttacagttattaagaactgaagtttgcaacagaaagcaaatcaatagttgcctggaacagggaatgaggatggattgcagaggagcatgagaaaacttttgagggtgaggacgtgttctttatcttggtcgtgatcatggtttctgggatctcataacaagacctcagggcaaatagggaagaaaacagaaacagctttcttgactaccctagtgaaagtaaccatgacttaaatcagctggtaataatgtagccaagaaacttcttgttcttgaccagcctagttcagtgatgtgtgacttagttctgctgctgctgcagtgtatacataacttttcctttttaccttgtcttcctgcctaccttaactttctttttttttgttgtttccaacagcatactactaaaaaacacataaataaatgaaaacattttaaatactcaaatataatttggacatcctttcaaacactagaatttaaatgttggccttttctttttgagggggcagggtgtgcaatggggaaataacttttaaaccgatagacttggatctgaatgctagtcttgccattgactcctcttctacttttgcatttgtcagttcagtttccagatcctcagttttcttatgtgtaacacagggataatagctgtatttcaagagtgattgtgaagattggaaataactatctattgtggtggtcagtaaatcatttgcttgctattatgtaatgcacatcaagtcttagagataatgcacagcctatgttcatttacttatgttgaccccctgcaacagctgcacacatgtgagatacctagaaaaaaacaggacagagggtcatgtaaactgatgtatttgccttccattactttgggctgatgtgttaactctgctttaattgtagtgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccgtaagcaccctctgaatgtctgttcctctctacatgtttggctttcacttcctgtcttacttggtctttttcccaaacaattttatatctctctctttttttttttactctcttttttcttacagtggatgcttatgtcagtaaagtctccatgtgtttaatataaattttaaatcctgtgaaaaagactagagagtaaaatggtgccagaggaacttgaggacaattgtattttatgtgctgacctttagttatctcatcccatgcttcctggaagctgtggatgcttgagaggattgcctgtggtgcgatttaatgaagcgtgaagtgggaggatctttttaactctcttctttgcaaattgtttaagacagtgtttctgaggtgtcctaacaaggccctacagcaaacaagaaagaaattgaaaagggtttcttgactatcccagtcaaagtaactatgacttgcgttaaatggactggtcaatttaagtgtttcgatcataaaataaggggatgctgtccacagaccacaactgaagctcagcttcatttttgtataattttcccttttagaatcagagaatttcagggctggctgagatcttaaaggctgttcgtccacatatctcattttacagatgaaggaaatgaagcacaaagaaattgtcacttgtttggtgtctcgcagcatgttagtggccgagtggggacttaggtgttcaacaaaggtttctttaccaaggtatatgtggattcccctgaattacattctcagcctacaatttcaagagggctttttgccaatagcctccaacctggacgtagtaccaccccctccacttccactgcttgttttgaatattaaaaaggaaaattgctaacctgacctttcagcaatcacattttgagattctcagaaggttttacttagtctcattgtctggccaatgcttggaagtatttacccccgcagtggagatgttccagccaggctaatgttattttgcaattcacaaaagctaccagctgtcactttgcaacttagagtgttaacagaatcgttcctgctcagtttttccagtgtgcattattgtcttcgtgatatttatattttgagaaattcttcagttaaaataaacaattttacaactagcattccaggttggtagagtctttgcttcggctgtgcacacttcagaacgagatgtacagctctagcttaatcactatagtaactggatgctggggcaggtaaagaggactgtggttccacatgacaggcagcagaggcagcagaatggaacctggccatggcatttctgtagtggcatttctaacctggccctgtgacaagagtgtggcagctttcagatttgcccctaaagatgtcaagagacttatttgttagaaatgtaacaatggaaactgcaaaaagagaaatataatatctcactaaatcctggagtactgctagagaactcataaagaatcaaagccaaataatcatttgcacccactccataaatatagaccagaaaccagactaacaataaggaagggggtattttgtgagatatataggattcacacaaatatagttagatttttcacttttggtcagaaatatttgctagatcacttctaaatatagagctatgaacggtctctaaatagctgctgaaaatatagctgaatcatttcaagattgatgaaaagctaagtttgacatctattccaaggtaaggaacaattcacaaaaaagttcagaagaaatctttatttggtgcctattcttcgtatagataggaagcctcctgatgtgtactttcaataatctcactgtagtagatttataaacacatccacatagacaaatttcactgcaaagatttataaacatatccatgtagagatcctactctgcagacacttctgcgtttgctccttcagcgtagcaaatgagcataggcagtcctactgacactcaaattttccatctgatggcatggaattttggatgtgaaatgtaagccatcaggaagtacagctaactggatatgtaatttagaagtgaatataagaagagaaacttaagaataaaataaatgttcaaattctatttcttataatagtaaactccaatttatccaaatgagacccagcgtggaaatctgatgccacttcctaccacctgtcccacgacagagtccaagtgtttaagagaaccgtctgtattttggcagacatgaatgatcctgatactactaaaagaaagatgtgctgttgctattacagaatcactgaaacatttaggagatttttctcccatttgtcgtattttaaatggacatataaataaacagggaaaaaatccaaaataaaaattagagatgccttaagaacctagactctgaagaagagttgctaaaaataaataaataaaaaagaaaggcagtatagtgatttaaactcatgaagaataagaacttggattcaaagaaacttggccattttgtgggggaggggatggtgccttaaaattcactagactcccaggtagttgaacttcgtgaagaaagtggtaacctgagatgaggattgatgcctcctttactgggatgtacttctgagagccagacttaccttcgcacagccatagctccccaagaatagcattccctctcccaccaaaaaaacatccggatctcaattttcataccaggatgcttactgcagactgtaatcagtttcctggttgcaagatttctctctgctcgttggcaagtcagcctctcagaagatatgataactacatctgtagatgatttgtacaatgttgggggtgggcagtggaccccagtggtttatgctcatgcttgccattctgtccctgaagacacagttccttgagtccagaagatttttgttttttgtgacattccttttaaaaatggctgtattcctgggagggggtcacccagggagcagttaccaaccaacttctaagcaaatctctccacggccagaggttatcttttttaaggcgtctagtggaatggatgagtgtgcctgagaaggatgggaaaagagatgtcagaaataagaccaggggctgagagggaagaagatatgtgagggagcagccagaacttgagccagtctcttcctcttgtccctttcctccgatcaccccaggaactggcctcccacctccccttctttgctgccaggagccttccgctcctctgtctcctccagaatccccccagcaaactggcagcagcttcttctgtcacctcttgtccatattctattgaggagggggaaaactctttgaagtcttcaaaggacctttaatgttgttcttattattttgtaggaaatagagagtaactcaaaagaaaaatattgcagaaagttaaaagatgaaaataattcttaaaagcctataatgtgcagcctttttgagaggtgcagtcacaaactctgaggttctgtgaagcctttcgcctgtcatggtcaagttgatcacctttccacaggtccacctctccttgcacctgattctgctattgtcttatagtgcatgtctgactgtttatatgactgcctcccaaagacttctttaggaaagaaccatattttattcttcttatgaacagcacctgagaccatagccaacacaagaatgaatcaatgaatgaaaatccaaggttgatctttctgagctcttgtcgtactaatttcttttaactatttttttttaagaccgagtctcactctgccgcccaggctggagtgcagtggcacaatcttagctcactgcagccttcgcctcctggcctagagcaattcttgtgcctcagcctcccgagtagctgggactacaggcgtgcaccaccacacctggctagtaattgtgtttttagtagagatagggattcaccatattgctcaggctggtcttgaacctctgggctcaagcaatccacctgcctcagcctctcaaagtactgggatttacaggcatgagccaccatgtctggccagttttcttttaattctttttctgagattaagtcttccttgatctccaatatattacaaagactagcgggtcccagtcacctagattcagaccctctatttttacttctgctccacagaaaaaaaaaacaagtgttcatggttaccaatgttggtgatcctatttttacaaaagacttctatgtactcctctcaccttctccctgcttccccaggaaacactaaaaacaagttgtcttgactcaatctcatttcaattcagtagtatcttctttcgtaagacagttcttcataaagtagattatgtgactctagccttgtttttagcaaataacattatcatatatactcagtcactcaaaaatcatagtatgacagttaaaaatattaaaaggaacagtgattttcctattttcagaggtcaagctatagtcttccatgataatcataataattgtattaaaaataagatgtactcagtatttactatatgtcaatagtcttactgacttggccctatattatcatgattttccagtagaggagatagaaagaggttaaataatttgcaggtcatacagcatcatactaaatgaggtaaatgagggaaaactcattttgtttcaggaactgttttaagctcagctctattcatgctttctgtttcactttttaaaatgaaaattaattaaccttttttctcccagacttgttttgcttattacaggatattattctgatgcttacattcctaatctttccagtttctggtatttatacacatttgaaagagtgtatgtggaagaaatatttggacttaacatgttttacattgtagcattaggatcagttttatgacagctacccagaactacaagtccatcacataatagtcttacgtagagaatacaaaatcctggtattttcctccctgtttgccatattgcaccttactgggccatttgaacacccatgcccactgctgagccttccaatgctacaaaaaagaccacagaactatttcaaatgcatggatatgaaatgcctggtactctgccaaaatccttctgtctttcgaatttaaaaaatgattcgatatttaatgcaaaatgtactacaaagtacacaaccatttctctgcaccaaaaaaagtattgttcatgtttgagactatgtagatttgtgaaagcaaagaagaaaaaaagagaagagttataaaaaaccaaatgttcttctcttttattatctatacagccaagactagatatttaaaacagtgtttacttggcgtggtgacttttttctttgcacgtcttaaatttcaagatgtccatagaacattctcctctactaactaaaatcttgttgtagtgaaaaatactttgttcaaaatttctacatcctgctaaaatggaatcactttccaaagaattttcacagctgtagatacattaaatatcctaatgtcactcgttgtttatctgacatactttgaatgagtagcaggtagaatttcaagagagatgaggaatttcaaggggtatgggggcattccaacagtattgaccccttctgttctggagaaacccctagcaaactcacctgccccggcgctataaggagtacttttcccagatgttttgctaacattgtggagggcccagagagaagccagatccaaataaagggtttctgtctgttcacaggttaacttcactacgccccaaaccagagttaattatgcctgtgaacacttctaaattcaaagcatcacataactgcacaatctaaaagaaacagccataaagccaatcattatcatcgtattcaaacacgttatatttctcaatataaatctcaagtggtaaatcagaaagttgcttctcacttgtgcattcattaattgaactgacatatgtaaagagcttgctatgtggtaggtgttatgataggctgggaataaatgataagacaagatgaaatgagatgagatacccttggaaaatgggttgtattaaaattaactgtttctgaccctttatctccaacatgttgtgagcaaatgaagagtagagaccacacctttttcatctgtatatccccaacctctaggacaatgctaatcaatatttattgagtgactaaatgagtgatccatatgagcaaaataattttcagataaaaaatgtgttatagtagaggcatgttgtggaagcagagggaggaagcaattctctccgttaattaagccaccaaaatgtgtgagaaagagcagtttgagtgctgtgcctctgcttatcaaaaatgcttaccaaatgtttttgtgaaatatgttggtaaaagaagagcttctgattttagtactcttaaatagagaaataattccttctgtctgtttaagaaagaatcagtcagaattgaatcttacttaaaagaacttcaagtttctcatgggattttgtaacttcaaacaggaaaccctgttggcaattcggagacaatttacctcctgtacttagcatccagccctaccgatcaatatctatttgttgttttatcttcttgtcaaaaacaaatattctcttccctgcaacttttccatataaataatatattcttagttggaagaaatcagtatgtctctttataagattatgggaaacccagggcagactaaagcagtttctcacttctttattatgacaagtcaaattttgaagtaattcaaatttttaacataaaacaccctacaaatcactatatatattttaaccaaagggtaagtgccttcctctttccattttcaatcagttgtcccctagaataacttgaaaagtctcagagtgagaaaacaaaatgtaaaggaagataaaagatttcaagaaacattgatttatgaagccatttcagtttgtgcttttgataatttgcatatattagcctggttctcttaaataccttgttacatgttaattatataccaatacacaattttattgagaatttttgaatgtcgatctagaacaagaaagtaaagtttgtataggcaaaagttccagggtaattggcttagaaacagaacatattccactatgccaaaagactataatggagaaaatgaataaagtatgtattatgcgctgttttctctctgcattgaaatggaaaacattacaaacaaaatactattattttattttaaaaataaaataacttttttttttttttttgagatggagtctcgctctgtcaacaggctggagtgcagtggcgcgatcttggctcactgcaatctccgcctcctgggttcaagcaattcccctgcctcagcctccgaagtagctgggactacaggtgcacaccaccatgcccggctaattttttgtattttagtagagacgggttttcaccatgttggccaggatggtcttgatcacctggcctcttgttctgcccacctcagtctcccaaagtgctggaattacaggcgtgagccatcacccctggccaattactattttaataataaaatgatatactaatattaattctttaagctttttctgtgccttttatattaccaaagaattaactgtactagcagccttaattcacaaagaaagacttacatggccatgtgattgaccacatcacagactcctaaggctgatcccgcccctaaaagtctgtgattcatccagacttgtgccctgtgatgcatccagtctctcaaacacatctggctcttttatgtcttgagatggcagtcagaattgcacatgaagttgaaggcatactgccatggcttttcataaaagcaagagaagtatacagactttttctgtgcacttcctgatgctgccccactcccaggctgtttggcctgaagttttagggaaaatctatgtttttcaacctcagcacacactggtggttggcttcctgggttgcagctgacagccagcattccatcggtgcagttttactaccttactgcaaaggcattgccagagacatagtcattttggagcaatatgctgctttcctgctcgtttgtacaggactctgaggagcttcccattatccatcctcatgcacttgtctttctgcttcctagacacttaacagattttattggctgtttgtaaatcaaactggtcccaactaatgacaattcctgatgagcatagctcctaaatttttccatttgggatgtatcagcttttctctactccttgcttcctgtgttaatgccagtgccttttttcacaatgaaatagggaccctggtcccatgttttgctcaaaatatgggctgataaccagaggaatatatgctacctaactgtggttggctaactagccaacagaagacgcttttcactttgggtttcataaaataattttgtgcagaataatctcacagtctctataatttatttaaacaaatcttcagaaacataatttttttgttagagaattcctgaatttgaaattagggtaactatagggactttttcatcacaaatttttttcaaccattatttcctactcacaatacaactgtgcttatgtgatatatttactcttcaaaaaaagctgatattttttaaaggccccctctttaaaattggacaccctcctcttcaccctgttatatttacaaataatgttcttttaaaaaagatccatttgtatttaagtctttagtgctcccattctctgttgtagagtcagtcatctctgctcactcctcaaaccgcataaatatttatccagtgcctgggataagcaaagtatgaactcacccagttttggtgtgcttgccacgacctaaatccctgcatacccccagaatccttcttcatgacagagtcacatttgcaatctggcacagtagcttgcataacaatagattccagtggcctaatttcacccttgagttcctgtaaaaccctcattcggctgccctccacttggtgatttatctagatttattgtgtcaatttggcagaacagctctgatataaccactgttggatctagtatcatcaatcttccatttccaggaacaatacaggactggcaatctccccatgatcttcttcattaaaagctgaggtctaagagtacacctatgagctatcattgtttcatcctttggagaactctctgttccaaaatcattggtggtcaatcctctccttttaaataaattattctctcggattcattgaaaggaactgtattgctcttgaagcctcacatataatgctcctcgatttctttgcattttgagggccacattattgctatgtgattgctaatcttccataccttgtagactttactgttgtcattatttgaaccatgttacagtttaggaaaaaagctaattacctcctgaggtcaaatgtttgatacttccagttatccatgtaatgggaggacaggaatgcttttgaataggctggtttttacaaaatcattgcatttctattacagctacctgctctaaaattaataactcactgagtggatggacactcaaaattctaggtgtaatttttataatgattactaatcatttcttaatataagaaatgtattagtcactaactctgtgtgagaccaagtgctaggcactaggaattcaagtaattcagaaaacatcatctctgcactgaaggatctcacaatgtagaatccagtcacattgtggacatgtaaaaatcacatcaaggtcattcattgtgacagatgccacataataagtaaaaagtgaagggcagagtgatttcctagacatctaggagaaaagctgttttcagagcagggtgaataatgatattgagtggcatcttgacaaatggatgggagggttgtgggcagaccatgttaggagggggaggggccaggaggcgttgaacagtttgaccatggtgtgcagtacaacaacagaaatggtagcagaggagactagacgagactgctgggtgtgccatgagcaaacgttagaacttcgtcctgagggcaaaaggcggccagagggttttaagcaatgaaataatatggtcaaatttgtgatatgagtgtgcaagcagagagatcatttcagaggttatgaccgtgttaaagcaagagctgatggaagcagtgacagtgggaatgaaaagaagggaatggattcaacatacaggtaacaagtctagctgagtccttcaaacatttgttcggagtggtagtaattaaggaagagcaagaaatcaaaggcgaccccaactcaggattcattttcaggtaactaggtacatggtgtttctaataaccagcagaaggactgcaggaggaacagcaggttagtactacggtgagtctgagtattatggaagagctctgtaaagataatgagttctcttttgaacatacttagtttggcatgaggtatctaagtgaaggtttcagataaatgattacataaatctggtgctgaggcttagaaataaatatgaaagagtcactagcatagggttcagtcaattttgcattctggctggttgtatttgaggtattacactaaaaatgacagcgacagtgataaataacaaatgatccctctctgaaacctagtaaggaacaaaaccacgattatttatatcttatttttcttatatataaggcatatgaatcttattcatataaattatttattccatgtactaaagctttgccaatacaagctttacttacctttcagacacattattattttaaataactcttttgaccattcttaagattagcaactatcaaataaatgaattactaatatgatacagtttctgattccaaagtataagaataaacagttgattccagctggaaaatcatttagctgaaacattatactttttatcatatcccctttatatcacatttgtgaaggacagatttgttatacttcctgaatcaatgaggatttggcagcacttgtgtcatttgggtagaaagaaagtgttcaaacagagcttttactttttttttaagacagagtctccctctgtcgcccaggctggagtgcagtggcacaatgttggctcactgcaacctccacctcccgggttcaagcgattcttatgtctcagccacctaagtagctgggattacagacgtgcaccaccacacctagctaatttttgtattttcagtagagacaggatatcaccatgttggccaggctggtctcaaactcctgacctccagtgatctgcccacctcagcctcccaaagtgctaggattacagacgtaagccaccgtgctcggccagagcttttacttttgcccctttaaaatagcagctctctttgaaaagtaaatatatcacataagcacagttggcttgtgggtaggaaatgatggttgaaaaaaatgtgtgatgaaaaagtccccatagttaccctaacctcaaattcagaaattctctgacaaaaaaaaaaaaaaatgatgtttctgaagctctgtttaagtaaattatagagattctggaattattgtgtgcaaaaatcattttatgaaactccaagtgaaaagcatgttctgttatttaaatccatagttagctagtagatattcctctggctatcagcccatattttgagcaagtgacatatacaaagaataagctaagagattctgatgtctcttaaggaaacattgaatagacagttcttcagatatgtgcattgaattgttttcacaaccttttataaaatggatgtgcccacataaggcatgcagctatgtatcctgtgatttctacagaatagaaaatgtcaaaccttgttgctggaagtactccaaatgacatcatggttttgttttgtttttgtttttgttttttttctattaccattaaacagggaaggccatggtaaaatttcagtatttgctgtcaaaatggctttagccacattgtgtggagggaagatcatggacaaattaagatgtaagttattattccttgtgtgtctgtttgcttttccttgctaggtaccacccttttctctccctcattcctctatgtcccctccccatttgtatctttcctcattctatgagagttgtttgaaatacatttttcactgatgtttggattttgtcatagcgatattttcatattagataaatgctaatgaaatgaatgttttcctctacttataacctgttgagtatcaccaactggcctctttctgaaattaaagtaaaataagcactctttgcagttaattgtgttatactgccttacacgtggtacaggatgataggcacgtgaaggcttagtgggaaaccttcccctttaaatcttctaaaagcaagactcttggcacatttcctcattcttctcagccagcactgttcaaatcactgggaactccaaaggtttcaaagccaacaatgtcaggaaagaagaataggaattacatagagacagcattggcagagttaactagatgccagtaaaagcatggtagctaaagtacattgagtaattgtgggccttaatgaacattttgtctctaaatatggtagagttccttaaccaacgacacactggggattgtttgtttgtttgtttgtttgctttaggtaaagaaactgagactcagttaaccatatggctaagacgatgccaggatttgaaccctgacttttttttctacacaggtggttcacaaattttagcatacatcagaatcaccttgagggcttcggtaaaacatagatttctgggtcccaccccaagaatttctgactcagtaggcctaggatgagggtgggtgaaaagcatatttatttctaactagtttaaaatgatgttgatgccgctgtttaaatttaaaatttccatttaaccctatccttttccctaaatagtatgagttggggctataatgctgtgttagaaagggcactgtcctgggaattgggagttccaggttgcaagcccagctatgtgactaatttgctgagttatcctttgtcagttacttcacttctttagtcctcagcctccttctgtatcctaaattttgggattttgtaagatacccatagaatcacacctggctgcatgcagccatctgtgtggctcacagcacaaggctcacctgctgcctgtcctcttctgagtgagatcgcttgcttcttgatccacccaaaaggaaagaataaaggaagacacagaacaccttttgttcctttgaaatttccctggagatgctccagggatgagtcattccagtggaccagtaagtaagtgaaagggacaacaaagcctcaggtagccacacagcttccctcacttctgggacttccctccatggagagccaaagacagccaggattcagagaagcctagccagaccttaggaggagccatgtagcttctcttttgttagcctgaaagatatagaaaattaaaaactatctacctcagtgcttatttgagagataatagctaaattagaaggtgctgacaccgagggcttttttttttctttttttttttcaaaaaaaaagaaaaaaaaaaagcttcagagtaatcctcgggcatttccttcagggttaagccagaaagagaaagtttagcaaaatgaaccaaggctaaggaaggaagttctgagaaccttgtctgccaaccccaactggccatttacgaagaggacattagataaatgtaaaaaacaaaacaaaagctaaacaaaaaaatccacttgagagacatctaaaaatacctgtttaatattatattaataggtacctggatagaagggtcccatattaaaataggtttaaggaaatctaagaaaaccagttttctgcatctcagaacgtctgtcaacctttaacataccaggctaattctgagccctcgaagtcctggtgtttgctgtctttccactcagctttgttcagtgtaagatttcatcctcctccaagagtaagggtggagggtgagggaggggggcttggtggaggtgacagtcacaggagtcacatctcactacagaggtccccaagcccttacagctcatcacctaggtggcgtctcagaccaattactaaactaattactggttagagaaaaagtatgacagcaatggccattgtgtaatccactttcacctcctgtgctcagaagggccatccctttccctcaacccatgagcaatccatgaacaaatgtgggtcaaataaagatgaagggaatggctggtaggtaagggactagcaatgtcagcacagttacaaagttcaaaatataactaagttattgattagatctttacaattgtgaaaacccttccagttctctcttgggcccaggagttcaaaggaaacagtataactgctacagtgctttctcctcaccccatcccatcaccctccaaaaagcactctctagtggccaaagtctatcctctttagggcagtgaaagaagcaacaaatgcatgtgtccccttggaggtaaactaagttttctagtctgcagaaacaagcccacaatatcacagattctgtagaaatacagatagtgtgaccccgataaatcgcattccccactttgagagcagtgcacctgaatcacacccttatgtgtccctggttctctgactgaggagtcactctttgtatagttaatcctgggaagatggttttagcagtttccaggtaacttggttaaaatcaatttgaccaaaaacaatttagttaaaggtaatttggtcacaaaaatctctccagaatgttaactagtcaaaaatgaatatcctgagttatgaatatttctagtttctgtgataattattaatggaatgagcgaatgtgggcaaatttacccacaaaatctgcccgcagagaccagtggctgccccttggtgagtgggattgtgggtgttcctattgtattcttttgctggcttgcattttaatgataaaacagataaggtagccaggcatggtggcacatgcctttagtcccagctacccagaaggctgaggcaggagaatcacttgaacccaggaggcagaggttgcgtgagttgagatcacgccactacactgggcaacagagcgagactccatctcaaaaacacaaatcaaaacaaaacaaaacaaaaaaaacaggtaaggtcatgattttctacgttgcttctgtaataagaaaaagtaaaatgaagggatatggaatgtttcaggcttgagggttttgttttcccttctttaaagtttttctaattcacgttaagccaaaatgccagctgtgcttgtttggcaatttttctatttttgtgcatagggttgagagatatttagctcgttccagctactcccttattgttggtgaacacagagcaagaataactggctgaaaataagtcggaaattttaaaaaacaaagagaaagcaacagaaaatttgaagttgattttcttaacgctttaaaatgcattagaagagaaaacaacactatgttgcaacataatttccagtaattagggcaccattcagtggtagggtgttccctgtgtaattccagggagcatcattgacacagcttaggagatgaagggcgccccctgcagtcatgtgccatggcaacctaaacataaacttacctaataacactactattttgtcagattgttcttggcccaattataagctgttttaatgggttggaacatttgtttatacttctgtcttagggctcctggatagttctaaggatcttaagggattctaaatccaatgctgtaagcctggtatgtcatgtgctgttctaaagctttggggaggactttttaagtctttttaaaagactagtattatggaaaatactgcatatttattgagtttctattactgaactggttgttttgcctctacgcctacccatagactttctaacgcactgacctactttaaattcttcagtatctccctcagcatcttctggacacaacctaaactcctcagtacaattcagccataaaaaagaatgaaatcctgtcatttgaggcaacagggatgagcctggaggacattatgttaagtaaaataagtcacgcacggaaagataaatactgcatgttctcactcatatgtgggagctaaaaaaaaaaaactgaactcatggaagtagaattgtgcttattagaggctgggaagggtagggggctgcaggaggttggggggatagggagaggttagctaatggctacaaaattacaactatgtaggaggaatacgttcgagtgttctatagcactgtagggtgactatagttaacaaaattttattgtatattttcaaaaagctggaagagaagatgttgaatattcccaatacaaagaaatgataaatgtttgaaatgaaggtaacgcccattatcctgatgtgatcattacacattgaacacatgtatcaagctatcactctgtagcccataaatatgtacattaatttttttactcagatagaatctctacagtctcatggttaataaactatttgaaacagcggaaaccctttataaatggagtatttaatgaaaatgagagtcaattcatgttctcaaaaccataatccgataaaagcctctgatatgcttaacatctgactttggtgtaaaaacaatgttcccagattatattttgaccttgaaaaattaaacctaaagtgaatagaggtggcacattcacagcagtttatcccagcagctgtgctggcctggtgacaagctagttagcatggtgacaaactatataatagcaaaccctttcattctaatagtgatttgcacagaggaattataaaacaccttgggaaattatgccattaatattcattaaatgcacatagtggcagaaattgaagaacagtggttcagtgaagccataggcccttcagagaaagatccaggaccctgactttacctcattgatcatccacaagaccaggcttcctcttcactacacgagtcagaaaacccttccctgtaaatcaagtgccttccacccagaaaactgtaattcatagaaagttttcttcttctgtaggaagttaatcaagtgtttgtcattacatctttatcctcaccgtgtctttgattttcaaatatcttacaccaaaatccgaaagttttagtgataatataaattggtaaatttctagctagataaatgaatatacgcacaccccaactttatagtaaaactctcattgtgtttcaaatgaagtcagcgtctctctcatatatacaaaaatttctcttgttgagctacatgagagttaatagttgacctcaaaacaaaaatgtagtgtcttattaaagacatttaataagtgtctctctcattaaaatgttaactttacccaaattacttgtgattgctatgtgccagaatcatctacaaaaagaaaccagagaaaacattatgccaggaatatttcagcataaaaattagcttttatattattctttcataaaaaatgtttattttgctacttttttgtcatttgtagcagatatattgaacaaaaacagtggagaatgttcatgtgatgaataatatctttccttttcctttcatcagatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacaggtaggagaaaaatatgtttaaggaagtatctctttcaaacagtggttgctctccttctagatgtcattccaggtcacagatactcagacaaattattctgtgtgatagcaacctgtattgtatttttcagcctctggcaaatgacctctgagccagtaactaaacccagcacatctggatcacaataatagacagtgtttactgaccatgaggcaggcactgtgctaaattttttcctttcattgtctaatttaatccctacaacaacccttctgtgttagtctcttttcacactgctataaagacatacccgagactgggtaatttataaagaaaagaggtttaacagactcacagttccgcctcaggaaacttacaatcctggtggaaggtgaagggaagcaaagacctaccttcttcacatggcgacaggaaagagaaagaatgaaaagcccaggggaatctgccatttataacaccatcggatctcctgagaactccctcactatcatgaaaacagcatgggggaaccaccccatgatccaatcacctcccaccaggtctctccctcaacacctgggaattacagttcaagatgggattgggtggggacacaaagccttaccatatcacctacaccctcagtgtcattatttttactatcactgcactttcaaaagggcttaattgtctcactcagcctcatgtgaaatatatgcttgacccggcaacaagctttaacattggtttagcaaaggataccagaaaggaatcccaacatctgccacatcatgacctgagaggcccaaaatatggtaaacacagctgcctgaatcttctacagcatgacacatttggggttccaagtgatgtgttttaactgggtatggctcaagctaccctgggaagctgcatagtttagggggctatctatgtgtgtacctctctggtcatgtagagagactccaggcccattctccagcgtagcccagtggtagcatagaaatccatacattaaaggttagtttaccattttttgagaatccaaactaacttttttgtcctctaaaaatgcctcttgactgggtgtggtggctcactcctataatcccaggactttgggaggccgaggctcaggagctcaggagttcaaaaccagtgtgagcaacatagggaaaccccatttctacgaaaaatttttaaaacatagccaggcatggtggtacatgcttgtagtcctagcttctcaggaggctgaggcaggaggatagcttaagcccggatggcgccactgcattccagcctgggcgacagagcaaggccctgtctcaaaaaaaaaaaaaaaggtatatccctgccccataaaatgcatacaacaaatgctcactacacagctttatggattaagagtcaggaagtcttttctttttactgaaattaacttttaaaagtgtcaataggccgggtgaggtggctcactcctgtaagcccagcactttgggaggccaaggcgggcggatcacaaggtcaggagtttgagaccagcctgtccaatatgttgaaaccccgtctctactaaaaatacaaaaattagccgggcatggtggcaggcacctgtagtcccagctagaagcaggagaattgcttgaacccgtgaggcagaggttgcagtgagccaagattgtgccactgcactccagcctgggagacaaagcaagactccatctcaaaaaaaaaaaaaaaaaaaaagtcaatcacttcaaaacacaaatctattttttcattcaattttactgctttccaacttttctcatggcatgctaaatgtatggctccttttatttttacagtgctttatgcctcacaaagtgaattatctgatttatggcttgcaacaaccctgtgacctaacaaggaaaatatgattcttttttaacaatataaagttcatagctagtgagggcagggggctgagtttttaactctggtcttctaattccatctgttaatgttattcttgtgttcttgttgttgttgcttttgttttgtgcactttcagttcatatttacaaatatgcagatgatctgactcaaggaaatgtaactacctgttgtattacttcacccagtcatggaaacaagaataatttcatttataactgaattcttgaattttagttagtgtattatagaataattggtaaatgtgctaatgcctcagaatatatgtctcattcaaaatcagctagaataataggactgggttttaaaaaaaaaatcttaaaaggacctatgctggtgtgatggctcacacagtaatcctagcactgagaggctgaggcaggaggagagcttgagtccagcagttcaagaccagcctggacaacatagtaagatctcatctctgaaaaaaaaaaaaaattaaacaattagccaggtgtggtggcacacacttatagtcccagctacttgggaggctgagatgagaggatccctttagcccaggtgttcaaggttgcagtgagctataattgtgccactgcactccagcctgggcagcagagtgagatcctgtctctaaaagaaaaaaaaaagagaaaaaaggacctatgtgttcaagaattatatgtgatgttgacatgttcaaaattccttttgaaatatcctatagactgttctgttatatgatttatatatatccttaatgataagcaacttatacatgttgaaatcataatagcattgttggaaacttccaggagtgctttttagcaagtatgacaaatagtcaaaatgaataagatcatttcaaatatgaaaagaggtaacacaaaaataataagaccagtttatttttgtacttaatgaattggctattaacagctactcaagagtctgaggtaggtaggaggaggtaggaagacagcttgagaccaggagttagagtccagcctgggcaacataatgagaccccatctttcaagcaaataaataaaatattttaaaaaataaataaataaaattatcccatcccctttgatattctagttcaaaatttcaagtagtgatttttgcatataaatatgtatttttttatttataccattacagtacatgtattaatatagctttcttacttttatcattttgaaagaaacttatagatacaatgcattccttttgtacatccaaaaggacctggatagtgagaaagaagcagactgaattgagaggaattatatataaagtaataaaaggagcaaatttttaaaaatgtagatggttctgtcctaacaggattccctcctgctcttgtataacagaaccattcacattaaccactaaatatttagtacttaaggaagttgaggaagctcagaagggaagttgttctataaatttagaagactgactgacaggaaaattgtagagtgagctatgatgcgttcttgagtaaaattccatggagaatttccattctttattttgcttcattatttttatactgtctttcatatatacaaatgatgctcttggaattgtttttctcctggtgatactattgactcagcctcagtggagagaattcagtcctatgtctgcttaggtataaaaagcaaacgatgttttcagttctaaactagtttaataacacatttggcaagttctgtttcttcagatattagacatttattgagtgctcttttgtttcagtctcaaatgatatgatatttacatagcaggtaaattgagatgattctctgtcctaaatttatggggggtttttttatgcagaaaaaagtcacgttaaatggtttcttggacacgcttatgtcagatcctcccccgcagtgtctggtctggttgcctcttctgcatcgactagcaaatgtggaaaatggtgagtagttactaaggagcaaaggtgattttttaaattattgaaattaggccattagttctacagttagtaagcccaggctgttgttttagggaagcctatttagtggctcttagttttgtttagggtagaactaacccatctccctgttcgggaaggccttaaaggaccactgaaaaattaggactgtcagttccaaaaataaatctcatggtcttcttctcaattacaagtcaggtgtggttaaaagacttggcacgatagaaggcgaacttcaacaaggagtgtgacattattttgtatttgttttagatccgaatttctcatatttgcatacacggtactgattatttcttcccaggcactcagccagaaataggtgggagaaatgagaaaaaaaaatagatgatagcaccctgttaatctttagtcatatgttccagattgtgagctttcaatagttgtacttacgttaaagataagagtaaaataactttcgtatcatgtctttttttaaagcaagtatttctaggataaaaggaactactgttggcatatccagatttaaatatgaaataccatttggggcaaaatttacagaaaattaaacatggagcagttcagtgcctccatctaatctttaggtgttcctacttattgttcaatgtaactctgaaatttctccagacttgacgaggaaataatttagtctctatctcttactgagatttaacttaagtctctatatattactcaacttctgtgtatttctttaatatacattgcagctaaagttagcttaattttaaattatcattcagaatttttagcatctgcccttatttatctgttagttagaagttatgaatttatcctgtttttctcatggagaaaatttaaagaatgaatttattttatttttttgcaatcactaacaatcatagtttttttatgtttatccatatgcagaagcgaagagcaatcaaggtccatgttattatgcaaaatgagttcacgttactgtttacagttctagaactagtcattttccaatcataaagctataatttctttcgttctctctcagcatttcctgctgcaggagatcagtttcttaggcaccatcccagaacagttgtccctagattgaagtcccactctagtctttctcaagagccgggaagaaaggttatgacacttgtttagaagacaatgcgtccagagctagttatgtctttgtttttacactttgctttttatcttcatttattattattttcattgtttttcctgactggttaggccggagaatagctttaccaaaggcaagaattgttattgttgttttagtatctagctcatagcatgtagacaattacttggatttgatcacttaaatctaatattttactttgcttcaaatctagtattttgctttgcctgctttataattcaaatttcctaccaaagaaagttaaccgtctcttgaggcatttgaattatttagaactgttttcagataatttgcacatcttttttagggccctatacacctgcctcaggaaagaaaaaaaaatctgtttgtcagatgtaggcaacaccactcgttaagtaagccattagtcactctattttttaaaaaataacttaattatctcatccacaccagttttccattctctgcccatcttcctttcttttttcttcctctcattctccgtgtctctgatattcgctctcttcccactggacaatcagcattcaccccttgtgcttctgagtcttccagtgagctgtgctggtctcctggagacagagagcagtttggggtaaaggcaagtctgtttggctaatttaaattcttgtaatgtgagagatgggaatagaaagagcaaatggcattacagagatttttgttgttaaaaggacacctcttctccatcccatttcatttcatttccccacaggcatgattgaaaagggttgtaagattccaggaatgaactaaatgtttctctgagcccaaatcaactatcatctgaaatcgtggtgcagagaagaaaggtgcaattcctgtaaggctgtatttttccttcttctggttcatacttttgttttcttggtttttcttcacttacttcccccttagtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatgggtaaggcaaggtccaggcaatacttggagttggatgtgtgagtgttgcccagagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacagtaagttaaaatcttttccaagttttgttttgtggaaacggcttaaaaattattgttagttttatttttcttagattctggagttcttttaagtgcgtgactagaatattaaagaaacaagtatgagaggagagtgtggacttaataatactgttccattttacttttctgcagagggtggggaggggagattgtggttatattagcaaaccatcttttcatgaagagtgtgagtgaccaacctggcaaaggtggcatgtgagtgtctgtgtgatagatgtattctcaggagcatgtggtaccaggtctgtgggaggaaatgtgactccatgtgctcactgttcaaatggattatgatttactgatgtttatcttcgttaaactcaaagatcagttccagcaatgttgccctcgtgcatctcttcaaggattggtttttgtaaggtgtacagattggttcttgtgggatataccatcagcccttccagcacctcttggaatagttccgtcacaagaaaatccaacctatttatgagtttttctatattttaatatatttcaattcaacctttagtctttacttaaagaagtcttcagaatatacatcttaaatcaaaatgttcttcctaggaattattattgggaaccaatattcagtgtaaatatactagtacttcatcaccggtcagattctgaattcaagcaacagttcttcactaaggaagagtatactgagaacttgccaattccaatgcaactcctcactgttgtttatgtcatgctgaggacagatagatacattaacacggatcatgaactacaacttagtttagaagaaaggagctaaaactttctattttcttattgttagcatattaccagttttcaaacttctaccccatatcctaaaagatttgatgtttgaaaactaatcagatttagttgttttacataaatgctaaatctacataaggagcctctttcttaggggttgtagacctaacattatattccagggcactatctgtacaaagaaggatcagactccttgagaggacagaaggccctgtggtttgtggggcaaagagctgctgttgctgctgtcttaactgttctaagaattacatctcctaacaaaagccagagggatttcttgagcaatgctcttattacttagcttttaaaaaatgaggacaatagtcacttcattatattaccaattatggactctaggtataaaagaaagtgacaaaatttgaaatggtttcttatggaaaggaaaaacatggttaaggttttattattatgttggtgcaaaagcaattgcggtttttgccattactttcaaatggcaaaaaccgcaattgcttttgcaccaacctaatgtatgtggtaggctactttttataaaattttgactgtataacatcaggataaatttcccaacaatctaaacgaagaagaggcagcgtgattctctggaaataacctgaattttaaattctgaagactcagattgaagttccattttcacttctaactggatgtgttcagccacacctgaaacatctttcttgcacctggattcccgcaaaatcttccactcatcttcattccaagcctatttcctcacaaaccattttctgttcttaagtgagagcagtccttctagaatcaggtctgatgctgtcatgcctgtgatgtaaactcttcatggtctgcctctgtcctggggataaagagacagttcttaacaagccatataaagattttgatgatctgcctcctgctttcctccccagaagggctcccttcactgttgctgcttcctccattctcgaatgaccttcccagtctgctgagtttttgtcagaaggattcctgcaggcccattaagtcccagcgcaggtgccccatgcacaatgcctgcttccatttattgtagcatttgctgacactgagcagcaggaggcagcttgttcggaaactcttttccgagcattgagcaaacttccagactcagaatcagcactgaaaaaggatttcttccgtaaatgaatatctattatgaaaagcaaatcatttgataaaatattacataaatattagctgttgtcacttctgccttccttcttctttccagaaatcacctgctaagaagctgactaatgcattaagcaagtccctgagctgtgcttccagccgtgaacctttgcaccccatgttcccagatcagcctgagaagccactcaacttggctcacatcgtgtgagtatccctaccctcccagtatagagacaattttcttcaagggcacatgtctggagccacacaaaagcaatttcctatcagtggtcagcaaccaagatttttaatttagtttaaaaaaaaaagtcagagtaatgccatcataattttttgttgttgttgaggtgtacagtacttccaccaggctggacaagtaaagtatgcaacactaacataattcacctggaggtggaaaatatttcagaaagcttagttataaaatacggatgttagtggtgtctgcacattggaagttaacaatgggatcactgtggtaaaaaatgatttacagtatattattccttaatttcatatgtgctttgagttccaaatataaaagctgtttgttttatttctctgcagacccagtttaagatgccagcaaacctagaaattacttttgtttttcatcccaagctgtataactttagaagaatcatagcctgtgcaggggaaggttgaagagggggagtggcgggaaaatttatcagaatatccatagattcttttcttcaaagtatgtgtgagtttcgtggcagaaggtgttgggccaacaaacagtccttccagccatccctgctacctcccagaagtttcatgcctttgaacctctctcaggcctgggtggccaagataacaagggggcttaggtagaagaaacaattttttccttggtgttacctggggctcataagaagaaagagtctcattacctgcttctatgcacaattagatgtcatgtagtcacagatgcctccttatgaactgcctgtagttttccacacttcagtgggacctatcacaccatagggcctgtgtttgcatgttgacatcaagaggtgggtgacgggacctaccggtataggaattcaacaatgcaaagttcatgcttcaggcagttcagcatatgatccataaggggcactgtggtgggtatgagaccttcgtggaagcagcaactatgttctctgatggaccttagcaaataccaccaaacgatttgtgttgggtcacgtctgtgagctttgtataaatactttggggctttgttttgcttgttcccggggatgctctgaggcatctctgacctcagcagtatacacagcctggaggctcctgtttctcagcttacaagctggcatgggctcagcctccagaaactaatgtaaactaattctgtagaatgtggctagcttatttttggaaattatgtttctataaataagccttaaaataagccaggggtaaataaatctggggaatgtcccaaagggccaaccacttgcagaaatctacctcacagatgcttattaagaaccttattaagatctagactttccttcccataaccaattagacacaatcactaagttgctaatgaatgaccacagcgaagtgagagcagccagtgctccctgagctctgccgagagtaatttcctaccagccctgctgggagtttcaccccaagagagcagccttcaacagagctgctgggtgtcatgaagatagagggtgtgggtgtgaatagcctggctctaagagctttgctgcttcccactcctccaaagaattagaacgtgatgcactgcaacgtaaaagtccatttcacagtgagtcccactggagtattatctagctcagggcctgtacccagtgggtgctaggattgggtggtgtgtgtgtgtgtgtgcacgtgtgtgtctgcatgagagagagaaagagagggagaaagaagtatttaattggctgagtaataatttttacattttgacttacggggcaatataatctgttttgttatttattgaattaactgagggctatagcctcacaatgcgttcttagtttatgttccatggagagattttaaaattctgtacaaaatgtgtcttctgagaaaaacctctatgtattttaccagatcctcaagagtccttgaatcaaaatactgatctctactcactgataacatattttcccaggatgaaagttttaattttaaaatgcaaattgtacaagatatttaattgttgaaataacatacaagacattctggatgtagaatgttaagtctatattagaaaagaattttttttctatttttagccatagaaattttttccatatttgtttctttttcaaatgctattgtcatgagtagatatccatgtcttttttctgagatttctaattttaaaatgcattgctcatttaactattctaaattatcataggcacatcaaggccattgaaatgaaaaaataaatggtattaagccttaatcatttacaaagaagaatgctctcttaatctgctataatgaacatgtacatggaattaatgaatattcacacttcttccaaatgtatgtaaataagattttgataaattagacaaaaatatatgacattccataccatgtcattttataataagcccactacttttatacagtgctgtacaatggaaataagtgaaatttaagaaataaaacacaccaatactcccacctccacttaatgcgcttaatttattactcccaaatatgacttaaattataaaggtcttatgcagaaggaatattgtcatagtgcagaaatgtgtatagtaagacactttatcattgagtctctagcaaaaatcatcctaaaagtatgttccttagaactatacatagcaataaacatgttttctagctatagctctgtcttggtcatcctcattccctctctgatctttccccttgctttactaaataatttattaagcaatctttaattgtagtacaaaccacatctttgtcattctttggatgtagtgtcacaaaaatatcccagtccacatcagttacacccatagataagcttacagacagaggtaagaagggagcagtgagtggggtgcaagcattggcaatattgatgggcatcctctgtcctgtactgatgacctgaggttctggacattgggaattatagcacagactcaaaataaaacatttttttgccactgtgaaaaagtgtgttgattttgtaaattaatacaaattcttcaaagacatattcagaaaaaaattccatgatgtacatgtttaagtgaaggataactgtatgtccttacatagtgctgaaatatgtagaacattatagagctcatggatataaaatttgatgttgaacattatacagtcttcttaaatgcacatcttgctgtttaatgattgtgttaaaaattgctggccaggcacagtggctcacgcctgtaatcccagcacttggggaggctgaggcgggcggatcacgaggtcaggagatcgagaccatcctggttaacacgatgaaaccccgtctgtactaaaaatacaaaaaaaatagccgggcgtggtggtgggcgcctgtagtcccagctactcgggatgctgaggcaggagaatggcgtgaaccagggaggcggaggttgcagtgagccgagatcgcgccaccgcactccagcctaggcgacagagcaagacgccatctcaaaaaaaaaaaaaaattttttttactacatggcacatgtatacctacgtaacaaacctgcaggttctgcacatgtaccccagaacttaaagtaaaataaaaaaaatgctgttagtcctctaatatatattgcatccaaaggtgagcagcaaaagcattataagatacaaataaaattaagaaaataataagtggaaaatgctttatcaatacattagaaaatatttttattactcatttaaaactcaagttccaactttttcttttttcttctttttttattttttgtagaaatagggcctctctatattacccaggctggtctggaactcctaggctgagattacaagtgtgagccaccatacctggccacaacttaaatgtgaaaaaatggcaaaaatatggcacagtctgactatgtaacaagttaacattttacaggtagccttagatacagtaaaaaaaaaaaaaaaaaaaattaaatcaataggatttttaaacaggttgcggtactaatacacacacatatacacacacatacatacatttgtatatggaaatgaagcatgtgacacacagaaaatgccattttttttttaactatagccaagggactttttttttctacccaccttgtagagaggtgctgccagtcatgaattagtccttaaatagaaatgagcaggtggtgacattttggtattttgacatttgttcttagctattgtattgcttgtaaatattaccatgattaacggtctctattctgttcaattcttcgctgccaaaagtgatacttggtaagtagtgcagtcatttccagtctacttacaaagatgtataatcatgatcataagtggggatgagacacaaaacaagtgagcaatatgaggctagtttagaactaagtcttcttatgctgtacactcagttcacaaggatgccacttatataaaaatgtcctctgtgaagatcttgtccagaaggccattgtgacttactctcttttgtggagctgtttcttttacataaaaccaaatatgttcaaaattcccagtgtgagccatttgttagataaggtaacttgccatttgattgtggaagaaataggaatttcagtccctctgaaaaccatcatttggtgccagagctagccattctttgtccaaagttcaacatttcagtggtagaccttaaacaaagccatttgctgagaaaccttgatttcagctttgtagtgaccagattcaatagaatacatttatcaagctagttaaaaagcattctaaatccacttgttttctcatttttagacagagcaagaaggaaaaatttttaaaaaaagacaaaatcagaagtgtggggtcaagtatttttttcaactctttgcaaagctacaatgaagatattatactctgttcactgttttaaaatctaacagaccaaacttttcataattcacagaggacatttgtataaaattagcatccttcttccaaagtgctagtgttcaactcaaggcagaattagttttaaactagccttgcgttgctcccttatatatcaaagatatgtcttagataagtaatgcaaaacactaagattgttttcagaacttcagttttgtctagagtagataagtagctgttgttttggcttcatccaacagatgacatgtcttacaaaatctcagagtatagtttagcaccagctaccttgaaaaaagttttgatgaatttgttattttttatttttttatttttatttttccataagttattggggtacaggtggcatttggttcatgagtaagttctttagtggtgatttgtgagattttggtgcacccatcactcgagcagtatacactgtaccatatttgtgatcttttatccctaaccccagagacttattctaagtctcaatgaatttttgcatgtagtattgacattttaaagcctgcagagcttcaggtccattccattcaatacattgggatatgcaagtctacctttttcccagaatgtcttcattgtagaatccaaagctgttctctaaggtaaaaattaaaccatttacaaatttggatcttaattatgccaatataaattgattctttaggctgctataattaatgtctcatcttcaaaacgttctatactgtcaaactcaaatatagaattatagtgaaactgaaatttcctctgattcagaaaatgctccacctcattttccatcttttgaactctaagtcccatctcatattaccattcattatcctatattgaacctaaaaaagggtaaaaatggcttggagatgagatagggatcttagccctatcattttacctgaactaaaacattcatgatggggaaagaatgacagaatgaaatgaaaatcagatgaaggaagacagactccatgcagttggtgtgtagaaccatgaacaattctgaggaaaattgaattctgttttccttctcttatcataagaaaacaagtgaagcttatgggatgctgtacaccacatactctatcatatggatcacccaaacaacagaaactaacttcatatatccttgtggagcttacttgcatcttcacttagaacaaaggcaaataaggtatgatatgattttacagcctgtgtcctttcagaccaggcatgttggagaggcccatcatcatggagaacacagaaggaacctttcaaagcctcaggaatcttcctctttccaagagaatatagattcaatgatcaggtcttcaaggcttcttgagaaggcagtagaagtaaagccactaccttcttcaaaatccttgcttcattccagaatattatacaatgaaacatcaaggctcaaagctcatgcatcagtattcacatggtgtctggagatcttcctcccagtgtttacctgagattatatattctcaaggaaatgtaactttaaaacacttaaggaatttaattggaaaatataagatttcttgttgatcctgggaaaggtagaacccagatcttcccatcccgtttcctggagggatgagggagagttttaaatttgtgacttttatttgttttaactttccattcaccctgtgttttgttttaggcctcccagacctgtaaccagcatgaacgacaccctgttctcccactctgttccctcctcaggaagtccttttattaccaggaggtaagttccaaccctattataaaataagccctttctttggtaatgagccttgattctgtggtaagaaaaatattctcatgcaagccaagggcagaatattgttactagaaactaacttgcaaatatccattataagttttcaatttcattcatttgtatgcatttaaagaggggtagggtggctttggggattaatgtcatgtctggaaacctgcatttataatttacccacagtaagaatgtgagggtatgtttcagttttactactgacacacatgcatcccatctcattaaggaagtcacgttcatagtcctcagagttgaagtcaaagaactggaatttcaggatgcaatggtgtgttactatataaatggtgaaatgtgtcattatttaaagctaagatacaaaagaatcctttgttggtgaaccctggagttcctgaggctagaggataaagaccaaacttggaaatgtagtttccatataagtaatttcacgataataataagaacttttttaaaaggtggatctgcatctcatttctttgcacaagatccattgccatgtgagcaagaaacaggagaagcaaatatttctctaagagttagcatcagacatatgcagggtcaagaggtgctctgagtcatttgatcaaatattgcaaatcaagcaccagataattattttataaatacatggagaaggctcacgggaaagcaaaaacaaaggtaaggaaaattggagtgagtaattgaacataagatttcaaatgcctttcagcagaaaaaaagtacagcctcatatttcacaaaatgcacataattcatcttttccctgaagaggtttataaggtgccagtttcactgtaatatcctggtacattcaactgaggatttgaagacaatgagactaagaacacagctgattttttttcctctgagttcctgtatgtgcccatcaacaggaacctgagatgaagatgttccccataattgtaattagcagaataaacagaatatggcagaaaatggggtttctgatgtataaacgaggtctgtaacaagtggaaataaggaaacagttatacagcagaacatccacagtaaaataatatggtttaggccctcagtaacttccttttagcactcttttttagaatcaccagcaaatgcaaccattttttttttctggaatgaaatcataaactgtaaaatctgtaaaagacacaggtctgtgcatctatctagggaagacctgatgtgatgtttagaaatatgtacttttattaggaagctctgcattctgcaaatatcaagcagaggtagaccccatccttactgaaggtcattttatatcatttcagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtctttcctctctgagtgggccttgctctgtccatgggaagttttaatgaggtctcattgtttgactccctcaggttacctgagggaataagtgcatccagccctgtggctgaagagcattccctcataaagctgtacgtaaatcagcttgatcacggtgcacggtcagtatcccagccctgaattgctaatcgtagtagtagttccatagctagactgataagtcattctactctggcactaaaatcctctcatagtacgtcttattggagatagaggtcttctggggtttaatgaaattgtgttgagacttttcaacttgagctggactttgcagctctttcctctcctttccacatattttatggatttcatagcctcataccggtatataagagatgtatatatgtgaaatgtatcaagctggatcttgtttggacaagtctctgcttttgtacaatttgcaaaaaacccagatggtaatttctaagactcttgaattaaggagtctgttggaaagatctttagcattaactaggtgaggctaggacaatgtcatgtagctggacctctttgcagttaaagacttgaggacttgtacctttctgtcctattggacctggtccattttccccccagggagggaagtctgattcctaatgaagtaacaatttcaaaaacagtttcttgctctctgtgcttattctctatcacttgataatgctggtggtgaatcacttttgttttcttaatcgtgtcgataaactaagatggatagaaatctatcatgccagatgtaggcaaaagttaaaggttctatacttctatcattgaaacagaaccaaagaaatatgacctatggctctgccctcacccctagcccatcccaacaatgaaataaaacctaagcaagccaagtatagtgccagtcagtatagggcagcaccgagaaagtagagaagttctccatattttatttagcctaagtttagtcttttgtatcatgacagatcctagaaagataaagctgaatgaggctgaattgaaatccccactccagaatcctcaccacaaactcctggcattattcacctagggcccttcacaagcataccactttgatcttcaaaagacacagggatataactttgaagtcttttgacatcctagtaatctacttcacacagatttatgagtgtgtacctctggttaccagcatcatctgtcgcattccctgttcttacatcttttctagctctgtacttgattcacttttcccttacttaaaagaaaaaaaaagcgattctcaaaggcactctcccttggtccttcgaagtcttcttacatgtgtgtatgtctatgtgtgtgtgcacgtgtgcacatgtgtacattcagtgttggtcagaagttaggtagaatgtgggtcatataacataattgatggaccgattcacttcattcattttcttgattgtaaactgtatccctaatctattttgttttcttataaatttatgggaaagaatggctgatttgatggaaatctattatcaccactggggaaagagctctaagagctatgtatggtgagccagcaacattatctaagcttatgaaagttagtgtattattattattattgcagatattattgcaaggactgaccacaaagccaggtcccaaaggctctttctccccttcactgcccacagctctgtgcctcttaggatctgctatcttctttggcatcatgcctcctttttaaaatcttaattatcttgccataatcattacttagtttacatgagaaagttaaccaatactttttaatgtcaagtaagcttctttcactatggtcaagcttcttcattagtcagagtaaagactaatgaaaaaattagtcacacttcttttacctccaattttagaaacatcatttaaaggtttcacaggtattttcatagttgcaacctctaaagtggtaagcactcacaaaaggaatca

SEQ ID NO: 13497 - DNA, 12460 bp, Human
taggaagaactcatctctgaaaaacaaacaaacaaacaaacaaattagctgggcatggtggagcacacctgttgtttaaggacttatcaaaagtgtaagtccagccttccataagcatttcaagataaattattacagcataaaatggaggcctttaaataggagaatgaagtggtttgatttgtaattttaaatgattgcatcaacagctgttttatggtataaaatgcccagttaggaggctgaggcgggaggatcactgagtctgggaggttgaagctgcagtgagccaagactgcaccattgccctacagcctgggtgacagagcaagaccctgtctcaaaaacaaaacaaacaatataatcacaggaaaagggttttgtaaaattttgcaacatttttaacttcctcaaggttaggtttcagatttattatttttgttttccaacattaattagatgtaaaaactcttaaaacaaaaatgccttcagctagcctttacaaatcagataagagggaaaggttgggaagagcagccaagttgcttaggggccgtatccaagtagcagagtgaaaaggctgtacttctgaagcttcctgcaatggagagaagtgttagcaggggttgtgagaagagctctggtcggaatgaaaagcagtggtataccatcagctgctcgctcacttgctctctcatgcacgaatccagcggagcctgacggcacttttcagagggcattttctccaatgaggcaaaaagtcaaagcctgaggatcttgaaatgcttatgttaggctggatctacacttttgaccagtccttaaacaacagggctcctttgtgtggtgtctgatgccaatcatgtgacctagctaaaggcagcaatgtaaccatcccacaattcatttatttattcaacaaatatttattgagttctctatttaccaggcagtcagcttccaggatctaggatgggatactgtggtgagcaagacagacaaggtccctgcccttaagggacttaaagacaaaacaaaacaaaaaataaaacaagtaaataaatgagatcacttccattaataacagtgccatgaagggtcatgcgccatgaaaggcaggtggtgaggctgaggatcttgggccacaatgagccgaggagctgaggtgactgggggcgccagggtctgggggtgcgggcaggcaacagaccacaggggacttacaggccattataaggagtttttatgtcataaattattatgacataaattggagggctttaaataggggagtgaagtggtctgatttgtaattttaaatgatcgcgtcagcagttgttttatggtataaaatgcccagctttaagatgaccatgcattctacaaattcaccgtgacatcactgccaaaactcttaacctgtcttaatctagttttcctgacagataaataggtcggaataaagctccatgacataactagtgggagccaaagatttgaatcacgtcttggtttcaaaacttgctacccacaaatgagttgtgagctcttgtcaggttatttactgtatttgtgcctcaactatctcagctgtgaaatggggataatgaaagttcctacatcatttatttgtggaaaaaaaaatgacatgtaaagcacgacgagagcgcctggcacaatgtagtaagctttcacaaacactcactttcattccttcttgcaggggattactgagaggatccacaagataatgcacgtgaaagggcttgcgaaattgtaaggactatcttaatggtagagtcctctttatgttttcttttaaacggtccagaggacgctgggctgttcgaggagaggcgcgaggccaagcgcagcctcaatgcggtcattgtcgtggggccgcccctcccccgcccggggcgcttctccatggcaacgtgggctttacctctccccgcctcctcaggcccgcagaccggaagcagcccgcgccgggggtttctgggaaaaggcttgtgaacggcgtttctgcgtctgccgtggacagcgaagctgctgcggttcctgagccggaggtttgcgccggtgtgcggggaacgttatgagagggaggggggacaccgggctagggtctgcggacctcttagcaggagccggcggggaagcctgtccgggaccttcctcagcttcccgggaggcgcggggaacaggccgcggtctccgcgcctagcagttgtggggcggggaggggtaggcggcaggcctgcttgggtcttcggcatttgcagagagctctctaaccccctgtgtcctccgagaccctcaccttccccctcccccaccggccggttttgttctatttcgaggccctggcgtctcgcggagggttctgggagtcgtgatgggagggggtggtagtgggacgagacttgcgcggggcttctgggatttgtagtctcaccggccgcaggcggaagtgccgtggttccgacgctgttgtcacagggtggcctttggtcatctgaaatccgcggtcctgagtgctgggaagaggggctagaggacgtcgggccggggccggggctggggccgggatacacagcaggtctatgcagcagtaaggtgggcgatccacctgggacgaggtaccctgcccaaacattgtcgggaccgtgggccttccctccatttcccacaagcggtatgctctacagcataaaaggaagagaaaattatgtagaaatacttgcaccgttgataagcagggtcttggaataggaacgaatgaatgttggctagaccttatgtataaggccaccacactccagggtatttaattaaaccagtatgtattacttgtctgataaggccttttctgattctagtcttcatcttgcttgggttacaataagtttttttaagttgttattgttcagattttgggccctgaataaataaataggctgaatggctcattgctagtatgtgtcgtaaacaacagcacgggcatgatcgtgcaaataataaaggtccagaagcagtatacagtttccctgaaggtagaagctggggaaactgtgagtcctccagtgtaaggacaagacactggaccactgcaggaagtcaaggtgcttatgcgagtgccttttcttaatagaagtttctgtgattaatgcctatcattataaatataaatgtacgtatggtgtggtggaagactgaatatttacgtattatgtgcaagataatttttcaaaattatgtgatgtttttcacatatgatcttttcaatattatgtgatctgctactcagcaagtgaacattttttcacatataagtccaaggagttcttaaacaccttaaaaatattttttaaatggtaaagaaaatttttttaagcacataataataaagcgaaccttccttttgagttgacttgtgtgtgtcaggaaacaccaatcctgaattggaaataatgcgttccagggtcaggcacatttagaaagcactgaagtagtctggttcttacttggattcttttgattattgacatagggtttgtcgtcttagtaggtcatgattggcaaactttttctgtaagcggccatatagtaaataaggtcatgcataactcaacgatagtgctatggtctgagaaatgtgttaggctatttcatccttgtgtgaacgtcatagaatgtacttgcacaaacctaaatggcgtagcctactacacacttaggctatctggtatagcctattgcgcctaggctacaaaccggtacggcatgttgctgtactgaatactgtagagaattgtaacacaatgctaactatttgtgtatcaaaacatagaaaagataagagtaaaatatgatataaaatgtttgaaaaaaaaaaaagatatgcctgtacagggcacttaccatgaatggacctcgctggattggaagttgctctaagaagtcagtgagtgagtggtgaatttggaggcctgggacattactgtacattcctatagaccatataaacactgaacacttaggctacactaaatttattaagaaaacatttttcttcaataattaaccttagcttactggaactttttcacttacaaacttttacatttttttttaacttttttactcttttgtgataacacttcacttaaaatacaaacacattgtacagctgtacaaatatatttatatccttattctgtaagctttttgcttttttttttttatagacagagtctcgctctgtcgccaggctagagtgcagtggcgcgatcttggctcactgcagcctccacctcgcgggttcaagagattctcctgcctcaatctccccagtagctgggactacaggcgcaatccaccacgcccagctaatttttgtatttttagtagagacagggtttcaccatgttggccaggatggtcttgatctcttgacctcgtgatctgcctgcctcagcctcccaaagtgctgggattacaggcctgagccaccgtgcccggcacagctttttgctatttttaaattcattttttagagacagggtcatactctgttgcccaggctggaatgcagtggtgtgatcatagctcagtggagccttgaactcctggtctttagtgatcctcctgcctcagcctcctatagtgctgggattacaggtgtgaaccattgcacctggccaattttttttttcttttggaactgtttttgttaaaagctaagataaacacattagcttaggcttacacagggtctggattatcagtatcattgccttctacctccatatcttgtcccactggaaggttttcaggagcagtaacatacatggagctgtcatctccataataacagtgccttctgtaatacctcctgaaggacctgcctgaggccattttgcagttaacttttttatttagtaagtagaaggagcacactctaaaataatatagtataaaaagtatagtaaatacataaaccagtaacatagtcgtttattattgttatcaagttttatgtaccatacataactgtatgtgttaaactggcaacacagcaggtttgtttacaccagcatcaccacaaacatgtgagtaatgtattgaccttacaacagctacagtgtcactaggtgaatcttgaatttttcagctccattataatcttatgggagcactgtcatctatgtggtccttcattgacccaaacatcattttgtagtgcatgactgtgttgggttttttttaggccatctagtctgttgaaactactcaactctgctattgtagcgtgaagtatgagtaagtacaattatttatggacacagtcatgttaatttcatatcattttcacgtgtcatgaggtattcatttgattttggggagctccattccctaaatatcattaggtattcatttgattttagggatctccgctccgtaaggcactgtgatgaagaccacagccatttaaaaatgtgaaaattattgttggtgcaagtgttgtacagaaatgggtggcaggctagatttggccgtgaagctgtagtttgccaattcctggtgtaggttattgattggaatttttaactcaaagaacaagtatcttttacttttaccagtataagttcaaattcttaggatatttttgcttatttatatatcttttatttcttatgcctcaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtgagcctgcttgtgtcatttcctgtgtcagaagcactggcataggtagtaggcaaagctgctgaattaattccactcaactaagttagaattatgtttatgccttttcccccattcccctaccactccttgttatctgtgccgctttgccatctaggcttctgcagtatttgtttcatggggtttctcttacgtgtttttagttctgattctcattacagttccttctctgaatcaaatctttctgtttccaggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtggtgaggaccagaactctgtgtgggctagagggtgaaagagagtataggccttttgttcagaactttgcttgttctcactggtggggggatcatatcactcttaatctaatatctcagtttttttctgattaagttgattttgctggcctcagaccttttattcctagacattaacatcttcagccttttcttccctttcagtctccttcctaaaaagagttgcccatgtcaggctagcatttgccttactttgagccagcacccacccatggaccaagtccctctattttgcattcagtattacttgtcatctgttttacatccttttactttcaatctcctgcctaattccattggtacagtaagcttacctgaaaacctcttctaatctctttgttgtatatcactgaaatctttctaaatatttatttctgatttccttcaacgtctacctagagtcattttcttctaagaagcttcttttgtagaaatatttggagtaatttttttcctttttctaagtatttatgcaaaaaaagcctccttagctataacatgctttaaatgcagaaaaagcttttttaaaagctcaaagttgtattaattcacgagaccagtctttcccaatatattagccattaacaccatatacttatgtgtatcctttgatatggcccagtatattcctaaaactgctagattgctttctcatgtttatgtgaactaaaatgaaattttgtttgactctgctttagtaatcattccttgaagtagttggagatggtgctggtatgccactgaatgaggtctgagcaggttttcttcacatctgaggggacagtgccagccagtcaacttttggggtggggctgaagtctgctgaaaatctgcagttttacatgtttcatgggacattcttctgtgcaataaagtttgagaagtatcattcttgatatatggggctgatattttcaacttctcatcatctgaattttagagtgacttttcacctgcgttccttatttcagctgtctagtctcttccacacttgggaatttctgtttcctgtgtgccgtttgtctccacttaatcttcacgctcctctgtttttcaagtctccaagcctcactatcctcctctaacctttcagtctgtctctcttagccttatctcctgacttgatctttttgttaattatttactgttttcctcttcgctgaaggcagttgctaaccctatatgaactggatctttactccttaaggcatgaagttttagaaaagtcttaaatgacacttgctgttatctctgcctgcgtgtgagtgatgctaacccatgttggtaattcaggcttttctttcattggacacgtttcactgaggcttagaaataaccatttttctaagtaccatgacaaataccacatgggagaagctgcttttattggaaaactttcatttattaggggcatactgaatttttatgtcatgtctttggttaacacaggaggcccccagcttatcttcagccccttcttgtcaagactcctgtgttctgcttttaggctaacattggctgtgacctgacttggcttgttcatttcagaaatagccactttctgacatgtttttctaatttacatctttgtattttgatgtaatttctccctttctcaaagtaaaagaacattataatgatttcctagtggccaattttattttatttttattcttacaaagtttcatccatacctagccacatcattttgactatctccctaaccatcttagaatctaccatctttctgacctttgttttctgactaccatttgtaaaccacttgcctatgttttattcagatatcccttatatcatgatgttatactgttattcagagtaatttcattttttcttttttgagaataggccttaacaccagtgtcagagtggtttatagatgtgtgctagctattttagttcattaaaaaaaaaattttttttaggtttctttttcccttaatagataatgaatgatatttacattttctgtttatttcagatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagttgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataa

SEQ ID NO: 13498 - DNA, 343352 bp, Human
  misc_feature (1)...(343352): n = A,T,C or G
aggtaaaaggagcagtgtagtcattatgatctaaaacaatatttttcaaattgtaggttgccagtcattctttgctgggtcataaaataaatttttttggttgggactatactttaccaaataataataacaaaatcaacaggagagaaaaaggcaaatatcagtgtatattgcaggtaataaaatagatgttttcataaaatttttgcagaacaaatgtatgtatgcactacatgtcaatgtaaagtgtatggcttactacaagacagggctaaaaaatgtttgaaagacacaatacagatgattatagaagaaagttaatattaagttgaatgattaaggaaggtttttggaggctgaaagtacataaataaagcttagaggggatgggatgcctttttagatgaaaagctgcataaaatagttctataattgtgaactataaccatatgagaaagtgaaatctatagaaccagcttattcttgaatgactaccccaggaccaattatctttccagaaacttccaggaaacacatgaccagtatctaactaaattgagctctgatgccacaaagggaaacttaacagagttgctcctgtgaagtataccccactagaagggtggttcaggatatcttctgtccaattgcgtgtttcaaatatttatgtatttaagatattaagatttttttaatgtgaaatatctaaagattcacctcaataaattgaaagtgatatttttcccctgagtcccttgtattagattcacttgtgacttcattggacagtgtcttctctgagctctatggtctaatacgtattgaacaaaaattcaaggactcaacaactgatttattttagcatttctttttaatacaaaagaaggaaataaaagaataaaagcagtcggggtggcctctggagaaggggagctgttgttgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggccgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaaggtgggctcggacgcagcccaggcgccgggcactggtcgggccgttttcctggcagagccgctccccgggacgggcgcgggcctcgggtgagagtagaataaagaggagcggccgcagccgccgcgcgaggaggatgggaactcccctatttccagctctggaaacaaatggatggaagtcctgaatggagcaactgctgacttcatctgcttggaaaaatagtccagaggaactcatatttggctactcagagcagtggagggggtgtccatgacgtggcagggggaaaatagacaactgaaacctcccgtgtgaactgcaaactgtgaccaagcaaggggaaaatgatctttctgtatatattttaatttcgtgcaaaggttttcaagcatctgtatcctaaacttacttctatgtcttgttcagcagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacaggtaagaactttctctttctagtcccttaacacccgtcgtggggaaggtcaaagcaggacccaggaggaaggagagatccgggacccgtgtgcccttcggggctcaaaggcgctgggcgggcggctgctttcgggagaggcgcagccctcactcctggaccacggggccagtggctggggaagcttctggggcgcgcgcggggaggcggcgctgcgctccacctgcccagccccggacgcagcccgggggcgaggcgtctagggaccaccccaattcaatattgggatttttaataaaccaaggaatgggattttaattattgaaaacccagctcctctgggccagaatggtgttgggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggtgagtgactcgccttcctctgttatttgtctgccggagcagcccggcggggagggaggaaggagagaggcgggagagagggggagccgtgagccgccgttggctcgtgtgccccctaccttcctcaaccccctccccaagtcgtccccactcgcattagccaggcgcgttttccccactgtacagtctttgtggtcctttattttaaagcggcagcgcacctccagagctggcctccctccccgcctcgggttcccggaccggctgcaggagcttccttccccgggtcgggcggcggcgtctggcgtcctcgggctgggccattgtcccatgtccttctctgggcgcctggcgcgtgtcccaccgccgccaccgcgcctaaaggccaggctggaagcccggccgcacgctctgagagcagacgagtctgatcgatagtctacagtgtctccttattggcataaagcccgaatgtagcgctagcggtggatgtggggttttccccaggacactgtcaggttttatcgttagatcgctgcccgggaggcacggggcagcccgaatgcctcgatcactcccagagatcgttgccgcgactgttgagattgtagataaggtcctggagattcctcctccccgcccccccattcccttcctcacttccctcttccacaaataaagccgcagctagaagatgaacaacaaagaaagatgggtttaggcgctatcgaatggtgtgtgtatttgttcctttttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggatggcagatctgatgcaggagacctttctgcatcatgccacggtgggtactcgcctggagtagggatgggggaggctatctggcatcctttgtatttttgcctcgctttggggtttcttgagcatttcttcctttcccccctcctgtactggcaactgtttcccggtgcagtattcctggaggatgctagaaaggagacgctttgaaagctattctatctctaatggaggtatattatattgaattgaaaatatgtgcatgaaaagttttttttaaagcattatttggaagggtcttttaggtttggaaatcagtttatggtttcctgagattaattagaaatagttgtttgaaggatgtatatttattttagaatttatatagaaattgggaaccaaaagtaaaagtgaaatggaaacacatataaaagttctgtggtggttttttttttttttttaacaatgtactattgttgggagatttctaagagttggacctataaaggtgtcttctcctttagcatgtggcactactaaagacaatggtgagattattgtctggctttcctaaataatgaggactagattggcatgatttagaactgaggtttatttacatctggatgagccagaaatctgatatacagaatgaagtgctttgattaatttgtattgggaataatatcaagaaatgatgtagaaaaataatttattgttagaattcaaaacataaacatgcattttcctttggacaaaactgagctaactgaatggataaaatcatttaagatatctttacttaaggtattatttcataatatcatgtatgttttaaagaaacactgttagttgggaagtttatttttcattccttttatgttaaacttaggtccctctaactgtcagatagcttcacgtggatattggtacaaagagtttatactcatatggatttgactacacccactatatgtgttaacatatgtgtccttttaaaggattgactattttaaataacataaattctgaacaattttagagatactaagatcatcataaatgtcagttattcaaactagcattcacgcattcatataccactattttcagtcaaaaatttatgcagaatagctaaagaattactgctaagacatctagtatagagtgacaacttcagggataatattaaagtaacacgtgtttattcagtaaagattccatatatttatgggagagaatataattcatcaggtgattgttagataatggttctcatgtagtatttaagagctctgcttttcattcaagcctgttttgaaatattgaagaggtttttaatttatgaactcgtctattgctctttataaaatttttatactgctcccgacatagaattataggctcctccttctctgagagacagccaatcatcatttcaatgagttaaaaaataaaggatccccttttatcatgtgtttccctacatttcaaattattccttccttaatgatacattgatttttctttccgatggtaggagtacagtcaccaagaagacaaaaatatattttctcttaattccaaggcatatattgatcaaaataaaatactgtatttgaatggtattttcgtgcagactaagaatcattcttagctgcttgaggtttgagggttcacggctggctttgctgtcagtaagagatgctttgctcctgatgttgcagtaatccactgctgctgataattagacatcattactactgcgaaaagggaaagagaaaaggggagaggacaggctgaggctaattatctactttagtttaatgaaagaaagagagactgatggcacctgggaggttatactagaacagagtagacacaccacatagacttaattgaaacaagactatctttaagtctcatagttaaagaagcttggttctactcttattttcccaaaagaaatatagctttccaactactcttccccctaaagcctaaacttaactgatgataaaatcgagcaagttacaactgacttaaaataaaaatattgactactggaaaggataaatatgtcctttaatatttgtcctggtcatgtctaaacctgaggggacatatctgccactgatgtttagactgctttttgatggagtagatactgtttggtcaccaagcaacaacatccggcaactcagccattttaggtctggtgtgggacctgtgcttttgcgagcccgcctgcactgcacactcacgcgcacgcgcatatgcagtttgttgagcaacccatctgctttttagatagtaccactgttatttttatacattctttcattaaaagtnnnnnnnnnnnnnnnnnnnntatttttatacattctttcattaaaagtgtcagaaatttagaagaatgaaatgatgaatgacttaaaacagttccgaaaacgatatagcaaatggttgacattgattacatccaacttttaagcagcgatagttttaaattcacttaactatggtaactctgttttacacatttggtagttccagtgtagtttgtttttagaagcttttgatcctgattaacgttttctggcaacaattagtggaaacatcacacttgcagtttaaactaccagaacacattataccatttgatattgtgaatggtaaacttagaaaaggagaaaatttattaaacgctctttttaaaaagtcctctgcattgtataaaacattaggaatttggtaagctcatgtttttgtctttcagtatcaagcaaagaaagtaatgaatatgaatattgaaactgtataatcaaaagatgtaatacttttcttaacctatatttgtaggaacagacacaaaggtctaaattatgcctttcttatatatatttctttcttatatttattccaatacaggtcttaaatgaatttccatccagaaaggaaaatgcattatctttagttgtgctatttacaaatgatgatttattcagttctgcaatctgtagcctcagatttcatattgttcttgctgtgcatactactaattgattactgtacagtgattataatgaatattcatggactgactcataaacagtaactgtttttgttatttttctgactgtggttttggtcataaatcctttatgctacatcagagtgaaagaaataataccccatgaggagtcctgtatacctttccacctggcctaactttatgcctaaggcacctatattaggccttgatctggaatctgctacagacccagttatttatcatgatactttgtatctatgacacaaagacaaatcatcatagtggtcactgagatggaagcacatttttgcttctatagtggacattgctgttgatagcccatgcatttttcttttcattaaagtactttgggagatcctgtagcataggatttgggggtcaaatagatcccgagaatgaatatcagcaatgtggcttattagctgacttagtgattctttgtggagttgtgaagaataaatcatctatgacaagtccccagcataggtcagctcgcagggaacagtggggaccagtagtaaaggccattctggcttgagtattaaggggcaggagatttcctctgaatataaagaggaaatatgaccctgttcgtgtatgaagactatcccacacttatttcttgagataccagttttttatttttccgttggttcttccttgtcctattagtagccacaatagggagatggggcaagatttggcactcgtatatatttcttctgtaatcttccttagtttgctgggatcctgctccctacgggtttactctctagactcactgcataagacggaggaatgatgaagtagaaaatacaggcatatggcaggagaactttcaaggactttaattttgtgtcaagtctataaagaccttttcctaatagctgttgtgtttgctaagactttcactctttgttttttgtttttttttttttggtctaactgggaaagatgaatgtgaatctactatgttttaggttatattcatttttacaatctttatataacaagataaaacaaacttcatggatagcatagatggcaagaaacatggcatagtgagtagagtgttgattttacagcacaatttaaatcctggctctgacgtttactggagttctgggtcggctaaagtttaactaaagatgcagtttcctcttgtaaaatgttagtattaatactagtcttactagttttgcatagttagtagtgtatataatatatactaacatatactatatatgcatatgcacacatatatacacatacatatacacacacatacacacaagcatgtggtatatgtagcatatgccggggacatagtaaatgctaaaaaaaaaagttgcttaaaatatgattcatagaacatgaaaatcacgatgtaattataattaggtatattttatgaactcaaaatcacattgcaacacggagctaaaatacaaggtcaagcgcggtggctcatgcctgtaatcctagcattctgggaggctgaggcaggcggattgcctgagctcaggagtttgagaccagcctgggcaacacagtgaaaccccatctctactaaaatacaaaaaaaattagctgggtgtggccatgtgcccttgtagtcccagctactcgggaggctgaggcaggagaattgcttgaacccgggaggcggaggttgcagtgagccgagatcgcaccattgcactccagcctgggcaacagagtgagactccatctcaaaaaaaataaataaataaaaaaaaagaaagaaatacaaggtatacttgtatgtatttatgtacatatgtattattaagatttattctacctactccatttttggaagaaaaaatgactgttattgtaaaagtgatactgtctcagttttttaaaaaagttaaatgaaaaggaaagaaataaagaaaaagtcataccaaatgtcccatcaaaatataatcaccgtaagctaattatgaacatcattctagattcctctctagaaatatatgccaaaagaagagtcgataaaatgactgatagttgcatatggacaggcagaaataattttctaaaactaggatgatgatgatatgctaatttaagtaagaataagaaaatataagattgtcaatgcgacaaaagaagaaatacataaaatttaatgaattgctaatagataaatgtttcttctcaaagatatttattcctgaagttaatggaaaagattaagaaaaactttaagatgttgaattacacttattttaccaattacaaatttccgttttataagtattattgactttctctaatgataaatgagaagcatattttcacttcttcccacctccttgtttcttagatcctggtttacatttcatttcacttattatattatacttattatatattataatttattatattcattatattataattatgtttgtgttgtcagggttgttgatattaatgttaaattatgtaatttcattttaaacattattttcctatttaaatgtttattatctgttttgttatctggtttcctttacctctgaattccttgatttgattgactctaattacagtttatcatttttttcctaaagtaggtccatgcactctattctttgaattttatatacaattgagagtatttgtcttttaccttctatccttgaaggacaactaaccagatgcagattctgtattttactttttctctcagaacattatagatattgtgtgtgctctgtaaaattctaaggcaaattgattttcccaaatttcatgaattgtttacttctttatccttgaaattaaattattttgctaagatatatttgaatttcttgtctaactctatattttgtcctgcgtaactgtgcccctgtttatgacttcagttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgggggagcaaaattatatgcaggttttcaggggcagagggtgtcagtacacctaaccccaggttgttcaagggtcagctgtattttcgattttctattgggtgttttcaccaagatatcccaaaatatctcaaattaagtatgtctagaaacacatttttcttccttccattttcccatccgaggtcctccgagctgacacatctttttcttattccctctctccatggatagcagcacaactttacttacctgtacaaggtgaaatttgtatggcagccttgatttctccctcttatagtcaatgttcaactgttggttgattctactaaactaatatttcttgaagccatcagattctcaccatataataaaatatgcctattgcttaataatttgttaaatttccacaaaactattttgaagaaagatttaatctccagtacctggcataatgggtgatgcattttgatgttcagtattaatggaataaataaaaatcacttcccaatctgacatgacataatgggacattatacaacagcttcttatttaccaccacacaagagctttttagttttatctacatctatatctatctgtccaactgtccatccatccaactatgtgttttaattgtgataaaaaaaacacacaacataaaagttaccatattaatcattttacattgtagacttaagtagtgttaagtatattcacattgtcttgcaacagatctccagagctttttcatcttgcataacagaaactatattatacaacagttcccctttttcctttctctccatcacttggtgaagtgccattttagtttctgattatatgaattgaactactttagatgcctcatataagtggaatcatacagaatttgtctttttataactgactcattttactagcataatgtctttaagattcatccatgttataattatatgtgacaagattttcctccttttaaaggctgaataatattccattgtaggtatatgccattttgtttgtccattcattagttgatggccatttggattgcttgtacttcttttattgtgagtagtgctgcaatgaacacgagtgggcagatatctcctcaaaaccctactttcaatttttctggatatgtacacagaagcaggtttgctggatcatatggtagttctaattttttgaggatctccctactaataataataatttgaaacaaaaagtccctttaatcttcacaatagtcctatggtattaacactttttattatacttatgtgaagattatggtttacattaaggtgaatttctaaaaatcacacagcttgggacaagaaaccatttggattctaaggcccttgctttaaatcactggtttccaaattctaatgataacgtaactcatttgctaaaaaagattcccccagtatatacacttttataaactacatctatataacactctaccaatacttaacccattataaactatatttaaaagtacaaatatattgggctgagattaaaatatatataaatccaagttttaacatttccttcttcacctcaataggttatcttatgcactgcctgagtgtacacataccaatttgaataccttattctaatttataacaccatattgcctctcagagaacattgaatttaagactttacactcagctaaaatactttctgtcatcttgtaataaaatatttttatatgtagagggaaactaaggaggaataattgttgacctcttagttattagtacattcacaactacaaagatttcccattggagaaatcctactaaaaactcaagtggagaattctatatggagtacttatttaaatatggaccttttaaaagtaaaatgaatgtttcaaatgcttctcaaaacattaggttcatgcttgaatgcaatattctaaattttaccccattttttcttaattatacttctttgattttatacctgtcttagtccattttgtgttgttataacagaatggttaatttataaagaatgaggatttatttcttacagttctgagggttgggaagtccaagaagccttcttgctgcctcatcccatgtcagaaaatagaagggagcccttttgtgagagagaagggaaggggtctaaacgcattattttattaggaactcactccagagatcatgacattaattcattcataagaacagaggccatgcgcagtggctcatgcctgtaatcccagcactttgggaggctgaggcgggtagatcacaaggtcaagagatcgagatcatcctgcccaacgtggtgaaaccccggctctactaaaaatacaaaaattagctgggggtggcggcgcgtgcctgtagtcccagctactcaggaagctggggtaggagaatcgcttgaagccgggaggcggaggttgcagtgagccaagattgcaccactgcactccagcctgggtgacagagtgagactccatctcaaaagaaaaaataaaaataaataagtaaataagaacagagccctcaggacctaatcacctcttgaaggttccacttctcaacactgttgcattggagattaagtttccaacacaggaacttcggggaacacattcaaaccctggcaataaccatatgcctctatctaccatgaagggttcttcagtgttttgtacattgtggtggtcagaatcctaggatgagtctcagatggcccccacccttgtataatcccttctcctttgagtgtgggcagcatctgtgaacatgacgagccccataactctcatagttattatcttatatggtaaggctgactttaagaaaggggggcctttcatggggatctgatttaatcacattagccttttaaaagcagggagtattttcctggctagtccaagaaggggaagtcagggtggtttgaaacctaaaatgtacttgctgcagaagttctctcttgctgaaatggaatgggggcatgtggttaagagctgagagcagtctctggatgctgagaccactcttggctaacaacgagcacaataatggggactgtagttctacaaccacaagggaatgaattctgccaacagcctgagggaacttggaggtggattttccctagtggagtttccaaatgagaatgcagttggctgacaccttgatttcagctttatgagaacctgagcagaggacccagttaaaacatgccagtcttctgacccacagaaaatgagataatgtttgagaagttgtaagccattcaatttgtggtaatttgttacaccataaaatggaactgatacatagttctttaatgtaaaatttaccaaaaacatgtgtgtaattaacaggtcaatttttaacaagcgtatttgaccaagattatttgtggtttaggatacagctgaaaatagcttaaatgttctttttctctaataccttatgtattgccatttctatggtttttgatgagatggtctataatttagtaaaagatgtaagctctcacagattatttgacatatttagtgactaatgactgtcattaggaatatgtatgtatataaaagttactttgatttttctctaaatgtttttatttttgatcattatttacttcatgatattccattcatctcttgagtagaatacaaggtagcttactgttttagcagtaggatggagaaagacaagtacacatatcaaaggaaattgttattctcataattataattaatttacattaaaggatttttgaaaacttacaagaaaatataacaatataatatttgttctcatttattagaaataaccattctataattttatttttttaacttatttaaatattacacattttgaagaagatctacctaacatttggggaatagaatataaaaaatagcagtaattggcaagtctttttcttttgtcaagatactggaggaaattgtaaattagtctctcctctctacgttgattttattttgattttcttcctttctatctgaggtttattcaatagcctcttatgttccactctttctaattttaatcaaatattcatttgtgatagttattctcacagttacgagtttttgaagtgttttggagctgttagaaaattggaaggttgagaaaaactcagagaataaatttaagaagttgaaagactaattttgagaataaggaacaaccttattggttctcactggatgtaactacagttgccagatggctgaagggttttaggggtttaatctagggccatggggtaaagctaagaggcacatatggggatctaaggcctagcctggtcatactagcgccatgctctacccaattgacctaattagatgagatttttcaaatctaatatcaaaggtttgtttgaatatcagatgtgggtcattgttctctaagcactctgtttacatggtcattgttgtttacctgaggccaagaaagaatttttgctatgttgttgctcatttttcctctgtaaaagctaccatcacaatcaattagtttatttgtttgttcttactaatttagaatatgtaattcataattagcagtaatttgaacaggggtaagatgacatttaccttgaactacctattaaaggaggatttttcttttccttccttccttccttccttccttccttctttccttccttcttccttccctcctttcttttatttgagagtcttactctgtcactcaggctggagtgcagtgctgcgatctcggctcactgcaacctccaccgtaaaggaggatttttctacaaattcatgataagatagcagagggggcatgcttttctactacaagaaaaaactttttcttaaactttctctgtccttatataaacaaattatatatctattccactataaatggtgctctaatgtaaaaattaggtgttataagtaccctttagctaatttgcattactttgttgtaaatgcctagtattttcaaataaaaaaggtcactctctaaaattaaaacttaatcaacatagttaatacagtgatatccaaagtcactttaaagtgacagaatggctataacactgtatgaccagactgtaacttgcttgaaaacttactaaaagctcttttaatagagcttcactagtgaactaacactaactttctctttcttctgtataacataatgactgatacccagggcatggacaggctcactcatagtgatctgctctgtagttatttgcactttgtgcacatacagtagagttgcaggcatagcattggttatgtttttcccatactattttttgctagtttcacttataattatgtgatttaaatatatcataaactgagaaaatgagtgcaaaatttaaattcagtgcattacaaagactcaaaataagggtgagttactaaaaagacctatgggaaaaaaagagaacttcgaattctgaactacttagattgctttacaagtaattactaacttcccattctactttaaagtaattgaaactggaaattacagacaatgtttcttggaagggttatacacttgcaatgctcaacatgcttaatgactcatacttaaagatctttgtcctatcacaaaagtttagcaaataattatacattagtatatgttaaatggaaatttaatattaagaaatatatgatgttttatgccttccaactttaacttcttgtgactgaacagcttcacaattgataacaagagctttttaaattaacataggaagtgttaataagtttttggtcagccatagaactatgaattaaagatataaatattggatgtgcccatagaataatctattgtcttgataactgaggaacttagtgtttcctgaagggttatccctattattgaggaaaatatttatatccataagagcctgagaacccttaaatacttgccattattttaacccctttaaatcaatatttaaccccttttaattatttgcgtttctaactgccttgaccagagagaattcacgggttgaactgttgccaatgatggcactatttagcagttctatttctcagtataaattaagtaatcttaggttttatactacttcaatttcttgtgagttttgattgagttcagagtctatattttaaccagtctatatacacaaatgagacctccaaaaatataatcactgggtggctgttgagaagaggagggcaaatggatgttagggagtccactataacctgactcgcttagaattttcccttttctataaccattttttcttggatttcagttctcttgccatcctgttcatccattctagttctcttgccattcatcatgcctaatgaatggattattttaaaaaatataatacctagcatattttttagagttatggtttaaaatataactttcaattctgctgttttttatcaaaattattaccatcaacatttctcaatgttgctacataataagcctttacaaataatcaagtatatgtagtgtaattttatttaccatttctatataacatgtgattttacttatttcttttttttttttttttttttggagacagagtctcactctgccgcccaggctggagtgcagtggtgtgatctcagatcccaggttcaagcagttctcctgcctcagcctccagaatagctgggattacaggcacccaccatcacgcccagctaatttttgtatatttaatagagacaggggtttcaccatgttggcaaagctggtctcgaactcctgacctcaggtgatccgtctgactctgcctcccaaagtgctaggattacaggtatgagccatcgcacctggcctatttcttgctttaaatcccctttcccaatgaattatgataattacagttttcttttcattttttcgagatggagtacttgctctgttgcccaggctggagtgnnnnnnnnnnnnnnnnnnnnnnnnnnnnnnnnnnnnnnnnnnnnnnnnnnnnnnnnnntcatttttttttttggtgattttagtagagacggggtttgaccttttagccaggctggtctagaactcctgaccttaggtgatccaccttggcctcccaaggattaatcctgtgctaggattacaggtgtgagccactacgctcagccaataattacagttttcatttaaaaatgtatatgtgtctgtttgtatattacaactgacattttgaaccttggagaactttatatgaatcttgttagtaagattctgagagtttttttttttttaatctttttcttgtcatctagctgaggacatctcatctattaccatgcttaccagtcacctgaggatcttgctaaaatggacattctgggtcagggtagggctcatgagtctttgtttctagaaaactaccatagggttccagtgctggttaagctcactatgaacaatcccttccactgattatactaaaaactctggaaggaatatacaacataactccctgagaactctgagaaacaaacaatagcagggtaaatgaggatggatgtcaactgcaagtacacagcacaaggggtgagtttcctttgccctgcccccttcatctactggatttaatctaagggcagcctcagtcatgaaactgcacaatgaaagcagacagtacaaattttgaagaaaagctctttctgtccagaggaccaggaatagggttccttgacacctgcagaatgtggagggatcaccatgtctatttttttcctcccattttcactaatagcctagcatgagggcagccctgctcatggagctgcactgctgatgtgatggtggcagtgccagcagagaggggcctaaaaacctcagtggaaaaacctgtctctggccagaggaacagaaaacagaagttcccttggtccctgtggcaaaagagtgtgtgtgagattctctttttcagggctacatgttcctggagatggcctcaatcccatggaattgtgtaacagtgcacataactaaaactctaagaagtaagaaagttttcaggcaagaaacatcagaaaaaaagtaatctgttgggaattagagagtgtgagggaaattccaaagagaagatcccctaaatcttgtattaactgtgttcattgtcaagctaagaatgtgcagaatatatgcaaagcaccatggcaaagtctttgagaactgaaatatgatataaaccactgcacaaactaagactgacctctgagttgcatgtatgcaaggtagaaccaaagaaacatatcaaaatttaaaaactgaactgacattggaatcattaactgtgaagacaagacagaatttttggtgtcagtctaatgggatttactgcatgctatccaaatataatattttttttctggaggattttaacaagactaagagttccacaacatagtattcaaaatgttcaggttacatctgaaattatttggcatataaaaacaatgaaaagggaacaaatcttaaaaaagaaaaaaatcagaagatgtcaaccctgagttggaccagatgttggaattataaaggatttaaaggcagctaacataatcatgctctatattgaaaatgcaaacactcttgaagtaaatgaaaagatagaccttttcagcacacaaactatcaaaagaatcaaatgtcaatatttgaattaaaaaatacatgataaaaattcactaggtgggctcaaaagtagaatggagatggcagatgaaagagtccatgaatttaaaattcatggactcaatagaaattatcgttgctgaaaaacagagtagaaaaaatatttaaaaaaacagactcaggaatctgtagtgcagtatcaaaagatctaatatttgtgccagtggaatcatagaaggagaaaacaaaggaattggtagataaaaaaaatagaaaaataatggctgaatgttttccaaatttgttcgcagggcaattcaaaatgcttggtggaactgaaacaagataaactcaaagaaaaatgattcccaaacacatcataattgaaattaatgaaagaaaaccatcttgaaagaagccaggggaaaattacacgttatttgtaggcaaacagtaattgaaattactgcagacttagtcagaaaccatgaagcccacaagacaaaaatttctaaaatgctgaaagaaaataattgtatctctagtgaaacatttttttagaaaacaggtgatataagattttctcagatgaagaaaaaccatgaattaatttccagcaggcctattctaaaataaatgctgaaggaagttcttcagtatgaatagatatgatattacaaggatatctggagcttcagtaatgtaaaaagaccaaaagaaattataagtagattactcttattctatacattatttaaaatatgtatgactgatgaaaaaatacagcattgtatggtagggctttaaatctctgtgtagatgtgatattgtgatatgtatggctctatgcaacatacaaaggatgttccctgaccagaaagggtttaaactacaaatctgtaagagaaagttgtctggaaattccctaagtacttaaagattaaataacattcatccaaataatccatgggtgaaagaagaaattcaaagataaattagacagtattttgacgtgaataaaatgataatgtagcatatcaaaatgtgtgggatgcaccttaagcaaggctttgaggaaaatttatggcaatacatgctaatattaaagataaaatgtcttaataatttaagcttctgcctaagaaatgagaaaaagaagaataaatggaactcagtgaaagcagaagcttaattttagttaattcctggtgaattaattttgttaattccttggtaactttgaggtatccctttgcctggggttttaacattcaaggatggtccatatagggtcatattcccagagtgaggaggggatagggtcttggttatctgctaatcaccttggcaactgcttatatacacattttcccatacaatttgcttctgacatgtaggttgtcaatgtgattcacttgcttctgaacacagggaatatgcaagattaggaccctcttaaatattttcgtctctttcttgctgcgacatcccaagagttcatgggatgaactcacctaatttcccaggtgaggctgtcttatactaacatgcaccggcattcaattatctctattctactgctcagaaaccgctttgggtggagaaaagtgtaaaatacatgccacccgctgatacatttggaatttcataattttccaaaactatttgggtttcgtttcctagaattcttacacactggggaggcgtagaaagcagagctacttctcgggaactcatgaatatctaggctacattttcttttcatatctctttatctactgagagaattgttatatcatttaaagtgtgaaaactgtctattacttcatcaacattccttcaggtctattgttcatggcataaataatattatgatgagttttccagactttaagtttctgaagcttgaaagcttaggattctgtaaatccaagtaaacttttgaaatttaaaatccaggacttaaacatttttcaaaaaacctgtttccataacaaccttaatccagggcagtaaggatggaatgccttaacaatctggtttagagaaaggactaggatacacatagaaatgcaaatgacagaaattggttcacacttcaacatttttctcaatatatgtgaaatggggacagtaaatgatatctacttcacatggttattgtgatgattaaatgagtacatttaacaatacatgtgatgtgatgcatgtgccagtttctgacaactaaatttaattcttcttcctttttttctccattattctcacctcttccttttttacttagtattgtcacctttttcttatataattggtataaacttatgggttctgaagtaccacctctgactaaagataatggaaagatgtcttagggtttattcatttatctatgaaacaattcagaaaaataatatgcttgaagggaggcttgtgcccatggcactgaattagaacccagctggctaaaggcacagtagggatttaattttcttcactcattcttttttcctactcactatttagaatacattttgaccaaagcacatttgtaaaagtcttttcatataaatggaatgctttgttaccctagccttaaaatgcagcatattcaaaattataaaaggataagagaaggataagagaacctcagaatattaaacctcagaatattaaaataaaaaggaatgaaataagacaaatatgatagtattactggaaagattgctttggggactagtgaattaaacaatacatattgcagactacaagaactaatcatcacctgagattatttgtgataaggggtttagaactcactgtcaaagagcacggactttcctccaattgcagagactacacataataatcagatcatgggagaaatagcatgtatgttattgcagaataataaggggttatatatgtgtattttatatgcacatactaaagtttgttgagcaccatttttggaacaaattgaatttttaatgagtcagcactctacagggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaaacataagcccttaacagcagcaatacttaccttaatcatcttagtatccttagaacccctggcatggtatctaactcagagcaagtgcttaataaacacttaatataataattaaattagagtaaaagtgggatttggactgactttcttttaggtcaatacaaattgaaataaactttgttgttactaaaactctaactggttaccagatccaggacaaatacaatttaatgagattgtttaacatttttaatgttccaaaataaaataatcaaatatatttgctgataataaaaaatatttacacaaatctaggtaagtagaaaatttcccatatagaataaacatagatctagatgtatatgaaagaagagatagtttatttcttgactagaccattagtaacagaatattggtattttcatagcaccgaatataaaatttatattaatgaaactgatatatttaaattataggttgaaatagaaaatttacagatattttaaaaatataattctgaccctagaatattttgaaagatttcaggtggttgttatggaactgagaactatcatgtgaaatctgtggaacttaggaatgtattgaatgtggcctaatatttgttcaggtgggcctagaagtaaaattgtgaaagaaaccatgaaaaaaacctcaatattttatgttaatggagaaaggatgcagatgaaaagtatcaaataattaggagttatttgcagtatttatataactatctttgtgtaatccttacagtgagtgtgttacttttctgtctcttgggatatataattcctaccattaatttccattgacagtaagagtagcggttaagaacatgaactctaaaggcatgcaactgccttagttttatttccagctctgtcatgtgttggctgtgggacttgtggcaagttacttaatgtctctgtgcctcagattatctacatacagaagatggtacttacttcatgggatttttatgaagattaaatgagttaatatcttaaaatacttagaaaatgcccagtatatagtaaatgctatagaagtaatttccaagtaagaataaatgtgtttttggaaatgataatgtaaaaaaccaacagaatatcattttcccctttctcttcctctgtccccctctcttgctctctctttctgctgccttctcttctttctccctctctttttctttgtgtgtctctcacagtctctctatcttatgcaaacatcaaccctatatagagcagcataggagtatagtattatattaatttgttcaatttaagacaaaaatgagcctcttttttaagtcagaagctgatcctcagtttgaaatttcttatccactctaaggaactgtcttattggttagaaacattctgggaaaaaaaaattgtctttcttatggaactcttcttgccacatggaactcttccattgaatgtttttactgaattagccagttagttcatttcaacaatacatttcttatttttttcatctgaacagatcaacttttttatattggcagctgacttttggtaccgcagtgacatgcctaagtgtatgccctgcattgattgagagatattgtatgtaatatatgaatatattattttttcagagtggctcattgggactttttagttttatggactagtaaaagattcgtaaaagttaagcaggagaccaaaaccaatttgccaagtttttgttttgccatatgaagatataagagcattaaagaataaactgtcatctatcataccaacattgtatcaaagaataagtcaacctaacaacaacaactaggaaagatttagagtcaagatttttaaattgaataagtttaacttaataaaaaattcactttattttaaaaattatttcttctcaaataggactacattacgatctggcaccggtactgagacaatttcatctctttatgaggcacgttttgtttggtttatcaggatatattaattacaggaagaacagccaatgaagtgctaccaggtcaacagggcttgtggtccagtttataaactgctaaaagcgatggctgaaaatgaagtttctaatgagcttttcctcatagtagtagttttcttctccaataaaaagtaacatgtttatttctctgtcaactcttagtttgcttacttctgtgatgacactctgtagatggtgccagggtctgaaaaacaacacaacaattactaaaatgaaaactgaagaacaaagtagtcattgtataaaaggaattatgtatatatcccagcttaagatgctgctgctcttgttggtatccagttataggactagggttgacagcagctattacttaccgtgtgcttattcagcaagcctctccttccctctctgaactgtagagtttgatgtgaaacaatatttttaaatgaacaattaaataattggtgctttctgattgtagaaatccctcttcctacctcctagaattcactgatatcactgttttttctaaccttatgccataacaaaaaatgttccaggatattcaaatctttagttctctaactccaacaatgagctatgccactgatttctaggcttgtgtcatgatagaataataggtttacagaacactgacgtgttcatcttctggtgttatgcataagttttacttggcttttatggtttgggctgggatacagtgaagttaaaaactacatttgatgctgtggattcagagttaagttgggattctttcccttaaggagcactttaattgtttgtttacttatttgtgtgtatttgtgtgtggggggacagataaacctgcttatgttaccctttaaagcatttttagatcatttttgctcctctttttatttgaagctactgtctcattttagccagatttcatctacttaaaatgctgattaggttggaggctagcactttaacagctgtccataggccagcagatgtggccctggtaccacataaggtatgaagtttgaactaaatcccttcatagagctgaagccatctaaggattttgttctcagtagaggttggactagggtataacaaaacaaaacatacaaaaaaaaaaaaaaaacttctctgtcccaggctttgctctgaaaaagaaggaacatttcctctgagaattcataaccataagtccctcacttatgttgatttgttgttccaatatgcaatagcaatgcaatcatgaagattcaaagttaagagattaacattagtgaataataggtggtagcatctgagggtgactgacagaagcttttacaaaatatctttggaatgatacacttaacacaggcccctaggattccaacagagaaatcacaactgaacttgaacttgagcttgtatgctgcaagtagtatgaattttgtcatatataaagcaacatttgacagaattacaatgaaaaattggcaaagacactataatagtggaaagcttgtcacatattttcattcaattcttgtttggtttgactgccctttactaaaaaagtacaagatttaatctaacagtaaagaagcttggtcaaatgtacaggtattttacctgtacctagcaatgacagcatccacattgttcccaagaatatgcaattttttttaaagttgcatatgcattatgctataaaacaggcatcaatacatttctaagatggattcatacatttaatttgaattcttaatttaaattaaaaattagaagtgaatttttatttgaaaatataatgggaatttttaaaagcacactgaaaaataattcatctatcaaagaaaaatcaaaatggaaattagaaaatattttgaaggaagtaacatatatttatgtcagaaattttatgaggcagacaaattggcgtttgtcacttttagtgtttctctttatggagggtgaggaggattggaaatcaatgagatatcccgtataatttaagaagtcagaaaagtaaaaaataaagacaatctaaaataagtgtttaataaaaaaagtagaaactaatataccctttcaagactgtgggtttgtatactttctgatgagaaatccacaaaaattcaagttgtttttattctgtatgcaatgtatttttattctctagttgctttgaagattgacattttctttgatgttcaacagtttcactgtgacatgactaggtttcactgtattctccttgtgatttggtgtcttgactcttgtaaattttgtttaaatttatgtctttcactaaatgtgagtttttgcccattacttcttagaatatttttctacctcccttccttctgggcctttaacaacccacatgataaaaatttggatattgtcccataaatctctgaagctcttttcatttttatcaacccatttcctctcttttcacatcaggtaattgatagatctattgatctgtctttgttcatgtccttaaattaatgatgcttcctccctacaaaggccttttcctatgttgttccctctgccaggaattcaaaccaccttccaccaccctctccaccgaattaacttctatacatccttcaggtctcatctcaagtgacactttttacagcatgtctccttagtatttcttcttagtgtttatgtccctttatgataatacatgtgctagtgtgattatttgattaaatcctgtaattcccatgagataaactccactggaacaggcagagtttaaattttctgccactattcgttagcttctggcacaaaacaagcatataataaatgttgagtataaaacatatagctttgttctttcatggtattatcagcctatacatctgtgtttaccgtagacaagtcaaatactcatttgcttctctttttgacctctccttgctgaactataaaattaagaaattggattagattttacctatagatctattcaacactgaaatgccattttttaaaaaatctattattggtttaaaaggatgcttttaatagaaaaaggataaagatcatagctttcagttttctgttttcttaattgtaaaatcataatgaaatggaatagaatattgactatcactaaaacctgcttaattcccatgttatatattgcaatttctatataagttagcacccttttgtagtttttctcatgcacaaataattttctataaatgagagtaatggatcttcataaattcatcattatattttctactcctaaaagaaaacagaagaactcaaaaccttcactatacctattgtttgatatcaaagagatggcaaaatcaacaggaatgtatttcaaaaagttctaaagtatctgctcattaatttaccaagccttctcgaagactgttatcagaagtatataaggagttataaaatagtttgtataccatatataataaaactaaactcaattatttgtttaatattatttagtttcttgaacctttaagtgtagatgaaggaattataacatggagaaagacaaaagttaatggaaaataagttaaactattgtaagggaaaagtccctttctgctgttttctgtaaatgccaagtaatctttccattgcatggaagtttgctgcaaatacatgttttgcagttaacaaagtgtgaataaaccctctcagaaatatttgcttgagggcccccaaatccctgctgtgaacatctaatcaaaattcatgttctactgacaatagctcagtaatgtcaacttcacttagaggacaggccatttactttattatttactgaattatgttgtgatctaaaccactttgtgattctgactctgcacagttgagaagactgtgaatgtgtgtggtgatcagtctcaagtggctctgatcagcaattttctaagatgtcatataatgttgtcagcagttaccttccttagtttgagtaaaacaagatgatagaatctttgtaagctagttgactgtccttagtatttctatgagggtaagtatatgcacacattaaagcagacagctcctcttcttgaacttgacacaatggtagaaatgtttatctgtgtcctagagaaatatgagggaaacaatgttttcagcatagacattcctgaagagaatctgatattttgcagttaacacattttgttcaaacataagaataaaaagcaggtatacataatcatctttttttttggtcagaaaatgagatttattagtttattggttattcatgagtacagctatttcctgtgtgaccttctacagttatctaaattgttaaagtaagaaagttagagaaaggttaccctgaagaacagaaaaatgaattctttatctactgggagagatttcttaaaaataaaagattgttccatctatacattaatgctaatgtcatgatattttaacttactgaagcaatgctagtgaagaatcccaggcaaggtgacattttttaaactttcaggtatcttcatcattgcaatggaaaataaaatgcatacaactagttgtaaaattggcataattggccataatgcagtggccacaagaagcttatttggcacacaccggtacaaagctttgttaaatttaaatagcttttttttttttttgaaaagtaacatttgcattacaaaccttgaaacttaaaggaaaacatggcagtattatttgaaaaggtaacaatctatcaaacatacataaaatataaacaaactgggtttggcctcttcagtatttcgtactaataaaatcatcaaatttgcaaattttgttttttcttccctacatcaatttctacattgataaatattttgttatttgagagtcatccttagattatttttattaattttaatgttgagaaagaatttagaaacagatgatgccaattgtcaatagtaatatccataaagtgaagatttaagaaaaatgttgcagtgatgccttagcatttcttgaaaactgtatcagtaatttctgataaagtatcttttaaaattttatttgtaattgatttaacaaggctgtaattagaagatttgggtaattcatttgaaaatccttttttactgtaaacttttcattaatttgaattaagtgggttggagtaagtaaaatatctgtatgttaaatagctcttaaaaagatattcacatattcacatttaggtagatagtttttctttttcttttctttctttttttttttttgagacggagtttcgctcttgtttgttgcccaggctggagtgcaatggcgtgatctcggctcaccccaacctctgcctctcaggttccagagattctcctgccctagcctcacgagtagctaggattacaggcgtgtactaccacgcccggctaattttgtatttttagtagagatgaagtttatccatgttggtcagactggtctcaaattcccgacctcaggtgatccacccacctcggcctcccaaagtgcagggattacatgcgtgagccaccgcacccagcctaggtaggtagtttttatattaattacatgcaaaaattatttataactttattatccaaaaactactgaggatgacagagctaacataatagctcttgaaaaatgagtaagatgaaacaatgtgtaaacatatttaaattttgagcaaagacactttgaaatgctggtaatggtacattttttttcccagcttacttacgaggtaatttaataaatccaataaaaatttgctgcttttcttcattcttttctcgcctgcctgcctgcctgcctgcctgccttccttccttccttccttccttccttccttccttccctccctccctccttccctacctttttcctaatctttcttttcttcttttcttagttgcttttaaaatatttatttaacaattggcaaataaaaattgtatatatttatcttgtaaaacatgttttgaaatatgtatagattgtgggatgactaaattgagctaattaacatacgcattgcttcacatacttttttgtgatgagaatactaaaaatgtactttcttagcaattttcaagaatataatacattttttaactgtagtcaccaagtcatacattctatattttgaaattattcctcctaagtgaaattttgtatcctttagccaacatttccccaacccctatcccccaccctagcccctggtaaccaccattctattctctacttctgtttattcaagttttataaagttcacatataaatgagatcatgaagaatttatctttctgtgcctggcttatttcacttatgtcctccagcttcatccatgttgttgcaagtgacacaatttccttcttattaatgctgcatgtatttgcttgtgtatgcataccacattttctttatccattcatctgttgatggacactggttgattctatatcttggctagtgtgaataagattgcaatgaacatgagagtatagatattttttcaacattatgatttcatttccttggaatatatacccagtagtaggatggctggatcatatggtagttctatttttgattttttgaggatcctccatattttttataatagctgtatgaatttacattcctatcaacagtgtgcaaaggttttttttcctccacatcttctcaaaagacttttatattttaaaaagaatagccattatagtgcgtatgggatgatatatcattgtggtttaaaattgcatttatctgatgattagtgattttgagcgttatcctgatattcatattggctgtttgtatgtctgctttgagaaatgtctgttcaaatcctttgctcattatttttctgctattgagttgagttccttatatattttggatattaacccctttaatatatgcatggtttgcaaatattttctctcattccataaattctttcttcactctgtcaattgtttccttggctgtgcaggatcttttcagttagatgttattccatctgtctatttctgctttttttgctgtgttttgggtatatatcaaaaaatcattgtccagactaatgtcataaaattttttccttatgtttttctcttgcagttttacagtattaggtcttgtgtgtaagtctttaataattttgtgttaatttttgtatatggtatgtgccttagtccattttgtgtttctgtaacagaataccaaagactgggtagtttataaagactagaaatttatttcttacagttctggaggttaggaaatctaaggtcgaggagcctgcatctggtgagggccttcttgctgcatcatttcatggtgaaaggtggaagtgcaagagcgcatgaaaaagcaatagagcaagagggggcctaacttgcttcttataacaatccactatgtgataagcaacccactcccatgataatgccgttaatccactcatgagggcacagccctcatgacctggttacctctgaaaagccccacctctcaacactgttgcattggggattaagtttctaacatgtgagctttggaagacacatttaagcaatagcagtgtgagatatgggcctacttttattcttctccatgaggatatcaagttgtcccaataccatttattgaagaaaatgtcctttctccattatgagttcttggcacctttattaaaaatcaattggctttaaatgtgtgaatttacttttgggttatctattctgctctgttggtctgtgtgtctgtttttattaccagtaccatactgtttttattactacagctttgtagtgtatttcgaagtcaggtagtgtgaggactccagatttggttttgctcaagattgctttggctattttgcatcttttgtggtattatacaaattttaggaaattttttctgtttatgtgaaagtgtcattggaattttattaaggattatgttgaatctgtagattgctttgggtactatggatgttttaacaatattctctcaaatcatgaacataggatttcatttatttgtgtcatcaatgatgtctttcatcaatgatttgttttactaaagaagcagtaaatctcaaagagctataaacttgtgacagctctttgattttgcagataccaataaaggattcttaatccttttagctgaaaatcttgccaaaatttcagagctttaatatacaatcctgacatagtggagagatgtacatctgatagcttagcacatcacaacaaacagtatctcctttacctaagctagtaattgcaggaggagcatgcacatgtgcatatgtgagtcagtatgtgtgtgtgtagggggagaataggttggtaggtagaggaatttttaaccatgtagggtaaattagacaaatatacagatatgacagacttgtagctaatatcaccaacctgtattcctctattggcctttctctgctggcgtagtcggcttccttttgtaaagtttgaatgtgctacacacttgcttttccagcttccctggaagctagatatttggactataaaccccacctataaaacaagagctaagggaaagtcttttgtaaggctttcaggaaagttatttctccataaataaagagattaaaagaataaaacagtctttgcttgacacggcaagcaaacatgaagccggagacttctgaagtcatattgcaaacaacagagagatagaattatcatgacgtggatgacaaaggataaaattgggaattacttacatgggtcatgatgataccttcttgactcagaaccaaatggaaaagcactgcctctggaactttttgtatatgaaatattaaatgtgtaagaattttaaagttggatattatgttaattatagtaaaatcatattaactgacaagtggtcaattattgtgttatgtagtacaatattatgttatatatgtatgtattttatatagtatagtgtaaatcaatttctgaaacatttagaacaatggaaatgaagagagtgagacttaatagtattttcaaccgataatatattctaaaattaggaagttagcagaattgggtggggatacaaccaagtacttgtggaattttcttgttttatcacatgtccacgacctgaaattgtgtaatcatgtagtcgtatttttaagaaaacacagtaaaacatagggtctttctactttctgttctacaatttcaaactaaagtttatttgcttattcagtgatttttaagcaatatctttatatttttaagtaacatgggatacttataattctttgcctgatgagattctttggctgtgtcagaatatttttgtaatatgtgaaatagttttgcatagttaagccagaaacctatgtataaaatgctgttgatatgttttggaatataaaattatttctatcatgttctgatctgaataacattaatgtacttttttggagtgtgaaataaatatacaattgtaataaaatgcataatttaaattattggtaaaatatatttatgtgtatatttaaatattaattaaattataaataatcaaaacctaacatttcatttgctgtttttatatattaaaaatgtctttgtactcttcctttgacctgttctactcaatttatgaatataaattacaaggataaaaaagagactaggactcactgtaaacagataaacgttactgataattcaaagcacacattttatttttggtgactgggattctaccttcatatataaaggacagcacatttattcatataaattttgaatatataaacataatacaatgttaatatattgttattatttgacagttatttatataatagtatttgggagatacatacaatcatatacaccatttgtccagttgcattacattttaagagaccattttaatttatattccaagcttttatttgcatgcgatctgttacagatggcctctagccatacttaccaagagctaagcattctcagctcttgtaattatggtaaatgaatatcaatcaatctgttttgccactttatatagaccataattccagatggaagcttgctgtttataaatctgaattcctgccaaaacagagatgttgaaattcgtttggatactatctatatgcaaaagatctaatacatatatatgcgtgtgtgtgtgtgtgtatgtatatgtagatataaaataagtaatatatataaaataatatgttatatatataacaagctatatatgtgtgtatatatatatatgcatatatctaactttctctactattggaattttaactctaaaaaagagcaattgtccagtatgaagtttagatggaaacctcatgatgtcatagcaacctgcaaaatagatgtttaaaatgaatctccaagtccatagagcactgccaatatgactcttttggattcaaataactcagccttatgggaattaaaaaatatgtatttattttgcaaatgaggactcaaaataaagtacatattttgaactcagtttaaaatggcttagtattattttttcagattgaattatttctaaatagaatacattaatttaaaatataccaggtggaatatagtcttaaaatgtattattacatataatggaataagcttacatgtgtaacttggtaaaattaactttttcattaatagggattctttgattttgctcactaatacatttcttgttctagaatagggcctcttatatagtaaacacccaatgaatttttgctgaataaattaactttgaaagtcaaactgcttgctacgttttgagtgtattcatgagaattcatgtgttggaaatttggtccccagcacggcagtgttcagaggtggggcctttaagttggattgggtcattaagaggtattaatgctgctcttgtggaactggtgaattcttagggagtgagcgagtatcactcttgctggactggaagagtttctatgagatcaggtggttattaatataaactgagactgctcctcatgttttgcctcttttgcatacactcacttgcacttccacttttgtgccatgttatgatgcagcacaaggccctaatccaacgctggccagatgcagccacctgatcttggactttccagcttccacaaccacgagccaaataaacctctttgctttataaattacctggtctcaggtattctattacagaaacagagaacagactaagacattgccattattcaaggttcttggaagtctttgataggagttaatatattggaaatatagctcattttacctttaatcttcctgagtctatttttaaaaaaagtaccaatattagtataaaacattgaggtcatgtaccttgggttcatatgttaattttgtataggtgagaatattcatttgggtctaaatacagatagtcctcaaattatgatggacttatgatggtttgactatggtttttgaactgtacaatgttgggaaaatgatacactttcagtagaaactgtacttcagattttgaattgatcttttcctggtttagtgatacgtgatataatacactctttgggtggtaggcagtgacagagagccattctagttttcactattggtagagtattcaatacattaggtattcacattttattataaaataggattgtatcagacaattttgcccaactgtaggctaatataagtgttctgagcagatttaacataggctaggccaagctatgatgttcagtaggttaggtgtactgtattaaatactgtattgtctgctataatattttcaacttacaatgggtttattgggacatagccccactatatgttgaggaatatctgcaatatatacatttatcaaaatgtgaaattactaaaaatttaagcaatagctaactctggcattgtatcttagacacccctgagactgaatttgccctgctaatgaactgaggcatatctccttgaattctttcatttttttttactacagtcctagcatatattcaacaattattttagtggcaagtatatatgaggcattatactgtattcagttaatgacaaaaagatgaatgacttttgatactcttaaaacgcctgtaattaacatggatacacagtgtctacaaaaataactacagtacttgacatcatgtgtaattaggacattgcatgcaaattaaagcacagtgagattccactacctacctattagaatggtgaaaatccaaagcactgacagtaccaatgttcgtgaggatgtggagcaatacaactctcattcatggtggtggaaacgcaaaatagtacaggcactttggaagacagtttcatggttttttaaataaaacagaatcctgcaatcagactccttggtatttacacaagtgagttgaaaaacataggtctacataaaacctgcaaaatttttttaaataaatttttaaaacctaaaagtaacaagttcttcagcaggtgattggctaaataaactggtatagccaggcaatgaaatattttagcattaaaaagaagtggactggccgggcgcggtggctcacgcctgtaatccagcactttgggagtccgaggcgggcgtatcacgaggtcaagaaatcgagaccatcctggctaacacggtgaaaccccgtctctactaaaaaatacaaaaaagtagccgagtgtggtggcgggcgcctctaggcgcctgtagtcccagctacgcgggaggctgaggcaggagaatggcgtaaacccgggaggcggagcttgcggtgagtggagatgcgccactgcactccagcctgggcgacagaacaagactctgtctcaaaaaaaaaaaaaaaaaaaaaaaaagaagtggactattaaaccatgaaaagacatagaagaaccttaaatgcaaattactaagtgaaaaaatccaatctgaaaaggttacatgatgtatgattccaattatctgacactctggaaaaagcaaaatatagaaacagaaaaagtatcagtggttgttatggggttaaggaggagggagggatgaataggcagagcacaagggaattttagggcaataaaactattctgtattatattacaatggtggatacatgttatttgtcacaacccataaaattgagaacaccaagagtaaaccctaatgtaaactataagtccactctgggtgataatgattgccaaggtagattcatcaactgtgatggaagtaccactctggtgcaggatgttgatagcaggggaggctatatatatgataggatacagcatatatgggaaatctctttactttctgtccagttttgcggtgaaccttctatccagtttggctgtgaacttacaacttcactaaaaataaagttgttgttgttgtttttttaaaaaagcttcaatgtgaataaattttgcagagtgccaacaaaaacaaaatccatgtgtttgggaatttataaaaggcagtttattggttctggttaagaaaaattttatgaaagatgtaaccatgatataaggttaatattttattacaggtaagagttaaatattgtatatgagagaaatggcagtagcaaaaattttagcaggtatagcactctcaaaatgcttttctgtggaatggcacatagtttcattggaccgaaaagcagagagcaattggtagagtaatggaagctaagatttagaaagcagacttgtgtaattttacagctagaatgtttgatgtgttcactcctcattttatacatataaggaaggaggcttacaggtaggataacacaattagttatgaatatttgtcacctaatccctagttctaaattgtattacattatactttagtaattacacagggtcctagaactttaaaataagaagtttaaactttaattggccatcagttttgttgttgttgttgtttgtttgtttgttgtgctttcttattttggacagtagcaaaatagaacatcatcttcgaatcaatatggtagaagtgagcagaatagattatggagaaaatggagatacccaaacatggagaacattcatatttggataatgcagacttgagctaaataatacattttataataaaatggatcatttttgtcagcaaacagcaaaaagattccaaaagcaaaatgatgtatttcagaactaaagatatcattaccacaacaagcttgatgacttctcctgaagttataaagcctagttttaaacctaatcactaaaatgaagtaagaaaaatattcctgcatcacaggactgttagctgtcatattaggcacacagcatgaagaaaaattgctgttgcatgtatgttctagttattacaagtcttttgaggtagagcaaaaggacctcatgacaattattcttatctctttggtgaagtaggagatacgtcatgatttgggtagattgataatgttcttaggaagtgaaattgtattcaagccttattcttgaaatgagaggtacaaagctcatgcactctataaagtgaaagaaagtgcagaataacttggggcctgaatagaacttaatgagaaacaagagattctcatggaacacaattgaaaagagtagagttgggtctgacaagagctgaaaagcttgtctttcttcccctttgtgaaattgtacagtggcttggaaattcttccctttgaataattgttcaatttttctctctgaattttaccttgaaaaaaaaataagcctctttgcaaattatctgcccattgtaaaaaattcagtttctctgagctcagagtttctttcctgcagcacacctcatgatgtgcacagatgtcatctggccttcttcctgttgctttgtgagaagtggggtgtggagaactatgaaaaatcccgatcctttggctattgctattcctagaagtaatccatggtcttttatttctgattagaagtcttgtatgttctgccagaatccgtgaaattgtagcaggctaaattattagcttgcaagtagggcacaatctcagctccttcacaattgacagttttcagattagaacatcaacattgctttagtggttgaccatgggaatctagtgtaaggaggcaagtgaagctgaaaagagtactgataaatggaaccatgagacaggaggaagtaactgaaagccttaactagggacaagatagagattgagtgttgttagaggatgagatgacaggtaagaaaattttgagtccctaatctgaggtcctatttagcctccacaggtttctgctcaccgcttctgaattccaacttctggttacccaaatttcagtttcacccatttgttacttgtatgtcttcttcaccacttactttatacaaaccctatttttaagtggtttattttcataagttgtttgagagtagacagtttgattgctcccacatgtcagctggaagtgcccttcctgtcacatctaaatgggattggtttagcctccattctgaaatttgaaaagtcaaatgctatcccctaatgttttgtgaattcataaggagcttttatttccatatcacctttggaactgaacccccaccttctcagaattcttgctgttcactctgtcgcttgtggatcttcctttgccatcaaactagtatcaacacagaactcagtcccttccttgactccttttccatcataaccactcccactttccaactctatgttctttttctttgttttgggtcttcctaatgttgtggaagaatgtcaaagtagtggcaacaacttattagttatcccttctaaatgctctttgactctttttcatgctgcttttccatattccattatattactaaatttgaaattgattcatgcttcttagaaacataattgtatcatgttattatatataaaatattatattacatgacataatatgcagttattatggtagtaataacaatgatataaataattatcttatttaggtaaatccagtacatactcagaattagcactgagcctgtttgcagtttcaattcggctgaagctttgaaattactttgcagggccattttgttcaatgtttagataaaaatacattttaagctctgagtgtgtgtgtgtaagtgtatgtgtcattatatgctttgggatggggttcatttgcatagttaactttatttcattcttttcatatcctatcagttgcatttttttatcttgaatacattttatattcatttttatttatatttttatttacatatttatttacatacagtaaaattctctttgttatatacagttctatgggttttgacaaatgcttagagctatacatctaccaccacaaccataacattgaacagttccattgtctctgaaattccctcattcttcctttttgtagacagctcctctaaccactggtgggttctcttgtctctattttgccttttccagaaagttatatgagtggaactgtggaacatatagacttttgagtctggcttctttcatttagccaaaggcagtggaggtggtatgtgaatcaatagtttgttcattttaattgctaaatactatttctttgtagggatataccacaatttacccatttacttgttgaaggacatctgaatgatttccatttttggcaattatgaatagagctgctacaattgcatacaagtttttatgtgaatgtaagttttcattttcttgtttaactttataacaagttgccaaactgttttcaaaagtgacggtacccagtttacattcacactagcaacgtatagtgtgtcagttgctctactcttcactggcatttgacattgtcagagtttttaatcctccattataatagtgtatagtgatatcttgaagttttaatttgcattttctcatgaatagggctattgaacaccttttcctatgcttatttgcatccacatattttatttggtgaagtgtttgttcagatctttgcctacttattaaattggattgcttattattgaattttgagaattatttttatgttctaaatacaaatcctttgtcagaaatgtgatttgcaaatatttcctcctactctgtaacttattttgacatttttaaaattgtgtgtttcacagagcagaagtttcttctttgttaatatccaatttatcaatttttctttcacaaatgatatttttgtgtcacactgaaggatgctttgcttaaaccatgggtaaacagatattattctatgtttaatactaaaatattctgtagttttatgttttaaatttactctatagttcattttgagttaacaaagtgtgaagaatggtcaaatttcatgtactttttggtaaacgaatgtctaataatttctattggccattttaattttatccatttttaatttatcaacttaattcacttaactatttttggattataaagttaatgcaattattttttaaaaatgaaagaagaagtttaattttttaaaaaaaaatccttattctcactacccaaagatattcactataaacattctggagcatatcttttcaggctttattcctcctgcactcagttgataataaattagtgaagatatgaaactattcacaaatgtatcagtgtattgatttttattaatgtaatttacctagcttaaaattcactgttttaaagtgtatattttattggttttaaatatattcacaaggctgtgcaaccatcaccactatatagttgtagaatattttcttcattccagaaaaaaatcattcacacctgctagcattcagtgcttattttcctgtccttccagcccctaacaactattcaactttctatcttaatgggatttgcttattctaaacattttatataaatgtattgatacagtatgggaacttcctatctgttttctttcatttagcatgttctcaagtttcaggcatgttatagtgtgcctcagcatatcattctttttatggatgaatattccattataccgatatgccatattttgttaatccatttattagttgatagaagtttgagttgtttccatttttcagctattacaaataatgctgctatgaacatttgtgtataagtttttgtgctgatatatatttttttgttttcttggatataaacccaggaatggaattgttgggtcatatggtcagtttgtgcttaactttttggagaactgccagactcttttcaaggtagttgtaccatttagatccccagagcaacgttatgaggttcccatttctccacatcctaacatgctaacatttgttattttctttttgtcttttcatcacagccatcctaatggatgtgaagtagcatctcattgtggttttgatttgcatttccctaatgactaatgatgttatgcataatttaatgtgtttattggatgtttgtatgtctttggagaaatgtttattcaaacacttagcccacttcaatttttttttcagtgttaagctgcaagagttctttatgtaatctagaattagacccttctcaaatatataatgagcaaatattttccactctttgggttggcttgtgacttctttgatagtgttatttatatgcaaaagtttttaattttgatgaagtctaacttctctattttttctttggctgcttatactgtatatgtcatattttaaaaactgttacttaaagcaaggtcataatgatgtgtacttctgttttcttctaagattgttatagctttagcacttgcatttaggtggttgatccatgttgagttgatttttggatatgatatgacataggtattcaaattcatttttaacgtgtgcatatctagtagtcacagcaccatttgtggaaaagattattatttaccagagtgaattgtcttggcacccttgtcaaaaattattttacataactatatgtgtttacttttggatgctcaattacattccattgatctacatgtctatcttcgttctaataccatgctgctttgattattgtatctttgcaataaattttgaaatttggtagcatgagttctccaactttattctttttcagattgagcttttctggattcattgcatttccatatgaaatttagaattagcctgccaatttttggcctccttccaaaaaaagacatttggaattttgatagggattttgttgaatctgtagataatttatagagtattgccatcataaaaatattgtcttacaacctataatcttggagtatattttcattattttaatcttaatttatttcaataatgttttgaaagtttacagtgtacaagtcatttattttgttaaatttatttttgcctattttattctttttaatggtataaaatagattgctttcttagtctcagtttagatttttcattgctagtatataaaatgaaacattttaaaaatattgacatcatttattaattctatcagtgtttcaggggattccttaggattttctctatacaagatcatgtcatctgcaaatatagttatatacttcctcttttttcatcatggatgcttttatttttcttgcctaattgtcttagctagaatctccactatagtgttgaatagaagtgacagaagcatacactcttgtctccttcctgatcttggggggatattatgcttaatgttacttgttggttttttgtagatccccttaatcaggtggaggatgtttctttaagtccccagtttgttgagcttttttgtcatggaagcatgttggatttttctcaaatacttttcctgcatctctttagataatcatgtgtttttactttattttatgagatattacattgctaatttttatctattccatcagctttgcatttatccatatgagataaattccatatggtgatagcatatgcttttgtatatgttgccgaatttggtatgctaatattttttgaagatgtttgtgtctatattaataaaggatattgttctgtaattttgttttcctgtgaaatcattgcatgattttgggataaggctaatacttgccttatagaatgcattggtaagtgtttcctctccctcttctaatttttggaagactatgtaaagagaagatgttaattctttttaaaatatttgataaaatcaccagtgaagccatgtggtctttggctttctttgtagaaagtattttttttttcaatctgtttaatcatcacaggtttatccttttttctactttttctagactgattgtcttactccatttggggtgctaaaacaaaataccataaactgagtagtttataaacaaaagaaatttatatcttacagttctgaagtctgggaaatcctagatcaaatcactggaagatttaatttctgataggggcctgctttctggtgcacagagagtatcttcttgctgtgtgctcacatggcaaaagatatcccccatcctaataccttcacaatggtgattcggtttcaatatatgaattttggggaacacaagtatttaggccatagcaattagttttgttagttggggtctttctatgaatttgttcattattaaacatattaatctatttttttggtaaacagctgtttgtagtatcaccttataatcttttttaaaaatgtaagttggtagtaatatacttttttttcattcttttagtaattttagtattttctttctttaaaaataatttattctagctaaagatgtatctgttttgctgatctttaccacaaaccaaccaacttacggtcttattgattattctctgttttttctagtatctatttcatttatttctactataatcactattatttccttatttctgcttgtcttgagtttagtgtgatttttctttctagtttattaaggtggaaggctgttttttgtttgttttgttatttttgtttgtttttgagatctttcttttttaaatgcaggcatttacagtcaggttttgctcaaagaagttattttgctgcatcctataagttttgatacgttgtgtttttattttcattcatctcagagtattttctaattacctttatgacttcttctttgactcattagttttgagagcacgttgtttaatttccacgtttgtgaattttccaaattgatttatgttgttgatgtctaatttcattatattgtggtcataaaacataccttgtatgatttaagtcatttttattattttgagacttgttctatagtctaaaatatcacttatcctagagaatgctacatgtacaatagagaaaactatgtattttagctattgttggatgaagtattctgtagctgtccaaacaggttggtttatcacattgtcaagttctctatttcttttctggtcttctgtctagttattctatccatttttgaaattgggttaagtctccaactattatttctgaactatttcacccctccattctgtcagtttttatttcttgtatcttgtggctctgttgttaagtacacatattgaaaattgtcatatattcttgatggcttgacaactttatcatgaaaaactgtccttttttctctatagtacaacttttgccttaaagtatatttgatctgatatttttataacctctccacttctcttttggtttccctttgcagcgtatgtgttttcatccttttactttcaacatttttgtgtcagaatatcatatatgtccattgtatgcatatttttggataatttttatccattaatttagtccattaaaattaatatcattactgatacaaaataacctgcttctattttgctatttgttttctatgtctgtgtctgtttttcttccccgcaattccttctttactgtcttcctttgtattgagtagttatttttttgtttaccattttaatacacatcttgtttttttaacaatatgtttttgagttattttcttagtggttgttgtggggattaccattaatatcttaatctataacaatctagttaacatttataccaacataatatcaatagtatataaaacttgtgctcctaaatagtctcaactagtccttatgctgccacagattatatctctatacattgtttgtccatcaacacaaggttataatgattgaattatgcagttgtcttttaagctaggtaggaaaaaagaggtacaaacaaaaaatacatcatttatatttaactctcccttcatatacttatctgtatggttacccattagtagaggtctttatttcttcttgtggattcaaattactttctagttttcttcatttcaagctgaaaaattccttcatcatttcttttagttcaagtatgctagtgacaaattctttgaatttttgtttatctgggaactaatttatccttatttttgaagaatagattttctggatatagaattctagttgacaggattattttctttagtgctttgactatgtacattctggcttccatgacgtctggccattgctttggccttcctaatttcttattagaaattaactctatcttcttgaaaacatcccgcgaaaaacctaatagcagcctagcctgaacacacctgtgctaattaaatgtgtattttctagttctgatattcagcaaaaaggggactcacactcagcctgtctcagttttcatgctaaaccatatcagctagatttgtttaagtttattatttgaagttttaacaaatttatttaggtatgattgacgtacaataaattgtacatatttcatatgtacaacttgatacattttgacatatgaatgcacatgtaaagcagtcaggataatgaacatatccattactccccaaaatttcctaatgcctctttgtaatccattcctcctgcctctccatgacccatctatccctatctttaggcaagcactactctgctttatgtcactatgctatatagtagtttgcaatttctagaattttatgtaaatggaataatcaatgcactctttttttgacttgcttattttcactcatccatgttacatgcatcaataagttatacctttttattgcctactagtatgccagtaggtttgacatatcattcgcctatttgtctgttgctgcacatttggattgtttccagtttggggctattttaaataactatgaccattcctgtatttaaaaaaaaagatatcaactctatcttataaaggatcccttctatgtgatgagttacttctctcttattgctttcagtaatttttatttgtctttggctactgacagtttgtgatgtatataggtagcttagcatttttggctgccataacaaaataccatacacttggtggcttaacaaacagaaattaattttctcatagttctggaaacgcaagtctaagatcaaggtgacggtattgtcagctcctagagagagctctcttcctggcttgtagatgaacactttctctctgcatactttcatggtagagagagagagcgctcatgctctcaatatttctacatataagggcaccagtcctattatgagagcccattcttatgatctcatttagccctaattgcctcccaaagccccatttccaaataccattatatttggttagggcttcaacatatgaacattgaggggaacacaattcagtccatagcactgtgtgtggacctctttgagtttgacctatggggagttcagtgtgttttctggatgtgtaaattaatgttcatcaaatttgggaagtttttcttctgttattatttcacatattctttctcctcatttctcttttgtttcctaggactgattgatgatatcttgcaggcctctaaggttctgttcacttttctttgttattcttgtttttgttcctcagataataatatcacttgacttcatgctcattgatacttccttcttcgtgttcaaatatgctactaagatactctagtaaatttttaatttcattgattctccttttcaaatccaggatttccacttggtcctttatttttttaaataatttccgtgttcttattaatattctccagctagtgtgacaatgttcttatactcttctttagctctttgaacatatttaaattggctgatttaaagtctttgtccagtaaatccaataaactagtttcctccaagacatttcctattgattgtttttattcctgcttgtggaacatactttcttgttcctttgtgccattcattttttaatgaaaattgatattttaaataatattatatgggatctctagaatgagattcttgtctctccccaagatttgctgttgctgcttattgtatttatagttgttaattgtttagtaaattttctaaatttaatttttaaagtctatattctttgtcatgtgtagcaactgaagtcatttctcagcatagtgatctaataatagaacagtgatttcctttaatgcttggaaccaataaattctccagcctctgccaatggggtctgtagtctacattagcacaaatatttgacattcacctaaagttgagagctctttcctaacctttacctcttgcttgtacagtgccttaagttcagtcagaggtgaaagcttagcccagtcttagattttttctgagcatgcacatatatctgtacatgtgtggtcatctggattcctagggaatatgctgcagagtttcaagaatctatggattttttcattcgctagtttttcctttaagctttttgtttagtttactatttgattcaactgttatccacagctttaggcagctgcaaagataaaacattttcctgtaattgttttttacatgggtgctgaggagaaggtttttcacactgggtgaaatccaagtcaggtcgacaagaggcagcctgttaagtggggtcttccatggaagcactagacatgtaaaataatgtgataattctttaggattgaggcgttgaaaaagccccagttccattctcctttctctggtggctaccaggctgtataggaatgtgggccattgtgaatagtgccgcaataaacatatgtaaaaaacatgtaaagtgcatgtgttctttacagtagaatgatttataatcctttgggtatatacccagtaatgggattgctgggtcaaatggtatttctagttctagatccttgaggagttgccacaatgattcacaatagcaaagactttgaaccaacccaaatgtccatcagtgatagactggataaagaaaatgtggcacatagacaccatgggaatactatgcagccataaaaaaggatgaattcatgtcctttgcatggacatggatgaagctggaaaccatcattctcagcaaactcacataagaacagaaaatcaaacaccgcatgttctcactcataagtggtagttgaacaatgagaacacatggacacagggaggggaacatcacacaccggggcctgtcgggaggtggggggctagcagagggatagcattaggagaagtacctaatgtaggtgacgggctgatgggtgcagcaaaccaccatggcatctatctatctatgtaatataaaactgcatgttctgcacatgtaccctagaacttaaaacacaataaaaaaaggaaaaaaaatgtggaccattatttttcaaggctactgaaacatacagagcagaagatgaatctagagcaagctaaaacaccccaaatttttaggttttttcaccaagacttagcttttttatttctttttaacaaatacatattggattgttgtgaaactttgataaattaagagtttttgaaaagttgattttgacagtgtttgccagttttaaaattgttttatgaagagcaaattttcagaggttctttctctgccattttcactgattttacttctgtgccctggatttaaatagtacagattaagtttccttctttgaacagtacaattttagcctgacactttagtttcgggtcccctaaaggagcaagcaaattggtaggacactactcattgaatgatgtaagacagtttgccagtcattatccacttcacttactgttacatggtattgtactgttcagctgctctggctctgattcactccattaggtcatgtttcataagagatttttaaagttcaattgaaataattaatcagaatcatgaatcggcattaattggaggctcctaaatgagaaagtagttaataatgattacgtttgaagttaaaatagatattatatcattcacattagaaaaggtgaacatatcactcatgttcagaggatccttttccttagtaaaaatgcattcatacaacacatggcactgccaagatttaaaattcatacatctgtaatatctgtgaacatggcaaagatttgcctttcaataattcatataacactctgtcataggctgagacagatcaagatatgtggagccccacagcaggttggtaacttggcaccacttaaacagatactttaaaaatattctttcagcatttatttggtggatacagagggaaattgattttttccttacttatttattttcatatcaaataactttaaaacactattttattattttattttaattaattaacaaataaacattttatatatccaaggtatacaacatgacgatctgatatacacatatacattgtgtaatggcacaagtgtatagtcaagttaacatatccaccatattcatagataacatttttatgtatgtgtgcatatggtagggacatttaaaacctgccctctcatcaaatatcaaataatacagtattgttaactataatcaccttgctgtacattagatctatagaacttctttattttattactgaaagattatgtttttgaccaaaatctctttatcccatcctccagcctctggaaatgactgttctactctgcttctatgagcttgatctttaaaacattccatatattagtaaaatcattcagtatttgtctttctgcatctggcttgttttgtttagcgtaatgtcctctaggctcatccatgttgttgcaaatggcagaatttccttctttttattgttgaataataaaaacacaggcaaaaaaagcaaaaacaaggcaaggcaggctacatcaaactgaatagctgtttgcagagcaaagaaaaaaattcaacaacattgaaagacagcctatggaatgagagaaaatattttcatatcatataccttacaaggggttaatataaaaaatgcaagatactcaacagcaaaaagtctaaacaacacaatttaaaatgtgcaaaaaccagaacagatacttttccaaataagacgtaaatatggccaacaggtatatgaaaagttcatcagcatcactaatcattggggaaatgctgattaggaccacaatgagatatcacctcatacctgttaagatggctatcaaaatggcaagaaaaacaagtgttgatatggagaaaagggaaccttggtgtactgttggtgagaaagtgaatttgtatagtcattatggaaaacagtatagtttcctcaaaaaattaaaaacagaactaccatatagtgcagcaattctacttctgggtataaattcaaaagaatgaaatcagtatcttgaagagatatctgcactcgcatgttcattgcaacattattgacaatagccaagatatggaaaacaaacctaagtgtctattggcacatgaatgaataaagaaaatagtatatgtatatacacacatgcatatgcacaatggaataaaaaataatacaattttagtttacttggaagtataagttgattttttactttaatcagcatttaaagctgggtgattcagttatattagtcaaaagattaatttcaataaatactttgatgtagttatccaaaaatatttagttcatttgctttaaataatgctgcaagtgatatagaaaaaataattattaatcttttagttcctgatcttaaagcttttacgtttatgttagaataccttattaaatatcataaaaccaggacttctgttcttcatagctttcttctgttctgtgcctccagaactacaagttaagtcaagttcgcattttgaggtgtttccttttgtacaaaagctctcattcttttgtacaggcaaggcttcattgctgggtattgtattggagttttgcaccaaatggttcaccagttagtaatgtttaagaacttgattaccatttgggatagagagtataattctgattaaggctagaatgtagttctaagagtcttaatttaatgctgcttgataaaaatagtgacttagaatactacttgataaaagtcatggtcagaatatgtggctcagactcaaagtttctgactttcctgagtgactacattcaaatatctatccaattatcatctctttatttgtagaagaggaagaaatgaagtaagagcaagcattactagaagaatgttgactttcccttcacactaggcccaattttcctctgctttggttttctctgttaacctaattggacttttaacaagtaagactatggtcattcaggtatttgactatttcttcttgaaggagggtacaaagtgaatattctggaaactctacaatatcttcgattgctactttaaattttagggagatgaatgacataggtgatatggtggctcataagagcaaattaattacaaatttattctctattctatgatgaaacttttccttttgtattatttcttgaactagccaagcctatcaaatggttatacaaagtgtactaccttctttacttaatggtagcctttgatgaaaacaacaaaacaaaaaacaacaacaaaagggggattgagatcttagagtggtagaaggctgagaaaacctaaatctacatcacatttcataacataaaccaagaaaatgtgttgtatgattacctgaagaaccaataaacctgaattgaactaataacagtaaatgtaacatctggtaaactacagttataatgcagtttttcttatgtggacaagaaaatgagaggctaactaaccatttattctatgaattaaaagaaagcctcaaatatttattccctcaaagtcatgttctatctgctaaaaatgctgatcaatgttagcttaattatagaaaactgtattttatttatagcaaactggatgtttactggtagaactgtgcataaatatacactcattatatatttagtgttcatttaggctgctcaacatcttggtctattataggggaaattgtaataagcttgaagcatagttcttagccatagtatgtatattgatatcctctttttaaagaccatttgcaagatttgaggatcatttttaggtatgattagaatttcctaatgagaattttcagtctattaaaaatggctacaccagcactatccaatagaaatataatgtaagccatagatgtaatttttgaactttctagtagtcattttaaagtaaaaacagataaaaataattttaacaacatatttcatttaacccaatatattcaacattttaccatttcaacatgttatcagttcaaaacaattatgaagggaggtattttactttttatgttttagagaattatcatccgggcgtggtggctcacacctgcaatcccagcactttgggaggctgaggtgggtggatcacctgaggtcaggagtttgagaccagcctggccaacatggtgaaacccatctctctactaaaaaaaataaaataaaatacaaaaattagccaggcagtgtggcacgtgcctgtaatcccagctactcgggaggctgaggcaggagaatcgcttcaacccaggaggcagaggttgccatgagttgagatcatgccattgtacttcagcctgggcaacgagaatgagacttcgtctcaaaaaaaaaaaaaaaaatagttcttaaacagcccatctcaattcagactactcacatttcaagggctcaatacccacatgttgctactgactactggttggaaagtgcaagtttctacnnnnnnnnnnnnnnnnnnnntattatgtataaaatatagtaaaattttgtccttaattctgataaggaagttccttattcctactttcctgagcagtttttattagaaatggatgtgggattttgtcaaatgtgtttttttgtgttattgagatgaacatttttctttttagtttgttaatacaatggatgacaattgattttctaaatgttaaaccaaccttgtattccattgataacctagcccttgtagtattggcatggtgcatattcttctatccctttattggttaactatttgtgactttaaatgtgaagtacattttttgtaagtggcatatatttggagcttgccttttaatctgatgtctgactttcaattggatgttcattagaacatatacatttaatgtggttaggtttccatcatcatcttgctgtttttttttttttttcctgtttgcccaatctgttatttgtttttttcaccttctttttcctgcacattaaaaattagttaaataccaatggttactttagggtttacagtatacttatttaccttatttaagtctaccttcaagaattattatgccacttacatgatgtaaggagcttaaaatacttctatttccttcttggtttatgctattgttgttatatatttctcctatacatatgtgataaatcccaatatacactgttattttgttcagatatcaattatatttaaagtgatttatagaaaataacaataaaaatcatatattcatgtggttactatttctggtgctcttcttccctttttatagatctgtatttccaactgacatcattttattctgcttgaaagacatttctgcctaaaggatattgatatttattataaacagatctggtagtagtgaattattttagctttgtatgtctgaaaatgtgttttggtttgcattaattttttataagatattgtaagtatttgtatatttctatttttaatatcgcattctttgtattcttgtcatatctatcttgtttattttttaatgtttccttatccactacttttaactgtaaaattattttttattcaccttccctcttgattggtttggaatttataaattagaattatcttagaagtttctgtttaaatttgaaaatgcaaacatattaaattctacatcttaatatttctgctaatcctttgactcctaccatattgtagtgaattaaaatcttttgttatcaagggtttaatttttttcttttgaactccagaacatggacaatagccttcttcttcttcttttacatttcttttaaaatatatattataaataacataaatatcaattatccttactagatccacttgttttcagactcatcttccaatttactagtttttttcgtttttcttccccctactttcttttcctatctgtggggcttttactctgcagaccttttttcccccctgaaactattgctttagaagttcctttagttaaagtctgtgaatggtaaaatttcttaattttctggctaaaaaaaatttatttatatctcttattttaactttttaaacatttaaatatttacacacataattttattttctgtattccattttacttcctattgagaaatgtgcagttttattgtctttttgtagtagaggatcagtctcttgcttgacagtcttaaaatttttatctttttttgggtattctacaggttcattgcaatgttctaggtgtagattttaaaataattatcctacttgatatatgacatttttcctaaatttctgaattcatgattttgtcacttatagaaaattctttcattatctccttgaatcaagaaaaaaagatattaaagtgactagacagatttataaaataaaacagaaaaaaatgtaaaatgcaggaactcaattgtttcaatagaagcttagataacattaaaaagagatttagtgcactgaaaaatggatgtgaagatattgtcgaaaatgtagtcatttttatattattcctttccctccaattccttgcacttataaaacagctacatttacccaaatttactagaatccaagacttcactgcttctccctactccctccagtcctcagatgttatggttcctggtataggaaattgctctcagataggcctcagctctagttttctgttatagctcactaatctggtttcattttagcatttatttaaattttaattttggggtccttgaagatttcacatacatatgtgtgagcttaacaatacatttaaaatgtggttgtttcttctccccatacaaacctctatctatctgtctgtctgtctatctatctatctatctatctatctatctatctatctatctaattatttgaggaaacagtctcagatttttcattttagaaagatactttaggcacctaagagaagaatgaaggggccaaaatatgaaacaggtagaagaagtagtaaattgaataagtaatccaagccagagatacaagcaagtatcgacagattagagaagtgtttaacaattaacacttagtaactggatatgtaggaggtgtaagaaatcaaagatgacttattttaaaggtgaactgaacgttatacggtattcccttggtatccattagggattgggtccaggaacttcctgtgatgctcaattccctgatagaaaatggtctagtatttgcatataacctatgcacatccctttgtatactttaaatcatccctaggttacttataatacctaatatgatataaagactttgtaaatagttgttatactatatatttttttttactattatatttttattttttcccaaatattattcatccatggttggttgaattggcagatgcagaacttgcagacccaaaaggtcaactgtatgtaaattattccatatttgttaaagttacagcatgattgttataaatttatgagctttagttaatatttttctattgtgttagtgacatgattgcatttatggacatttaccattggctccagttcaaatgatagatctttgataatgggactttgggaaaatggagatagacaaattttcacattatctactttctgtaaaaaacaaatacctttcagttctccttttccctcttctagacaaagtctgtttacttacttcagttccagatacaagatccattgtttaaagtggcataccttgttgagagggaattacaagttggctatttttatgttgttcttttattgttttattaatgccttttcatcaaatactttgactccaacttataaattccttggtatccactggctcagataaactataatgttatattctgaaacatcagtagataaaaactgtcagcatttcgtcatgtgcttttaaaatttgaaaagcttatacaaatattaatgaatatttaaaatattacagtttcttgtaatatcatattgtttattaactaagctagagactaaagtttatctggccctgtaattgtttttaagaatcggtgaaaatttcccaacttttggaaagacatattttgtaaatttttattctattggcttttttctagtacacagttacagcttaaacattctaaaatattgaaagaaagtgttgttagtaataatagattaaaataaagaaatgtatgacatactttaaaaagcctatttaccaattttaaaaatatagtattgttattattcaattatatctgcttattatatatttaaaagttaaaaaaagcagaagaaaaaaagaatcacctctggtttgattatctagagatgtctactattaataaaaattacgtatttggggtatgatatctgattctagattctttaagatcacctcttaactttttctagtctccttaattctagtgtacactaatgtcaaataagataattattcattttgaaagctttcataagaagatatttgttactctctgtaatttaatgtcctactatatattgtgcattgacagaaataaagcagcacttcaatatgcaaacattgagacccagctggaaagcatgcaatacccactgaggcttctaatgctatgtgaaatacacaaagggtggtgtgctaggctaaccttttcaaatggcagaagaaccagttcagaagactaaaagcttttctacttactttcccattcaattaaacatctacacactggaacatgggtgttctgatcatttcccatctgctgtgagatactaaggatgtaaactgaggttttaaacactagtctatacacagtctttattttattttattttattttattattattatactttaagttttagggtacatgtgcacaatgtgcaggttagttacatatgtatacatgtgctagctgttgtgctgcacccattaactcgtcatttagcattaggtatatctcgtaatgctatccctcccccctccccccaccccacaacagtccccagagtgtgatgttccccttcctgtgtccatgtgttctcattgttcaattcccacctatgagtgagaatatgcggtgtttggttttttgtccttgcgatagtttactgagaatgatgacttccagtttcatccatgtccctacaaaggacatgagctcatcattttttatggctgcatagtattccatggtgtatatgtgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttttgtgtctctatttcccttcagttctgctctgattttagttatttcttgccttctgctagcttttgaatgtgtttgctcttgcttttctagttcttttaattgtgatgttaggtttatacacagtctttaatttatacacagacctgtctcacagttgaaatatacatttgcatttagcgtgggcagaaatgagcaaatttggcacttgagggtatggataatatatttggggagatagtagatttctgccggcatagaaatagtttggcagatagtttagaagtttggaggataattaaattaaaaattaaataaatattacctttactaatctcctatttactgaatcacatttaaagggaaattccttagaaaaataatctatggaaatgactaccttataaagttgaatatttcagtgcaaagacaccagaacatatctaaattaacaatcaggtaacactttagttggtattttaaggcatatatctaatctcaaatctctaattcacatttgtcaaggaattaatattccaaatatacaaggaactcaactcaacagcataaaaagaaataatctgatttaaaaatgggcaaatgatctgaatagacatcacttaagagaagatgtacaaatggccaacaagtatatgaaaaaaaaatctcaacatcattaatcgtcaaggaaatacaaatcagaacctacaggagataacatcttaccccagttagaatggctattatcaaaaagacaacaagaaatgctggagaggtcgtggagaagaaggaataaacataatagtgtttatttcttgcaaaattgtcctccttttgatgtattatacaaggttggtgggaatgtaaattagtatagccattatggaaaatagtgtggaggctcctcataaaactagaaatagaatggcaatcccactactgggtatctatcaaaggaaagaaaatcagaatgtcaaggagacatctgcactcccatgtttattggagcactatgcacaatagccaagatatgatatcatcctaagtgtcgatcaacagatggataaagaaaatatggtatatatacccaatggaatgctagtcagccataaaaaagaatgaagtcctgtcattcacagcaacattgctgagcccgaaggacattgtgttaagtgaaataagccacgcacaaaaagataaataccacgtattctcactcatgtggaagctaagaaagttggtctcatagaagtagagaatagaagagtggtaactacaggatgaaagggtgaaggggagagaaaatagggagaagctggttaatggacacaaaattatgcctatataagaggaataacttctaatgttttatcgtactgcagggtgactatagttagcaacaatatattgtatatttataaatagctagaagagaggatcttgattgttcccagaacaaagaaataacaaatgtttgaggtgatgaatttgctcattaccccaatttgatcattacacattgtacacatatataaaatatcacaccgaaccccataaatatctacaattattgtgccaattaaaattttttaaaactctaattaaaagatcatttgttttagtatttaaagtgaccacatatataagaattcatttaaaactttcttcaacaaaatattacactaattccatttggcaaatgcttttcatttccttatgcattttctctagttaaaggttatctttgccataggtgctagttagctaacaatcattcaatgatacatagattcacaagcatctccattaatctctggaaaatcaagtatataatatatataatcagaaacacatttattacttacaatattttttaatttaaaaattttgagaattacattgaaatatcacaataaaatcttttttcatgaaaagccctagttacagcaataaaatattaaacattattcaagaggaggataggtccattttgtatactttagaaaaactgccctcaaaaattttcattttttcaatccatatagaattgaaaagttgtttctttgcctttttctttgtctacagctgaacaatagagtttcttgcaaaattttcctccttttgatatattggaaagcgaggcaagagtccccgttgacttagctgccagaaaagacacccttctccgcctgggtttgttttgctccagtaaataaaaacaggattcagttgggctctgagcaaaatctgttcctgtatgcaattttgaagtccattacgggtgcccctactgagcacttagtttacctggccagggatgactggatatggccagctgacaactccaccccaccccactcccctccccgcatccctctcccgctgagaggcctacagcgagcggggtcgggtcctgggtgctctctggtcttgtctgagcgggcaaccttttctgaaggcctctgacccttcctttgctccccagacacccgggaagggcagaaaaaagggagaaaggatcccggcgttatagtcctcgaagataattctaggtgggagtgaagggactgggagagtgtgctgccgttggtcgggtcgggacatacagggaattagaagagaaggactaaagccagagggacccctccggcgaggcgggatggattagggtggggcctgctctctaggggactctcaagctcttggaaggtcacgtgctcaaactcggcgtgaccgtgcctcccaggccctgtcccccaccacccaggggaggagaaggcggcggcggcatccacggatcagggtcaggcccgcggcttcgagcccgcgtctcctgctcctccgagagacccaagctcatgctcgggtgaagcggacgcagatctcatccaggccccagcactctgggtactgggggcgggggacgtcagcgggagaaaagccttggccttcctcctccggccgttgccgcggcaactgtgatgtctgaggcggagggtcgcgggttgggagcactgctccccctcgcggagcgcggcgcccggagcgcttagcgcgcctgcaggtcgggggaggcgaggaggaggctgacagggtggagggcgcctttctccctgccaccccctccagcgttgctatggacaccgccagggcaacctcacctgtacccgctgctccagccgccgccgctgaagtagaaacagcaacccgagctctcttttgccccagcatctcttccagggactctaacccagcagctgccaccgcttgtctcccacaaacaggaagtgagagggcagacgtccaacatttgtccttgttccattaccatgcctgcctttatttggctttccattctacattttgtatctcagcatcttccagagtaaatggtctagaggatggaaaacgcttccttttataccgtctgccacgcctcttctattagcagacagctggtttaattctacaaaacactgtcctgggccctatttaattatcagaagaaatatattttaaaagtagcgtgtttcttgtattacagcagatatgtagaatccctagttttcattagaaggatatatagctatttataggaatgttctcttgctgctaagcacccctgaaataaacactttttgacaaatgagtagaacaattctgtgtcaggatatctgggatacatagtacgtaaaaacgagctgtttagaaaccccttcttttcccatctcatttccagttctatatgccagtgctaaaatctcttttctgggctctaatccatctgtgtttgaggtcagtttttgactttgcaaggggatttatttccacatggctctgtttttgaactcgagggtggggggtaaattaaatattcgactacttacactcagctcaggtgcaagatttagtgcatagatgcatctctactgactaccgacgtaaatgcacttagtaaaaaagactctccctgattagagcaaatggaggcatctgtgatcttgaattgccagccataccctggcaggctctgtgaactactgttggtcacaaccccttgctctcaaatttcttttctgttgagtgtatatatggtaaagctttcattctctgaaagcaccccggtagcttttgctactgataatcatgagtttccttacatagttctgcaagtttgaatagacaagccttttcagctgactttgatactacctctttagaaaatcccaacaatgcaagataactatttcttttttttaaagctgataggtgggatacttaataatttcattttgtcacactttctgtgtcatggtgttttcaaagccactaaaagagattttgatatagtgcaagccctaggtaaagctatgaattcgaaacatgtttatcttcaatgtcctatctaccctgttcctacctctcccaaaggtcacctggattcctaaataccaaatcgaatggtccctttcatttgtcatcctacttaacctcttataagaatttgacgctcttgatctaacttctcattttccttgataatctcttcccatcttcttgtgctctctgacctatttgaaggtcccttctcagtctttttacttttctcttttccttttttgatactgtattttgatctgcttttttttttcattctgcatattttcctgggccttttcatccacatcaattgttttatctgccatcttattttcttgtcttctaaatctgtgttatcttgtgcaaacttttctctgagctctagaccttttttctgagctacttcatggacaattctatatatcttacctgcaggcatctcaaattcaacctgtgactcactgaactattttcctatccaaaatttgattttcttattgtattttctatctcagttaatgaccctatgcccctacttacacaagatcagaagcatgagggccatttattgaggtatatatttatctaatgaaattttcttactggcatctaccatatgccagacagtgtcatgaagcttaattctagtagaaaagaaagattaatgtatttatgaccaagtaatataattccagcttttggtaaattctactacagaaataagccaggtgttatatgataaagaagagctgagaagagtactctacacaggatggtccaaaaaagttttatgtgttaaaccaaaatgaagaatgagaagaagccaaacatgtaagttgctggagaaaaaaaacatgtcaggcagagataatagcagtcacaaagatcctgcagtgggggagggcctcctgtattcaagaaaatgacgtaaaagccaatatacgtgatgagaaggggacagtggggtgtagtgagtgtgggaaggaggcaggggacagattttgtatgactctgtgggccatgatgaggaatttggattttatactatgtgcagcaggaagccattgaatgtttttattaagagtggctgaactgtttcatacttatagatgatcattaggctgtagggtggagaatgaattggaatggtgacagtttggaagtggagaggatattaatgacaatggaagtgttccggatcagcgatgacagtggtacggaagtagagagggagacgagtgaacagacgtgaggtattttcagtgatcttttgtctttatcactcactattgtgtgtcagtctcatttctgtccttagagcactccatgccatatggagctttccacatcccaagtccttaccgataaatcctatttttatggttcttatacttttagaaccttaactgaatgatagttacatgttacctgacaaggagaaggtagagaacaatagttaagaaagtaggctccagagttaagctgccttggttcatagccatgctccaatgacttactagcagtgtcacttgggcaaattgtttaacctttctgtttcattttctccagctacaaaataggaataacagtaataataattatttacaggatattatggggattaaataatgcatataacacacagtatatggcaagtctcagtaaattttagattatgatgttgctgctgatggaaaatgatagaggatgtaagatcttactctgataaacattttaatataatgcacgggaagttctgcagcctttccttgtaacttgttagtaagactaagaatcagaagaggaaaggcatcatgtctggcatggaaggaaatgggaaatattctgacaaacaggcatccaaaatagttgctcatcaaatctcccttcttggggaaacccttctataggaaagcattttctgttcctttctgatttcttaatcttgctttctttgagcctgcattaaatcattttgtttttcttgttacagtgattagaaagaaaatggatatgaagtttttaatcatgacaagaataatagaatacctttaagctggaaaaagttgagacttgctactacttggtgattttctttatgtcttgctaattcaataggaaacactccttagtacaatcttgtcctgcataataatgttttggtcaaggatgagtagtgtatatgatgatggtctcataagatgataatactatattttacataccttttctatatttaaatatataaatacccactgtattaaaattacctacaatattcagtaccgtaacatgctgtataggtttgtaacctagaagcaatataccatgcagcctaggtgtgtagtagtctatgccatctatgtttgtgcaagaacactctatgatgtttgcatgataaggaaatcacctaacagtgcatttctcagaatatatccccctcattaagcaatgcatgactgtaattccaaacttcagttttcctgcattcacaactaagccaatattgactgccttgttttatcaagttattagtatccttcatgaatggtctgtatctcataattttccaactcagttatcaaggtttctctgatttattgaataaatcagtgattctttataaaatatacctttcaacatttttctttcttttcattgttgttttcctctgtctaaattagattctcatatttttcaaatatatatatatatgttacatttttaacatctctctgaccaactttcacgtatttgtggcagatttattttttcgaagtatggagctactcttgtcatcctttcattcaaaaattcaaaaactctttactaagaagaaagttacaaattggcaaaagattcgtattcagactttatagagaactataagaaaaagggagaccagccaataaaatattgggcaagtgactaagagagatattcaacaaaagagggcgtctaaataactaataaatgtaagaaaggatccacaacctcagtagtcatcagagaaattaaaattaaaaccactatccacacatgtatcagaatgacaacaatgaaagagaatgccattccaaagagtttgtgagaatgttgagcaatcagaatgttagtatactgctagagagacatttagttaacacacccacttgggaaaaactatttagcacattttacaaagatatatatatatatagcaatagtatatgacatgagtgatgggtgcacaaaaaaaacacgaatgaaaccgttatagcagtattatttctaatagttaaaaaacataaatgactctaatgtttttcctgaaaaaaattgttaaataacttattgcatattttactatgcaatactatgcaacaataaaaaaagtacttctacacactacagcatgtatgaatcccacaaacataatgacataacaaaataggcaacacgagtctatgttgagaagctaaggtagtagctatctctggggagataagcaagattagtgattaaaaaacagtcaaagggagcttgtaggggtgctgctactcttctatttctggaacttggtgatccgtatgtggaagtgtttaatgtgtacattcattaaactttatacttatattttgtgcattttgtcttagttatatttcaattatttttttaaagacttgtcattaactactgtattaagtcactgtcttcagcctctgcctgttggattttaacctgttttctggctgtttcctcttacatctttgcatgtgtcttacgttttcaacagatttgactagtaaatgaatttttcttcatattcattgttttcatccttttagtaatggaatcctctgaatgttagctggacacatgtctgactccttttggccaatcttctgactacattttctagcctgcctcagctctacatatggctgtgtgattaagtttgggccagttattcatagcagaagtaatgggtccgatttacttcctgtatgttactttcacttttacttcctgctgggaaatagcaatgtctgggaaaccttggcaaccacatgttctagatggcagagctaccatgctggctgtggatcactggactgttagatgaaagagaaattaatttctgtcttatttaagctataatattttgaggttcctttattacaatatagtctctgtcttaacacagtttgttataaatattgcaattcatatgtgtctctgtgcattgatttggctaatcactctttccagagatgacctgacctactgaaatgatctccaagaagtgccatattcactgatttatatcttgcagtgctttccatttcttagatatctgaccatggggaatgtattcatttatnnnnnnnnnnnnnnnnnnnngagttaatacttgtaaagtgtttagcagtctggagtacatattaagcactcaacaaatattattttcacctaatagttttaatgtaaataattgatatggaactgagcaatagcacaacaaagaaactcaatgtacattggaagaggatatgaattaaggacatttaagagacaatcatttcatgattcgagccttctagagatttgttattattttataaatattggaaatagtgtaatgttaatataaatataccttatgaccaagtaattctgctcctagtgatgtatcgaaaagaaatgagtacatgggtatatgaaaaatataacgaaaatatttatagcagcattacctttaatagaaacaactggaaacaaccccgttgtttcctacacataagagcaaaactaactcttaattttggcaaatttattttaactgtcccatgcttctctttcttcttaaaaattggtaataatagttcctgactattgattacttaagaatatgacttatctattacaatgtgatttggggaaaaattgctaaaagtctctaagttattaaaaataaattgcacttctatttttagtattccctttcaattatcttctagcaattttcttttgtctaagtacttcctttaagtcccttcattagggtggtaaatgtttttggtgtgtttgccagaagaaaaccctctttcttgcacgataatttatctgattatataaatctatatttttcagcatttgccctcagagtcgtgaagctattattgtattgccttctcacttggtgactattgagaggtttgctgtcggacaaactcttgttccataagggtgatctgtctcatctttctggctgttttttcttttaatataatcagtttgtggttatctgcagttttatacatagtaatgtatgcaagagtgaatttttgcaaacaaaattatcctgtgtaggattcactgtgtttcttaaatctgaggtctcatagctctattaattttcctccattgttttcccaaaagattagactattttgttttcaaaccaagagccaaataaacctaagacacatcacctggtcatgtctatttacaagtagttcattcattcactgcatgtggacatttttttaagagtcctatttttacatgaacatttctgtttcaagtcttgtggcccattgctcacatgaccctagaaatttacctgactttatcaactctgcattttaaactatgcttattagtcattctttctagttgttttataatggaagatttctttctttttaaaaataacattaaaataagttaatgtttcatttcctatccttggcagatttttatttttcaatatgaattgttttgaaaaaaaagttaatgatacatgcactaaaaagggatacaaagatttcgttattatattttaatttaatgtgaatttttcattttttcaaattgatcaagcatagtttacaaaaaattccttgagctggttgtcggtccactagaataactttcctctgttgccgcacaggacagcaaggctttcactcctccaaagagtatatccttttccccctctcattttaaatagacttcaggtttacagcaatactgagcaaaagtacagagtttccaggtatcccctgccctcacaagctcataagcacccctgctatcaacatcctgcaccaaagtggtacattggttacaatcaatgaaactacattggcatatcattaaaatccaaagtttacattagggttaatcttggttttgtacattccatgagtttggaaaaagatgtataatgacatgtatctacccatatagtgtcatacagaatagtttcactgccctaaatatatgttgtgctttgtctattaatcccccccttcccataagccctggcaaccactgatctttttactgtctccttagttttgccttcttccagaaggtcagatatttggaaccatatagtatttagacctttcagattggcttctatcactcgataatatgcatttaagattctttcatgtattttcatggcttgatagttcattttttagtgctaagaaatatttcattgtctgggtgcaccagtttattcactcacctactgaaggacatcttgtttgcttccaaattttggcaattataaataaagctgctataaacatctgtgtgtaggtgttcttgtagacttaagttttcaacctctttgggtaaatacaaaggtagatgtttggtggatcatatgacaagagtatgtttagttttatcagaaagtgccaaactttcttccaaagtgctataaagttttgcaatcctatgcacaattaacgttctttttgctccatatcctcaccagcttttggtggtgttagtgttttgaattttggcctttctaatagttatgtagtggtatctcattcttttaatttgcattttctgagtggcatgtgatgtcgagcatcttctttggtgaggtgtctgttcagatcttttgtacattttaaaatcagtttgtttgttttcctattgttgaattttatgagttatttgtatatttcagataacagtcctttatcagattttcttccagtctgtggcttgtcttcttccagtctgttgcttgtcttctccctctcttgactatgtctttcatgatcagaagttttgaattataatgaagtctagcttatcaattctttcattcatggatcatgactttggtgttgtatctaaaaagtagtcatatccatgcccaagtcatgtagattttctcttattttatcttctaggacaaaagttgtatatattttttgtatttaacatttagtctaggattcattttcagttttctttttgaacaatgtaagttctgtgtctagactccttttttccacacgtgcatatccagctgttccgcaatgtttgttaaaactatcttttctccattgtattgctgttgctcctttgtcaaagatcagttgactatatttatgtaggtctatttttgggctctctattctattctactgatactcgtttgttctgttgccaatacatactgtcttgattaccacagctttatagtaagccttgaaattgagtagtgttagtcctatgactttattcttctcctttaatattgtgttggctatacttggtgcctttaaatttccttccacattttttgagggcactattctcaacattttcttcatgtaataggcttagtcatatatttgaagggtaactaacacttacagataactaacatttgttgagtacttattaaattctgggcaaaattcaattaatcataaattaaacagatatattatataattatcatcatattttagatgagaaaaccaaggcccagggaaatgtaagaaaattccccaaggcaacttaggtagtaaatagaggaatacgatagtctgcctcaaagggacataatgtggtatcacctcccagtacctacagcattaactaactttcagcaaggaaattcttcaaataaaccaggttatagaggtataaattctacttcaattgaatatttgctgattacgtactatataccagggacaattctaggtattccattttcaaaataatgatcactaagcattttctcttaatgagttcattgtgtagagtgtcatatagtgaacagacaagttaaaataaaatagtagctttctccaaagggtgccacactggaatcaacctagatggtcatcaactggagaatagaaagacaaattatggcttcatcatgcaatgggattttattcatcaataaaaacatagggtatgatgataacaaagttttgatatctctctcacagatcttacttgctaaatcttcatgtttacttcctattaaaacactatcatagctattctgattaatttagtagtgaaagaataatctttctttctaggcttcaaatcctttcccttgtatttaggttaaaaattcttactttgtggccacgtgcaccctaacaaagttactagtcccagaattttcccaaaataaaagtccttttattttctgggattattattcacaagattgacccttatctctgaaggctttaaagatttttattcttttggcatttctttccaatatactcatgtattacagattgttggctatggacaccagaaatattttgacctatttttaatcattaaaatcactatgaatattagcatgtctcaacctaatttttattttctttgctctgcatcctatccccaaagctatgaaaaggaatttactgctctatcacacaatgattatgcctaataattaagggaaaatgcaggaagatgtaattgtacttctcaattgcagtcaaacactgaattagccacaataactaaaaaagatagctcaaatgattaaatcttcagaggaaccctatatttatattaaataattcatttctcaaggaaaaaatagtttgtatatatttttgcaagaagagctaactatcctaaatatatatgcacccaatacaggaacacccagatttataaagcaagtccttagagacttacaaagagacttagactcccacacaataatagttggagactttaatacccccctgtcaatattagacagatcaacaagacatacaattaacaaggatattcaggattggactcagctctagaccaagcagacctaatagacatctacagaactctccacctaaaatcaacagaatatattcttctaagcaccacgtctcacttattctaaaactgaccacataattggaagtaaaacactcatcagcaaatgcaaaagaatggaaataataacaaacagtctctcagaccacagtgcaatcaaattagaactcaggattaagaaactcactcaaaactgtacaagtacatggaaactgaacaacctgctactgaatgacaactgggtaaataacgaaattaaggcagaaataagtaagttctttgaaatcaaagagaacagaaacacaatgtcccagaatctctgggacacagctaaggcagtgtttacaggaaaatttatagcactaaatgcccacagcagaaagctgtaaagagctaaaattgacaccctaacatcacaattaaaagagctagagaaggaagagcaaacaaattcaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgctagccagacaaacaagaaaaatagagaagaatcaaacagacacaataaaaaataataaagcagatatcaccactgatcccacagaaatacaaactcccattggagaatactataaacacctctatgtaaataagctagaaaatctagaagaaatggataaattcctggatacatacaccctcccaaaactaaaccgggaagaagttgaatccctgagtagaccaataacaagttctgaaattgaggcagtaattaatagcctaccaaccaaaaagacccaggatcagatggattcacagccaaattcttccagaggtacaaagaggagctggtaccattccttctgaaactattccaaacaatagaaaaagaggaaatcttccctaactcattttatgaggccagcatcatcctgataccaaagcctggcagagacacaacaaaaaaagaaaatttcaggccaatatccattataaacattgatgccaaaatcctcaataaaatactggcaaaccaaatctagcagcacatcaaaaagctaatccatcactatcaagttgccttcacacctgggatgcaaggctggttcaacatacgcaaatcaataaacgtaatccatcacataaacagaaccaatgacaaaaaccacatgattatctcaatagatggagaaaaggcctttgataaaatttaacaccctttcatgctaaaaactctcaataaactaggtattgatggaacgtatctcaaaataataagctgtttatgacaaacctgtaaccaatatcatactgaatgggcaaaaagtggaagcattccctttgaaaactgacacaagacaaggatgccctctctcaccactcctattcaacatagtgttggaagttctggccaggcaatcaggcaagagaaataaataaagggtattcaaataggaagagagaaagtcaaatcgtctatgtttgcagatgacatgattgtatatttagaaaaccccatcgtctcagcccaaaatctccttaagcgcataagcaacttcagcaaagtctcaggatacaaaatcaatgtgcaaaaatcacaagcattcctatacaccaataacagacaaacagagagccaaatcatgagtgaactcccatcacaattgctacaaagagaataaaatacctaggaatccaacttacaagggatgtgaaggacctcttcaaggagaactacaaaccactgctcaaggaaataagagaggacacaaacaaatggaaaaacattccatgttcatggttaggaagaatcaatgtcatgaaagtggccatactgccgaaagtaatttatagattcaatgctatccccgtcaagctaccaatgactttcttcacagaattagaaaaaaaaaaactactttaaatttcataaggaacaatatagccaagacaatcataaacaaaaagaacaaagctggaggcatcacactacctgacttcagactatactacaaggctacagtaaccaaagcagcgtggtactgctaccaaaagagatatatagaccactggaacagaacagaggcctcagaaataacgccacgcatctacaaccatctgatctttgacaaagctgacaaaaacaagcaatggggaaaggattccctatttaataaatgatgttgggaaaactggctagccattgcagaaaactgaaactgaaccacttccttacaccttatacaaaaattaactcaagatggattaaagacttagatgtaagacttaaaaccatgaaaaccctagaagaaaacctaggcaataccattcaggacataggcataggcaaagacttcatgactaaaacaccaaaagctactatataaactgtttaataggcactagagcagtgaaataatgacaaagcagagaaacatgcagcctgaataaatggctagtcagtacctcaaatttgaaaattacttgcattttaagggaagcaacagcaagtgtaagggatgcaatggaaagtcccttggaagacaatatccaacaagtaaagctcacttagccagcatctgcacatatggccaagcagtgtttttctagtcttcttttcgcatggggattggccaactagtaacatggactttttgtgctagaaagaagatgaatattctatgtaaataactgtgagtattttatataaatatatatgtagtctcactgaagaaacaaaaacttggaattcagtgttgttttcttgggtaaatcattaattttggaaagagtagatgtaaattttatctgcttttgcaaatgaattgctggtataaaattaataatttttgtatatgtttgcttttcacagaaacaaattttttgaagtatttcaagttaaaaattgagttagtttttcttttatgctactgttacttagtactgttgtttcttttccccgagataatgttcatttaaaattcttatgtttttcttttcctttttaaaaatagtaactcaaatacatgagaagatgtcaaggaatgctgcatattaaaaattcttagagttataaacatactatttgtgaaaattagattatttacagatgatctctataaattcttgagtttaggactcttgaaaattgaatgctagaaatttatatttattttattatctcctcttttatattatgtcattcttttatttgttgtttataaattaggaagtttaaatcatactgcttttatttgtaaatgttttactaaaattgctatcaattacatgagctactttataatgatgattttgcccattagaatatctgattgataatacttaagactagaaaaggtaataactattttcattcattgagtcctagaaggtaaaattgctatattgaccttagtttgaattctctattacaatttccataaaaacctttcagtatatgtttgatatatcaaaattttgactttcaaatattatttttaattaattggaaaatgcatgcaaactatcctgtttcaatctgactagtataattgagcaatataacagtgttcttgtctgtcaatatcttgccaaattacctccaaagcagatacagtggcctgtggagaataggagttaggaagaagttcaggacagtgatctactccataatggttatttctgcatcatttcttcctgtctgttttcctcatactggtgaaagtccagaatttaaaaagaagttgaatttgaaactcagaaaaagcatattccaagtagatcctataaggagaagagtcatggagaactgcatgtcagccttttaacgtaaagggcactttgattttatcgtaataaaaaagtatctctaagcatagtgtctctcatttgacaacttcatacaattgcattaaatttttatatgcatgtatattatcttaccaattggcaattagtgagaaaacgtaaagttaaataaggggtaactcgtttttagcctaacttttctttccttcaatcatttcagtgtgttaatataatacaacaaaactttaaataaacccatcattttgttgagcacagacttgctatcactaactcgatttacaaatttggttagttttgctatcaaattagctttaatgtaaagttttttcagtagtagctatgtttttcatagcaccctgaggtgtcacattagatgagttagttttttgagttcttgctctttgaagctttttatgtcaatagttgaccacaggaactagtctataaaatcgtcactgaattcagtgaatctgtcatttactcatcttgaatgacataaaaatgttgatatcctggagctggattgtactaactcatgagagctaacaggtaactttttggaaattttgcaatccatttatgaaacacagcaattaccaaaggttgaatgatataaacttattaagtaattaatattaaaagggaatatgtgctcaaaactcgtcatgaataattatttttatatagtgtagtattgtctatactcttgaggtggttcatctggtttatagtatcattatggtgaaaataccatataatggaggattattgtgattctcttttcaacttcacgttcagtgatttcccactggtagcttgaaagaagcaatgatagaagtatttatacaacatagaaattagcaaatgacataagtcaggacagatttatgattttgtccattgtcttagtagagctgaaagaagtttcaggttttttttttttttttttttttgagatggagttttgctcttttgcccaggctggagtgaagtggtgcaatcttggctcactgcaacctccactccctaggttcaagcaattctcctgcttcagcctcctgagtagctgggattacaggtgcgtgccaccacacctggctaatttttgtatctttagcagaaacagcctttccatgttggccaggctggtctcgaactgctgacctcaagtgatccacccgcctcggcctcccaaagtgctaggattacaggcttgagccaactctccaggccagaagtttcagtttaatgaataaaatttgtataagagtgagaaataatttaacagtaaatcacataccaaatcaattacaaaaaaatattgagaaaagtattcaaaagttgtatggagttttatttgccatatcatagttcaatcaaaaccataggttggctagatatacaagggttcagcaaaaatcaatgaaagtattctgtgagaattggtcacttatatgaagtttatagtaagagttattacatattttattatttataaattatatgttacacatcttttatatcagtactgtttataaccttatgtattatgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttttttgagatggagtctcactctgtcgcccaggctggagtgcagtggtgtgatcttggctcactgcaagctctggcctcccaggttcatgccattctcctgcctcagcctcccaagtagcgggcactacaggcgcccaccgccacacctggctaattttttgtatttttagtagagacagggtttcactgtattagcgaggatgatctcgatcttctgacctcgtgatccacccgtctcagcctccaaagagcagggattacaggcacgagccaccgcaccccgctgtgaatagcttttttaattactaattttgtctttatacttgtgataggcctataaattttttgtcagccattatcaataatttaagtctttctaggaattgttaattttatattattaattctaatttgttgacatacacttgtttatgggtttttgtgattcttttatttttgtaaggtcaataatgatccttcttttattcctaattttagtaatttgagtcttccctcctctttttacatttttatataagtagagcttaaactttgtcatttaaaaagttgttttcacatattgccttttagttttgctgattttgtccattgttttctactctccatttcatttgtttcacatcaagtttttacatattctctcccttctgctcgattttagtttactctttttctggttactaaggtgaaaagataagtctgatttgaaatttttcttattttttaatacaggcatttagcactggtttgggcatgttgtgtctttgttttcattcatctcaaagtatttctagttttcctttggattcgtctgaccaattagttttcagaagtatgttaatttctttatatttgtagttttcccaaatatccttgtgtcattaatttctaatttaattccattttggtcataaaacatgtaaaatatattttcaatcccttaaatttattgaggcttgttttatgatagcatgaggtctctcatgaaaaatgtgttactgttttgtagagtgttctatgtatgtctattagtttttttttaaattttaagtattgttcaagtcttgtatttctttatatatcttctgcctaattgttctactttggaaggtgagcttttacgtttccagctattattgttgaattgtctatttctccctttaattctgtttttgcttcatcaatgtgtgtgtgtgtatgtgtgtgtgtgtgtgtgtgtgtgtgtgtgtgtgtgtcacttggagtctcttattgggtccatatatgttgatcgttgttttgtctgtctggtgagttgaactttttattactatgaaatgagtctcttttttaattatatttttaaattatattttagtggttgctcttgagcatacaatatacattcaaaattatcagaatctacttcagatatatagtatgttggttacaaccaagtaaagaaattgtaattttatatagctatatttttcccacttttttgttctgtgactgatatatattttgttctatggctgataagtcataaaactgacacacacatgtaaaacatctatatatgttaaaatacaacaatatattgttataactattgctgtttataatcttatgtgttttaaagaagctgagggaagaaagtagaaaagtatatatatattttgaggcgaagtctcactctgtggctcgggctggagtgcagtggcgtgatctcagctcattgcaacctacacctcccaggttcaagcgattctcctgcctcagcctcctgagtagctgggactacaggtgcatgccaccacgcccagctaacttttgtattttttagtagagaaggggtttcaccatattggccaggcgggtcttgaactcctgacctcatgatctgccttccttagcctcccaaagagctcgaattacaggcctgagccactgagcccggccaactttcttatttgacctttttggttctctttctttctatgtgtggatctgcatcaccataaggtatcatttccttactccaaactccaatacacctttgtttctgccccttttctctgttattgtcaagtgtgttacatttctctatgttattattccaataaatcaattacctattgttttatccagttgccttttaagtcattcaagaacaaatatgcaattatactgtctttaacattaatatattacattacattatattaatttgtattatattatattatttttacctttactggtgttctggatattttcatgtgaatttgaattactgtctgatgtcatttacctttagcccaaataacttcctttagcattattatcatatgttatgtctactagcattgaattctctcagttttgttcatctgggatagtgtatttcactttttttttttttttttttgagacggagttttgctcttgttgcccaagctggagtgcaatggtgtgatcttggctcactgcaacctccacctcccaggttcaagctattctcctgcctcagcctcccaagtagctgggattacaggcacgcaccaccacacccagctaattttgtatttttagtagagatggagtttctctatgttggtcaggctggtctcgaactcctgacctcaggtgatccacccccctctgcctcctcccaaattgctgagattacaggtgtgagtcactgcatctggccttcaccttaatttttgaaagataggtttctctggctataagattccttgttgacagttttttacatttagcaatttgaatatttcatcccattgcattctgacctcctttgtttcttttgcgaagttaattgtaattggggttaacttatatgtgatgtgtcttttatctcctggtgctttcaagacttttgtctttgcctttggttttaatttctactgtactgtgtctatttacttttttttttttttttgcgtttttgaaactttgggtttgttgagctctaagctcattaaatatatttcttccagtttctgaatgacttaattataccttactgtctaactcatgatatttggctgatttatatggtagacctaacctctgaaggcatttttgatttttacttatagagtacaggtgtattgtgcttaaatcatagttgagagtaaacaggtccacataacaagaagataatagacaattttcctccacaaatatgtgattttaatattatcctgacaaacactgaacttccaatttcttgagacaatgttgactgttaagaaatgcttgtgaaacttttcaaatgtatgctcctatggcacaatttgtatctcctgtgctctaactcatacccattggtagttggttgaataatggccaccctaagataccaagtcctaattcttgaaacttgtaaacattatcttgtttggtataaggacctttgtagatattattaagcatcttgagaagattactttggattatctgattaggctctaaatctcatcataagggtcctcaccagagagaaaaacgcagaggagagatgcacagaagagacaatggtaatataatgcagcctcaagctgtgaaatgctgtaaagcaccagaagctggaagaggcaaagaatgggttctctcctagagcttccagaaagagtatagctctgtggacattttgattttggacttctggcctccaggattatgagaaaataaagtactctttttgaaaaccactcattttgtagtaagttgttagagaatccataagaaattaatatactaccctagcaaccatttctttaatacctattttctgcattaaactgtaagcttcacaaatgcctcaattatctgtcttacacatcttgctaactccagctactagcagagggtttagtagtatctgggccttgttgaatacttattgataaaatgagtaaataggctgtgatccccacatcactcacagttgagtatttagctagataaatgagtgaacatgtgaatgaattaaaggacaaatatatatttattcccataaacaataaatacagactaagtgtaaaagattatcatattttttgtttttccagcaaaggaaccctctcagttcctttgctggagactgtacaaatttcatggctgggaacaaagaagacaaagttttatgggtggttttactagtgggtacagttagaatttgagttttcagcctaggaaaggtggttattctctcaggtataggggataggtcaggaggaggcatatgaaattgtgtttttagctctttgacctaacatgtgatttcctatatatagttgtctgaatatgttgcttcagccaccactactcacaaggcttaccatgtcagaaaaataaatgaataaataacaaaaaactaacagaaagcaccaggtgacttacttttgtttttgcagtgagctcagtctgctggggttactgttcaaataaactcttgccatctcactgcataatgattttgctcagattaatcactctcttgtgctgtatgctggggttaatggctatgttatgttacttcaaattatatcacagggtccaaataagaagtgtgtgtgtgtgtgtgtgtgtgtgtgtgtgtcggtgtatgtgtgtgtgtgtatgtgtatgtgtgtgtttgcaagcaggaagccctttcatgttgcagtcatgtaagattaactttattatctcattccaaacttatttcttactcctctctattatccatgaaaactctttgttctttgctgtacttcccagcaaaatggcttttgcctggctccaactccaacctgtgttaaattatatttcttcctggaatctacttcaacagaaggtgatattttctcttaattcttatagtactttgcatatttttatcatggtcctgaaaatgacaagagccaccatttactgagggttcattatgtggtaaacattggattacatcctttaaatatgtcatttcatttaattcttacaacagttttgtgtagtgggctctttattttataggagagaaaaactgaaatttagagaagtttaagtgatttgcacaaaatatgctgcttccaagtagaagatctaaatttcacatagataatttctagagctcatgtttttaacctttaccacatattgttctttagaccaatactgatagaataataaatgtgttttctttcctaggttatgcaataacctaggataactctgtatcatttttttcatttctcgaattacagtttccagggcccagcaactcaatattgtttggatgaattaataaatatctagaatttaattattacaataaaaaattactgggcctcaaaatatattttaaaataatttaagaaaatcgtactgatggcaacaaataagtcattataaaaacttaaaagatggaattgatgggtaagcatgatttattcaatattaactatgccaaatgtcttctctcatgtttttccaagttctgtatgtaagtaatgcataaaatattgaaatattcattcatgaatttttgacgtttcctatatagatgattttgttgaggttataaaaacattttgttttaaacaatttgtgtattaaatgcaaattagtttattaatcttatgggtttttgttgttgttgttttgtttccaggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcagtaagttaaaaaagaaaaaaaaaagagcatgcatttcgagacttgatattatgtatccttgtttaaatgggttcgataattataaatattctatcttcaacataaattaggccatatgatggtcatgcccaacatttaaactataattattttggttgtatgttcactagtctattcatataatttaaaactgtctctagaattttcatattgttgcctttaaaaatgtataatatgtggtagtcccaatcaaatgcccacaaatggggacatatattatatattatattatgaatattatatattcaatgagtcatagcatatgaattatggactggaacataagaacttttatactaccactactgtcaacaattattttccatcaaatcatattaatatgttgaggtattttctagttcatagtaataataaagtcatgaggaatattttatgtacttttcttatgtctccttatattcaatgtatttatcctgaagggtatgtatttcttaattttccaggatagaatattaaaagatatgtgttattgtaatagatctaatgcccttgaaagtttaaaaatggaagtatatgatgtttttgtcataaattttgtaaaaagcagatttaattaactgctagatatcgaaatatatagtgtcaaaatggagtaatatattaatctaaagtttctaattatacctacagtttgatctagacactttaatctagctttttatttaattaaaacctttataaaatcatattactatagatatttcatcctgtctaggaaaattgaacagtaaattattcttctcctatatgagcaaaatgtgcatccgaattactttgtcagcaatgagaataatatcctttttgagaattcttattgaattttgcttttggctacctttatattaactgttttcagctatattgatatacaatatcagtctggatccatttttttttcagatacagaaaaatgtgtgaaatgctcaaagtttcaaatacaggtacctatgtttgaaaattagctactgagcataagaaatagcttctttttcataactattttttgctatatttccagggtcatattgaatctttgtagttgcataataacccctaatacatgttgtatttatccctcctcctctatggttttgtttcttgggctgtttccaaattgcatggtttgtgggcaggcactattggtaagtttccttacataaatctgccacataaactttcttttgacttacacattccaggagacattcttttcatgactaatgataatggcctagctcttgggatatttttatatagactaacattactgaacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattgatctactaatatcactaactgtgtaatcttataataatacattttcatgaaatagctacctgaactcgacaggactttgtaaaaggactttgctagggatgcataatttcaattgtattaaatgaataaaaacaaaaaccaaaataacaagcaaaaatcaagtggtttcgttgtcaatagtagtgtggcagccaaatctgtttaggtgccaaaagcaatttaaaataatttaatctttgaaatgcatttattatagacctttaatcaaaatgcaaaatgagtcaatgatttaaatccaaatctcttgccctgtgttttcttaaatgaaatgtagagaatctgatccattgccattatgcatgctaaacacttgtaataaattgataaacatgtttccagtgtacacaattttgaattaacattaggaagacattttctgcattttggggtagagatataacctttgaaagtatgtccagaatctgaaaccttatctaatccctcttgagaatgtcctatttgaatattctctcttttcccaagttttttctttgcacatctaaagtgttgtcaccttttcctgataccatgaaggttctttttggcctaaactttttccctctgatctctctcagttgaattctaattgggaaacatttcctttttatgcagtaataattcattataggaaagaaacaaaatatagaactgcttgcaatgccagtgaaactgtgcatgtgactctacaatgaatttaagtctaatgttaaaatttgatgtaagtgttcaattaatgaggcataaaactaaaatgtgatttgaaatagaacggtttagtgctattaaggccatagactgttgggccagactttaattcttaatactaatgctgaatttggctagtcataggtaggattagctagataactattgcaattataatggttcccattaagcttaagatttcttctaattcttaaacattagcttatagagcatgcatgatgattatgtttattgaccttctttttctcctttttcctacatggccaagaaaccatacttatataactaatcattaaagtgtatcatactgtcttaacaatattatcaatagatctagtggtcattttatttactttgcctttttgcaaatctttctatgttttcactctgcaggaaatggtggtcctttaatgttggattaacttttgaatgcatttgttttttctatctgcagtatatcattccttgaaatatctaggcatttataaagcttaaactttattgtaatctgatttgactttagataaaattggagggtatatatattatttcttatgagctcttgaaaatcccacacaaaatgacacattttaggaatatgtaaaggcaatcataatttttttttcaatcattattgaattatagtgactcttaggtctctttattgcatttgtatctgtgtatatattaactgttactggtacattgaatgtgtttcagtatatttgtctgtagtctactcttggttatctacatgaacaaaacggagaagaggtgtagacatctcaatatcactcatgtttgaacttaaaatatatccttttactaaaaaatataatctgaatgcagatgtggttagcaatttggaaagtcacttcaaaattaatgatgtggcattataaaaataacttgggaccctgttttgtcttccagtgtttaacttttctcaaattctgccaaaacttcactttctgtgaatacatcactgttttctggttttcttttatcaattgtattatatcacagggtaagcgagttcagacacatttcttaaattagggactaatcaaagggttaagtttcaaagctctttcttgctacatgtaaaataagactaactggtagaaatccaggaactaagagggaaagtcagtgttatcaatagagaaaacagtctgcatatatctatgtataaacacatacacacatacaactcatagtgtgatattgtaaacttatatgtattactcatatatataactgccaataattacattcaagtcaggagtggagaacatatgctatagctaaaaggaaataggctggaagccagactaacgcagtttcaaatttcaaatctaacactcatttcgtatctgtgccacttttggcaaattatttactctttttctttatatggtggataatgatatacattgtgtgctaaaatgaatgagttactatgtgcaaagtgctcggcatatagtaaacttgtgattggtgttacttctctccttctttgtccaatcactactcatgtttcacgtagaaggacaggcagcaaaattagcatagctctatcatttaccctagttacaattatggatctaatttcctaggcccgctctaatgcctctgtgttggtagacaggaatagtaataacttctcatgcaggcattttttttttttggtgcatcctgtagatgtcactatccctggaagtccacggtttgggtttataagaaagcatgaggaaaggccagagttcttgtgtttaggagctctcctgccaaatgaaactcgtgagagtttcagttatttcatttgcttttcccaaagattaaatctgttaaactaatttcaaattaattttctggaaaaaaataaaattgtctctttttttaaaaaaatgcttttaatatgaatggaatattcctttccagagatatgctgtagaatagtaacatattcatgtagaatctctacagccttactccgaacattaacaaagaaaatatttatactatcatatctaggacacttaaccttaaaaccctagttagcattattttttgcctagttctttttataaatatctattggttcactgtctctattgctaaatagaatattctaacttgcaccagtttctgctagtttgtcatgtaaaaattcccagaatttttgtcaacttataatgggactaattaaccaaatttgcagccatatggtgtggaaaagtagcactaaagtcaaactcaagaattctgaacaattcatgtagcctctttgtgcataggccacaattcactcacatatatgatataattctgtagtctaagacagagtttgtagagtttgcagatcttaacagtattgaaataggggtttatctacatacctttttgattcatgccaggaagtctttggtctcaagcacattttccttctgtgtcatagtgcctcaagttttacaattagaactcaatctatttgggttaaaccattgacccctgtatttttatataaaattcaaatatcattaggcaagagaaggtggagaatcaattaagctgccagcagtcattgataccttatatgatcatttaacatacttgtttctgtctctcatctctagctaaatttaactcaagtcaggagtgagatagaaagaaaatgtgagttattggcatagagcaatctattgacctcccagttagcataggacctgtctgattttttttttttgagacagttttgctcttattgcccacactggagtgaaatggcatgatctcagctcactgcaacctccacctcccgagttcaagtgattctcctgcctcagcctcccaaattgctggaattacaggcattcaccactatggctggttaatttttttgtattttaagtagagatggggtttcaccatgttggtcaggctggtctcaaactcctgacgtcaggtgatccgcctgccttggcctcccaaagtgctgggattacaagcatgagccatcgcatcaagccttgattcttatatgagtcctaatgtggcatcacacctaatagcgtttggtatgtgtttgacagttagaagttaagaagcatgtcatcaagatgaggaagaagtctcagcaaactccacagaaaaatctttattttcaaaaaaaggggaactatgtctattcaaaatatttaaaaatgttggagtatattttgaaataaatgaatatcattaaatgaaaaactgagaattacatacatttcttagaaaaaaatactctctaggcacaattcactcatagaatataaaaatactgtgtgtttgagtctctttcacttctttttactattatgaatttttccctttcttgccacggatcttagtgcaagtatagattgtctttgaagcagaggggctaagaaaatctctatcaggcttagaacttaatttcatttctgtagccaaatgctttaatgtagaaagaaaattaaggcaaaataacacaacagacaaatataggttcctgcctttttaatacagatgcattgttttttccccattttattattacaaactagagtaccttaaataagctgctgttctggatgtctaacagagatagaaaaactttaaatgaactattccaagttcaaatttttggtaaactttgtccagtattgaactcattaataatttacactgttacacaataaatttgtgatctagaattgtattttatagctagtttaccttagagagtttatcagtataaaatagcactcaaatgtagatattttacagataattttgttaggttattttgctttatgtctctctatataaatataaaatatctagatatatctatagctatctatagataaatagatctatgtctttctatatctatatagacatatatgtatccatctatctctctatatatacatatatatctattagatatatagatacatatctatatatacatatggtaggtatatctctctgtatctatatagatataaatatagaaagatgtagatctatctctctatatatattctcatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctctgaatattattcagattattgtcagatgtgtacaacatctcagaaggaaacagttaaaaataattcagcatgataattaaatttattaactagcaatcctaaaacaaaagtaatagcttactgccattcattaaaattgaattatatatctcatataggtgtagttgctcaccgcagtggccagagtaatactgcaaatctgttaagattcagaagctgtcttcttggtagtggagacaaaaaaaaaaaaaagacgtaagagcttatccaaacaagtttatcatcagctagtgtcacacaccacatcatcaataatttttatattaaattataatatcccagtgaatattctttgaaatataatttaccttttggagaaacttcattagttgtttatgacagcctagtaaattactactttagtgctccctagtggtgaaaaggagccaatgcggctttaaaaagtagctggttaatgcctcctagtgggtgattctcactcagatcgagaggtttgttttccttgctactctgatagtgtaaaaaaaaataaaatgaccaaatttcttaaagtgcctgcatgtatgcacctgtataaataactatataggtaatgaatttgcaatgagtataatagcaaggagatgtaagacatgggagactggcatgagattgtggagacagaatggtccagctttgatgccaactagacttgagtttaaatcttgatagtgtaagttctacatgtgtgatgttggcatgttattattttgtagggttgtttttagggccataaataatataggtaaagttttaacataataattgcttcaaacactatagatattataataatgtgactagaaagatggtttttttcttttaatatggagttgtttttggggtaacagatgttctaaattgcttttttccccctcttaatcaggtaatgaaaagcttacttctttttttgtgtctactattctccttagtgacctatggataacacccacccatgtcttcatttatgattttctcataaatttgagaatattattaactagctttatgagcagcagacttagttgtcttatgataagtaaagaaccagcttttacctatttttatccatctatctcttctgctccccatttccccctccaccctcattttcctgggaatgtcctctcagagtgaacactttcctcagctgaatttagttctttggttacgggtgaattctgaaagaaactgagtcagtaacctagttgctcttctgagaatttggaatttggaacaggaaatttctatctttctgtgctttttcttatcaatagataatacatagacgtgatatatttggtcagatatattcattagtgtctaattatttacatagtctaaagtgttatctctcaattgggctatataggccttaggggcagacaggtggcattgtcccaagtactccaggccttttgatatcccataatatgttaactttcagcaccaccaaaccccagatactgtaataaccaaaatgccttcttgttctctatttgcaaaagtcacctagtgagaacagtaaacactcccagttgagagacattttataaaggaaaccacatagccagttctctccttggtacctttgaaaaatgtgtttcttatttgccagttgtttagcaattcaataattcagacaactgattctgcaaccatagtgcactgtcatcatctcacagactctgcactttgcctcttgcataaatacatgaacgatatgcaaattactggagtccctaacagaatgaagtgaaatcttcgccgtctttctctgtctccctaagatggctaattattgcctgctttgagtggctacagcaactgtattcttggatatgtgttcaaaaagaaatgcttgctccccacagaccagcagtgtgtaagaaaggtaaactttaacaaggggagttgcaacagaagtctaggaggttttgaacatgccaatgaactctagaccagaaaagtggcattctttgtggttctcccctagggcccaagggaaatataaatgtatcatattacacatactcttcaggaaaaatcaagacaggaagaggttttccacactcccatgtaagtacttgtgtcttttaatgtaattcttcatgtcacaagtaattctataaacaatgactttgctgagttatcttatttaatgcaatatttaggaattctctttattttatgaatagtgaacatgtatgaaaaagatctttttcattgcccatctacttattttttcatctaatataagaattctctgttatgacaatcttttccttagcagccaaatattcaatcataagaaataacagctgaatgtggtggcacatgcctgtgatctcagtgctttgaaaattaattataatttaacataaaccactttctattttctgcttgattaacttcagtctactaatgtatactgatatagtaccaaattcatctgatggtgccctagaatgctgctacctgtatatgttttcctcctctagtttctttatatcatatggtgaaatgctttgccttcttttaagctgtttttgcctctggtctagcacttgtaccatttccctatctttggagaatactgacttcctacctctgtagcacattcacttttcatttcttttactctgtgttgaatgcatttgcctcaaatctccaaattgtttttatccgtctgaaaaactgacttgaactatctaaaaatactcctgcctgctttataccttcttcagatttgcctacttttattgtaaatttgaccacatactcatcaaattctcagcaccacaaaataactttggatggacagagtgcattcctctgctttagaacagtgtttttttattagatgtcataatccatttatgactcatcaagttaatttagtgggctgtgatcacttttaaaaatgaaatagagaagagaatagaaatgatcagtttgattttatgagtgtgtatatgtgctagcttatgatgtaaaatgtatgtatacctgtgctgtcgatatagaatgttggaaagccttgctttaaataggcactatgatttcaagctgcctgcagactctccaataattgcttccacctaccctatcacttctgcttttggtatatccttagattttcctgacataacaattttttccaaagttaaaattaccttcagactcaagccaatattttcattcatattagataaatatagtctttaaggctgctagatttaacacacacaggataaccagttatatttgaatttcagataaacaatagtttgtaatacgtttggctccaatattgtatgtttatctagaattcaaactgaactaggtgtcttatattttatctagcaaacttaatcctatttaaaaatcaggccgggcgcggtggcttaagcctgtaatcccagcactttgggaggccgaggcgggtggatcacgaggtcaggagatccagaccatcctggctaacactgtgaaaccccgtctctactaaaagtacaaaaaaattagccaggcgtggtggcgggcgcctgtagtcctagctactggggaggctgaggcaggagaatggcgtgaacccaggaagtggagctggcagtgagccgagatcgcgccactgcactccagcgtgggcgacagagcgagactccttttcaaaaaaataaaaataaaaaaaataacccagatactcctgactgggctagatcacccatctcaactaggtaaaaaagggaagggtagatgaacgggtgggaagactgagggagaacatgatcagagaagaagggagaaaaagaaaatgtgggcagtgcttttctacaaatggtgcattggagtaatgctaatattgcctgagtcatggcaaaacaagcagtactgcaggattgataggaactcaaagaaaacataagaatcctccaccagggagtatggggatttgggggtgattgtgcaaatctggcagtttcctggttttgctattggaaacatcatttaggcacaggaattcttctggtctttaacaggcattcaaaggtcagatagatactctatctatagatagataagtagttaggattccgaagcaaaaatttttgagagatacagtgattacaaatttgtttaggcaggccagtatgtctgtcttttgtctaactgattgttgctagacaagaactttttatctgagagttttctttttgagtcctgattaaagcctttttcagagttgctttgaaactaatcaaataactaccaatagataattccaataatttgatatatccaggcacattaatgctgtagaaccatattgagtagtattcaggggtaattatggtgcctatgcattcaatagatatttgctgaataaataaatatgtagttgaaaatgtctttatctttgcaagactgtttccttacacatctctgcaaattaattatttcctctgcagtagtacaatgatgtacactgctaatcctttttcatggacaaatgggttaaaatatattttaatagaaaagaaaattattgtctgagcatttcaattttataacacatctagaaaactatcaaagtcatagctaatgtaagttatcacattatattccacttgggctcaaatgtgacagtgattgcataccttgtaaagtcctaaatgcaaagatattcaatatataaaacagaaaaagacagatgttccttgaattgaagatatgcatagagcctagatttattttcctcagatagaggccgctctggagtttggtgttctatatgtttatgaatcaggacacacaggcttttaataacatttggatttataggctctgttcaatttaatttcaattttatgttttacaaataaattttctatatcttaatttagttacatatattgcagagggtttgtgatacaaattttctcaaatctagtaagataaaaaaatttcactaggagattatttctaatttattctttatccatgatctgcaggatattgataagagaaaatgtcagaagtttggccttaagggcaaattcttttaggtacatacagtttgatatttgccaaaaactatggtgtccatataattattctagttaaataaagccattattgctattctctaaattcattttaaaaacaaaaggtggagaaaggtgattttaaaaatttgtgtgattatattaattattgtttgctctaaagttcagtatctgaaaaggagcacaatataccaaagcaccaagttacattttcaaactactgatatttaggaacactcatcatttttttattacactagtgaatttaggttaaaattgtataattttggttgataaatcttttgattagcttatttttgtttgcttgctttataaagtgattgttactactcatgatttgccaacgttatgtgatggctttatttcagctcgcacattagcttcaaatcttagaccaagaatggcttctctgctggcgaatttcttacaattagatgtcttgttcctttaggaagaggcagttatttacattcctctcctaaattctattaaaaatggaagtccaacgcatttactgactggctgctaaaatattacagcattgtcacaaagccatcattttagtcctcagttttgctggaatggaacagatggcctgttaattttttccaggcggagctctgtgttgttactccatagtctgacttgttcttgagaaactttgtaacctgagacaaggtacagagtgcttgactgacccttgtattcagaaaggtcaccccaaactagttagagcattttacacttataaagaacttcacaccagggagcattataaacattttagaataattaacctatgctgtgaggttaatatcccagctctttatggatgaaacagtctctatcttttttcaatactgataactaggagtggctgtaaaacagtggttaaagtgataggctttgaaaccacaatagcaggtgagtcctgtctcttgtacataattggcaaaatacacaacctctctgaagcttagctccctcatctgttacacagagatcatgatagtgatcatggtaatctattcgtgggactgttgtgaggattaaatgatgaaactcatgtaaagttctgattcagcataatccatttactaagtactcaattaatggaaaacaatcagacatagattgcttggtgacattttcgtccatgtaatgcagccaaaactagtaattgtcatgtaattaacgagaatcttaattttgaggattgcaaattctctaccatttcaggaaccagaggtttgcaggtttatatataatacaaactgaatagttagaaaccctttttattgaataacttagaaatgaaacattgttgcaattagagaggaaggatacttgggactgagaaaagaagacatggtcaaattctccatgttttaaaattattttccgttatttttttctcttaatttgcactattttatggcttgagttaaggagataaacttacgttacatacttatgatacacagtctgaaaaaatagagcaaaacaacaatttgttattaaatttttttgattaattaacttcttcaatttttctaactttatgttacttcagatccaagttggaaaggtcatttatttctgaagactctgatactaaaaaagaaaatgtgaaaaaactttagtattatatattattgaatttacaagatgagttttgcaaattagattgcttgtgattgcttttaaaatttcagatttttggataacttataagtttaccttaactgcattgtgttaaaggcgaaggctagtaatactcaggaatggccagtatttggctttatagttgtagggcttcttaaagtaccatttttttcttccgaaaagcagaacattggcaagtagacaagtatatttgtccgtgggattttcagtaaggtattcccaagagtttgcttgtttttttttataacccacagatggaagataggaaaccatgccctttatagaacttgatcattgagctttctgcaggtggataagtttgtcactggatcactaatgttgtgctgttattgctccagaggctgattttattgttcagtccatcaaaagaggctgtggttaaattacttttatatggaagtattactatactttttggatggtagaggtcatttctacttctaatttatggaaataatttaatctattattttctgttttactgatgaattccagtcctaaaggacttagactgtaatatttacactgaaaacactatccatgtttcccaatactcaaatgaattaaggcctttacaagtggtaagttatgaaaaatgtaccttgtgccaaattcccccactccacaaccgtagataagtctgaaatggcctcattgtctggggtgacactgaaattctttgtctcactgccaaggaaatcaagaacgtggacacaccaagggtgagattagagcagaaatttaataagcaaagtaaagagaacagctctctgctgcagagagaagtccccgaaaaagggttaccgttcttcagggaaatgcaagggtttttataagcaagttactggggagggagtatttcatctacatagggcgtaaaaaacctattaggactaggtgtgtcatttgcatagggtgtgacactctggcagtccccaccccaaccttttattgcccaggcaggtctttagcctaagttattccatgttgcttatcttttccccactgtgcatgtgctaagggggaggggggtgggcaaaaatttaaaaattagttgtgcatggtagatcgtgtctgtagtccagctagtcaaggaggctgaggcaggaggcttgcttgagcccatgactttgaggttgcagggagctattattatgctactccactccagcttgggtgacgtgcctggccatggtggatgtgactggcccaaggtagttctttcgattggtgcagctgcatgcaccaccttcatgcaagcttccagcttccttactggtgtatgtccaaaaaaggaaaggaatgtgctcactagggcccacagtgcttactgggacccactgtatgcatgtgaaacttgctaattacacaggaggctccatctttgtgctcgaacttgcttccttatctatgtctgcagcctgatcttccaggctgctctttgttagagcagaaattctgccgaggactctttgccctattttcctagctagtttcttccttccttctctctcaattcaaggttaaaaaataataacaataacaaatctttcccatgactcaagttgaagatagtttaacaaacactgaatttttctgtgatgacattttgatactttgggtttcttgaaattttttttttttgtctgctttccctgggcccttagcatttgtcttgtctgttggataagccacccatggtccattaaatttacagaaatagaccagtatttgggaaatccttgtttgacttccagcattttactttgccctctgctgtgtaacaacgacaattcatttcatctctttacagcagtcaaccaatttatcaaaaagttactggaaaatctgttttaaccatttgctaaaataatggtagtaaaaccacagtgaaaagtataacattatataaacataagaaaacaaatctagattcctagaaaacaacatttgtaagaaataaatttcccataattatttacttgataaataatgttaggtcattagttttaaggttcaatgtggccgtgttccagttcatccttaacatgtttgtttctgttgtgagcaatatatttaatatgtggtttgtcacatggaagttgtgatttttttagtgcttagttaagagagatcaagactaacatccattctattttgtgtcttatcactatcaagggacagtgtttctgtgttcataaacaaattctaaggaaatactctatctttctgaaatataaaaatatttttaagaatacattttcaagtgaaacatgttctcaccaatattctagaaaatgttctgtactgtatattcaaaatccaatttccatctagaagcagaatattcacattggaaaactgggtccaagacatttatgacatttatgaatgattatagtattttacatagttaattgtaatattagtagaatagtatttttagtatctgaatcaaaatctttttaaatttctgttccttctaggttttatttgcaactgctattacatattgcgagaaagatattaggactttgataaatgggctaccttgagggacatgtccctgagttttatcaccatttatgaacatctatttaaaattgatttaacatttcaaacattaattcccagcaaatgagaacaggcctttcattagggtaagagtcatagaggtacttaacataggcctcaagttggaagaggattggcacataggctttcaatgctgtctctgaattaggttaaataaagatgcccacagaatcaaatggcagtatttcatcataaaagtttaattatgaaatgtaattattcaaatataccataatttaagaattttccaaagacaggacactgttttaattttttttttttaagaggcactgtctcaccctgctacccaggctggagtgcagtagcataataatagctccctgcaacatcaaagtcatgggctcaagtgagcctcctgcttcagcctccttgaccagctgagactacaggcacacactaccatgcacaactaatttttaaaattttatatagagataggatctatgttggctgggttgtcacgaactcctagtctcaagtgatcctctagcctcagcctgtcaaattgttgggattacaggtgtgagccaccatgctaagaacttcagtaatgaagcttgtctaggatattttccttttttgctagctttattgaggcatacttggtaaatgaaaattgtagccaggtgcagttgctcatgcctgtaatcccagagctctgggacaccaagatgggaggattgctggaggctaggagttcaagaccagactgggcaacatgatgagaccccatcttcaccaaacaaaacaaaacaaaacaaaaaaagttgggcttagtggtccgcacctgtagtcctagctaattgggaggctgaggcaggaggatcgatcacttgagcccaggactttgagtctacagtgagctgtgattgcagcctgggcaatagaaagagaccctgtgaccctgtcttgagaaacagattttatatatgttaggtgtacaacgtgttttcatacacatatacattgtgaaattattaccgcaatcaagctaattagcatgtccatcacctcatatagtaaccatttgtgggtacatgtggtaacacttgagatttactctattaatgaattttaagcatacattacagaattatctacggttactatgctatacatttgatctctagaacttactcatactacatgatggaaactttgtaccctttgaccaatatctcctcattttcctcaccctccagccactggaaccaccattgtattctactctcagcttctatgagtttgactttttcaatttccacttacaggtgagattatgcttgtctttctgtgtcaggcttatttcacttaccataataatctccaggttcatacatgttgttgcaaatgacaggatttccttcttttttggggatgaataatatttcattatgtatgtgtagtgacatgaaatatatatgtatatatacacatataaaattaaatattgatatatattttatatcatgttttctttatccattcatcagtagacacttatattgtccccatatcttttttttttggggggggacagtctcactctgtcacccaggctagagtgcagtggcacaatcttggctcacttcaaactctgcctcccgggttcaagtgattctcctgtctcatcttcccaagtagcagggattacaggtacctgccatcacacctggccaattttcataattttagtagagataaggtttcatcatgttggccaggctggtctcgaactcctgacctctggtgattcacctgcctcagcctcccaaagtgctgggattgcaggtgtgggccaccgtacctggcctagttgtccccatatcctggctattgtgaataaggttgcaatgaacataggagtgcagatatctctttgagataatgatttccatttcctttggatatattcccagaaatggaattgctggatcacttggcagttctattttcaatttctaggggaaccaccatattgttttctataatggctgggttgatttacattttcaccagtagtgtacaaggcttcccttttcttcacatcattgccaatactttttgtctttgacttttttataatagcgatcctaacaggtgtgaggtgatatctcattgtggttttcatttttatttctctgatgattagtgatgttcgacattttttcatatacctgttagccatttgtatgttttctttagggaaatgccgattcatgtcttttgcctatgtcttagtctgtttgggctgctataatgaaataatctagactggataatttaaaagtaatataaatttattacccatagttatggaacctaggaagcccaagagcaagctaccagcatatttagtgtctgacaaggaatcattccacgtagatgatgctttctttcttggtggaagggcagaagagacaagcaagcccccttagacatcttctataagggcactaatcccatttatgagagtagagcctccaaaaggcctcacagcctaacactactagactggggattaagtttcaaagaaaaagtttaagaagacacggacattcaaaacatagcagcctatttttaaaacaggttgttttattgctatgaaattttttgagttctttatatgtttttgaaattaaccctttattatgtatggtttgcaaataattccctccattctatgggttgtcacattctatgtgtgcacacacacatatgcacacatttaagtctttaatccattttaagtttatttttgtataaggtgtgatacaagggccaatttatttcttccacatttggttatccagtttccaaataccatttattaaagagattatcccttctctttgtgtgttcttggtatatttgtcagagattattctttcttttttatagttttcattgtatatctcttttatcgtcttgattgaattgtttttctagtttattttatttttgatgctattttaaatgacattgtcttcttattcttttttgtatagttcattgttatctataaacattcagctgattttgtatcctgatttttttatcctgcaactttactggatttgtttataagttctaacattgttttggtggggtctttaggattttctgtctataagataatttcacttgtaagcaaagaaaattttatttctttctttcaagtttagatggcttatcattttctaactttttattactctgactaggacttctagtaccatattgaatacaagtgacaaaagtgggcatccttgtcttattcttgattttagaagaaaagttttcattttctcaccactgaatatgacattagctgtgggcttgttacatatggcttttattatattgaggtacatttcttctatacatatttgttaagagttttaatcatgaatagatgttgaattttgtcaaatgctttttctgaatctgttgagatgattatattacttttatccttcattctgctaatgtggtgaatctcatttattgatttgtgtatgttgaaacatccttgcatcctagtgataaaacccacttgactatagggtataatccttttaatgtgcttttaaattttgtttgctagtttttgttgagtttttcatctatgttcatcagagaaattggctgtaaactttttttgtagcgtccttgtctggctttggtatcaaggtaatgctgacatgaacttggaagtgttccctcctacccagtatttttttttttttttttttttttttttttttttgggggagggcggggatggaaggagtttgagaaggattattgttaattcttcttggaatgtttggtagaatttaccagtgaagccgtcaggtcctgggactttctttattgggaggtttttgattactgatttgatcccttactcactatcgatctgtgcatatgtcctgctttttatgattcagtcttggtatgctgcacatttctaggaatttatgcatttcttttgtgttatccgatttgttggcatatataattgttcatgattcttgggattctttgaatttctctgatatttataatatctcttcatttaattataattttatttatttgattcttctctgtttcttggtctaggtaaagttttgtcaattttgtatatcttttcaaaaaataaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatatgttgtgttcccagtttgttgcactcaaagatatttctggatttcctgtttgatttcttctttgctcaggagtgtgttttttattttcacatatttgtaaatttttcaatttttcttctattattgatttctagtttcataccagtgtgctctaaagatttttcatatgttttcagttttttaaaatttgttaggacttgttttgtggcctaacatatgatctatcctgaagattcttccctgttcacgtgagtagtatgtgtattctgctgctgttgggtgataagttttgtatatgtccattaggttcattcagtttctagtgttgttcaagtctgctgtttccttattcattttctgtctgaactatctatttactattgaaagggatatattgaagttctctgctgttaacgtgttgctgtttgtttatccctcagttctattaacattggctttatatatttaggtgctctgatttgaggtacatatatatttaccattgttatatcttcttgatgaattgactttatcattatttaacgaccttcattgcctcttgtgacaatttttaacaagcaccctattatgtttgatgtgaatatagccagccctgatcccttttggttaccatttgcatggaatatatttttctatcctttcactttcagcctatgtgtccacttatagctaatgtgatacttttgtagacagcatataattagttcttttttttttaaattcatttagccactctgacttttgattggagaatttgatccatttatatttaatgtaattattgatagataaggacttactactgccattttactaactgttttatgactatttttcttttcttcctttcttggtctcttcctttgtgatttgatgatgtttgtgtagttgtatgttttgattactttttcttcatcttttgcatatctacttacagaatttttctttgtggttaccatagcacttacataaaataacttataacaaactattttaagctgataacaacttaacttcaatggcttcaatacttggtgcctcgagtgtaatggagggcctgttgctagggtccaaagtgaagctgaagttgagtgctcacttcactctccttcaaccatgtggagaacttctttctccaagttgtgctgcatgggtttgagggagagttgacatatataatgtgaaaccgtcttttctaccttattcattgagtcttttcttatttctatgctctactcaggtgctgtaatcacttacttggattccttagttgttgtgaaggtatttttgtgcatggatggttattcaagttcatgtttctgtgaggggacaaatgctggaaactcctatttcaccatcttggtgactcctgaaaattccaggactcttaatttcgaataggcctgggagaaaagattctgaatagggaaaaaagtttttttttttttttctttacgtgcgttgcaggagaaatattttttttcagaaatgagtatgagatgtgaaaagcctgcttggaggatctttcttccctgtgcataggaggactctgtggtctgtgggccccagtgaatatgaggtggggaagaaaagattcaaggggagtggaatgccatggcaggtgtccctataacatgaattctaaacaccaagaaaactattcccaaataagcgcttttatcttatgtaatagatagtgacatggcaagtactatgttagagccataccggaaagaataatatgataaaatatttgcttaaaaatattttctaagatacaaagtgggctttgtattatttcatgcacacatgtatacatgaacacaaacatttttgaccattacatgtagtatttttcagagtaaagctataaaactaatgtgatatgattattaataatttcaagaaaaattgatttggggctaaatgctgctagacaagtcataggattgattcaggtcaatgataaatctatcctgaagggttttctacacaagtgcttcattagcatggggaaaagagaagatttcagaaagtatcaggaccgtggaagccaatggagtgtctctccaactccagcacttacctatctttcaatgaaatatttctcttttataaagtagataaaaaatttaatagaaatctagaaaaaccaatggagcctttacctaaaatcctacttgataataaatttactggtcagacgcattagttctaatggactataactcgatatgctttgaaatataaaatataaggatgaagcatgcattatagactttttcttctgaattagtataaaatatttcttcagagagtaagaaaataatgatctctaatgaaataagtcagttagaagtgtttattccctctgtaaaaacagaaaaataggattcaaattcatatatgctgtgtgtgtttatagggaaagagagagaaaatgaatgagaacctaaattatatatatattttcttattaaataatataaaatttttcacaaaatagtttagaattgttctgatcattttcctcacacaataactgcatagtctgaagcagtattttttgaaatctggatatcttactctgtcaatataatatttaaaaataagagttctatatttcaacccctaagagtgttgaattttaatgacctgaatatggattatcaatggcagattttaattgtaagcctgtttctcctcttcagtattcttatggcttcttttcccttaaagtcaataggataggctatgtggtataaactgattttaatattaaattaagagaaaaatgagctttacaattttggatcttagtatatggggttttctcaaggctaggcttctgtagcctggctaagcaaagttgactccatcaccactaagagaactagcacccatttgcactcaattatacatttgttgcacatttcccctcatttttactaatttaaaatacatcagtgtttgtaagggctatagatgcacctaagaaatcatctgtggcatttatgtcttatttgcaactcatttattcctattgcttatcttatatttcatgtaaaatgttagtgctatggtggaaaactgaagcccggcatcagacttcttagtagcactgtctgagtcactgtcagcttttatttaaagatattcaactatctatcagtttcacataaggaattatttgctttgatgagagaacttggttttagaaaattaatatttataaaattactgtaatggtagtatggatttctaacttgattctagatcatggttctgaaaacaaagctctatataggccacagaaaaggcttgctctgacagtcagtgtgagctattatggacatacattataaaaaattgacataaaatgaatgaaataggtggcctaaatgcatttccagatgtgtcattttctgtggaagggatgattcactgcagtaaatatatacataagttctgtttgaatttattttttattctcacttaaaatattttgaaaagcaacaatgaagaaatgttcattgtgcaaaatccagagtttattgctcctacttggggctaaattacaaaaaagagtatttaaaattggatacaaatttgattgtgctagcagtaagtttaaaaacaatgttggcaatgtttaataataaggaaaattcactaggacatctgtacactgtgattattttacctaaaagaaatgcaaaatataaacagatgcccatcgagatgtggttgatttttgtctccacatggcattattggcttttattaaaagacatctaatcaagtttgatagatatttcttgaaatgatgcatggtatgcaatgcatgctttcattgtgcttcctgccattatggaataacgtgtcttatttggaaatacaatgatcatttctgttaaatcatgctcagtgagcttatataataacacctgtattttgtgaatcatttcagatttcagagagctatgccttcctaccaagagaagcggtgacacgatttctaatgagctgctcagagtgccagaaaagaatgcatttaaacccagatggaacagatcataaaggtagctgcagtgtcaaatagtgagatttaaagtaattttattcataatggccatttgtatctcacatttttataaaaacgtggtagactgaaacagttcaacaagtcagatcatctcatttattcaagtaggaggcagtgaattttgaatatccacttacaaagtaattcagtgcccattcttagaagaaagacagtttcagctgtggcaaataacatttttccctgtaatcatgttttaattttcatttattatatgtatttcatgctattttagatatattcagcaaggaaattggtttctatcaatgtctttttaaatctaccaattccttatttctaaaaattatgaataatgtggagtttctttactaaaaaattttacattaaaattatgatttggatttagctctcattaaaattattgaaaattatttagctaaatatgacttcctctcagagattatatcagtctcagagatacattttttgctggctcattcctgtgtctcgaaggttaaatcgaatggccaaaagcaaaaaattgagcagatttccttcggcattcaaaaaatacatatagaaagtaaagcaaagaagaaaaatacaaataattgtgttagtacaccacattaggtttatttattgttattcaggatgtttaaaagttcccctgcatttataaataatttattagtactgttaaacagtgtcaatacacctttgtagaaccttactagttgttttttctaccgtccaactataatgctaccatgctttaagacacttgatatctaaaatcctgtttcaatttggagaaatagatcattttaaaattacaggtagaatgcagtattactttcattacccattaaaaatgttttattacagataatggaaaacctcccactttggtgaccagcatgattgactacaacatgccaattaccatggcctacatgaaacacatgaagctgcagctgctaaactcacagcaagatgaggtaaaataaaaacatctacatttgtattacttacaaattggaacgaagcttgataaccatgactatcatattaagcatgatggcattttgaagacagtaatttattttttaatgaatgaatctcaccacagttgcacagatgggaaaagtgagcagaaactcctagtccacaatacagagcccctgcttaacacctctgtcttagtgttatgtgggaatttgtttgttcccaagaaagctacattttccttagtagaccatcactgagctggccttggtaaagtgctacaaagttcagagggggtaagttcacagtaaagtatccgaaataattgagattctaaggaaatttaagtactaaggctattttgcatggcaatcagaaaagtagagttaatgggtatttcaagtattatcatttctccatcattcaaaccttatgtaaattttaaagttattttttaattaactgctattctatatattatttatttacttctgtgcatttcctagagacaatctgtggtcattcttaattagaagtgttttgatgttttaagttatcctatttaatttgtatagtgaaaatttagcaacatgctgcatgtatagacactaaaaacatatttcttaaatactctgtaggattctagttagctagccattttggttgaagctatgtcaaagcagggactaagttatatatgtatggtttatattctccaaaataaataacaatagcagatatacaataggtgcttagtacatccttgttgactagttaatactcaatagatgcattcaggttatttatattagaaacaggttcaggtcctcaggctaataaattatcttcttgaaatttctctaaaacaggaaatgaggttaaatgtttgtttttcaaatacagaattatttgctaagctatgattgcattcttttaaaattactttgttgaacttactttattcataaaactcaaatcaagtttttagttttcctctgtatttaagcagttttaacctccaagctatatttataaaattgtttgatctcaatagatgttattcagggtatactccatacaaaaattcatattagtgcagtggcaatattggattttatattgccatatggctacatataaataattgaataaatagtaataaaatcattgggttaaagatatcaatgacaattaagaaaatactaatgtccttccatccctgagaatgataaaaaaaaactatcttcatgattcattatatagttgaaaaaaatttttaaatgtctcattaactagttagagctgtcagattatttgtaggaagctcatttagatgttgatatgtttattactaggccaaaatgtaagaagatccactttgtgccaacaatgcgcccacatatgctgatcccttctggcttctaaaaaatcataagtattttacacaaaagaaatagatcctttaaaatttataactagattagaaaaataactcttatccttacattttgaaaatactaaattggatgtcacgcttccttaaaatatttagataaatgactagttagattatttgcaaaatttttagaaaattgtgtttattgaaagatgaaaaagaggttaagtaaaggaagtcacattaaaatggaatgtaagtgaaatattcctgtctaacaaattatatttaaatttgaataagcattaatccaataagttcaaccaatatttattcagtacttacatgtatctggtcctcctgaagaaaaacagtgaataaattgagaaaaatctttgtcttttgtgggggtaaacatataataaagaaaataatggccataggtatataagaatatgctaaaggctattaagagaaataaagaaggccagacatgggactccctttagaactagggaatcacaagtttaaaaggctttattaaaatgtatcatttgaatagaagtgaaggaaatgtgtgcatgtagcagagggatatagtgaaaacttcctgaggcaggtatatatctagtagctgcaggaacagcaagacagtcaacatggttggaacagaatgttcaaggaagaggaaaataggagaggagtttaaggagatagtggaaagccaagttatatagagtcttacattttaagaacttttaaattttactctgagtaatatggggagccattagaaggttttgagcagagaagtcatgtgatctgatttatattttaacataatgatgggggctgagaatagattgaagaggaaaaaaaaactggatgcagggacaccagtagaaggttattacagaaatcagtgtgggtaaggagttaacaaagctctattccttcctgcatgagaaattggcctttgaataacttttggagtttgcgctccacaaaactgctaacattgaaatgataactctgttactaggcaatgttcctatggcaaaaatgattccaattgataaactgtatcagaagactagaaatatctggttagaatcttcagatttccttgagttggatgatttttgcaattggcatgtcctttgtgaggaccttaagttattaactgtggtgtgataagagatttttgtctcttttggggcatggggcttctctgctaagtttccaacctacccagtatgattactgctttcttgtacctgagctatatcacaggaagagctaaagaaaatatgtctaattaactatgtgaatttctacatggcccctgcaagggcttccatggaagagaaacacctgatgctgccctactggcaagagtttcctttgctacatgtttctagaagaagctaatgccaagggttttcaatggtcctcttatgagtatacattttagttggatttaacaaaagcttctgatggatgtttcaggaaagaagataatagtggcttggatcaaagacagtggtttaggtagtgaaaagaggtgaaattatgaatagattttaagttttgctgacagattcgatgtgaagcatgaaagtcaagaggtagtaatggctccaaggtctttaatctgaacaagtagggtagaattggtattaactagtgtaagaaaaactgtgggtagaaaacatttgaggaatgatactagaagttcatgtgagctcttcattagaaattcaagtatatttaagaggtttattagagattcaagtagatttgtcaattagacagttggcatgtgtaattaagagcaaagaactaagctagacataaggccaagcatcatcggcagatagtgtgtgaagccatgagactgaagatactaccaaggtagtgagtgtagactgaacaaacaaagcccaataactttgatttgggaaattccaatgttataacatctggcagatagggaggaaccaacagaggatactgagaaagagcacccagggtattaggagaggcaggagagtttgtgaactagaataaaactggaaaaaggtttttcaatatgtctacagtaatgtattatgtcaaatcaagtgataagtcaattatactgaagtctgaaaattaaatttgtgtttagcctggtggaagtcaatggtgttctttacaagagcagtttttatggggtgctcaggatgacagcagcaaggccattgaagagtttgctatgaaggggagcaggggaaagaggtaggagatggagggagcatgggaacaggagttttttattatatatttttttctaaaatcagagaaattatagcatatttacatgttgatgagattcatgtagcagaggaaaataatgatttagaaaagaggaaggagaattgatgaagcaatatccttggcattaataggtaggatttcttgtacaaaattggaaaagttggccttagaatggagcacagacaggagggatcagatagaggtaggcgaatggaaatagtggtggagattatggaattgttctgctgtttgctcctaattcatcagttaaaaaaaaaaaaaagcaagactaaggatgtttgagaaggtggtgaaagtttgagaagaggagaggatgtgagaagtagaaatctagacagtgaggagtgaattgaccaggaaaatggacctcttttgagtttcaagtaaagtcatttaaataattgctcatctctatgtccagctatataggggcatgggtagaagacagtaagggaaaaagagaattactcacattttgggtcttgtcaaaagaatagaagtgttatataagggtatgattaaaatgacaagccatggaattctagccacataagaatataagtgagatcatgagagaggtggggcgagagcaggggaggtcaatgcaaaagggttagagggttagaatcaaggggtgataaatatcagtgggatagaaatttcatcggaatactagaatacatgcaatactagagcaagtgagctgggaaatttgagctgttgtgtagagagtgagatgcttaaaatcaaggttttggaggatgtgcagttgctggtaatgaaatgcatagaacatgattatgagagcaaaatggttgaagaaaggtagaagaccagatcattagggaagagttcatgaaagtgacaggtcaggatgtttccagagacactgaagtaatcagggaccgaagcatgcgtagttgtctttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatccacctgcctcagcctcccaaagtgctgggattacaggtgtgagggtgcctggcctgaaataatatttttaaacagtttgctaagactgtcttgtgaaaaatgtcaaaacatgttcaaatatcaaaattctattaaattactctttttattgtacacatcaaagaaagaattgatgtggagagaaaaaacacacaggaaaatttaggaaactggccgtaaataatttactacttagaaccactgacatgctgctctacctccattttgcagatggggcaccaaggtttttagctgataaaacttgccctaatgattaaactggtagagagaagattggatatttgaacctaggtttaaataactttggagcccaaaatcttcctactgtgcaacacatccacttaaaattagtattaactatttgtttttttaagcaacaaatcaatgtaaatagaatgctatggtgtagctcaaaggggagaaattagatgtttttcagttttcttttgctatgtaccacccctaaaacttagtgtcttaatacaaaaatgatttattaatactcattattctatgggttaagcagttagccaagaacctctgggtgatttattttgttacttctggcataggctaggatcatttactcagtgacattcaattggtagctggacctggctggatagtccaagaaaacctcacttaagtacccggttccttgatgctcctttatgctcctttacgtgacctctcactctccatgtggctggcttatgcttcctcacagtgtgctggtctcagggtagtaagacttcttaactgacagctttattgtatggcagctggcttccaagagacaggaagtggaagctccctgttgttctgggactgacacagcatcacttctgccatatttctattgaccaaagcaaataacaaaaccagcctagtttcaaggggaggagagagaaatactgttccttgatctaaggagcagcatgcatgtaaggggcagtggggaggggaagggatccatggtagccatctttggaaattatccactacatggtcaatatccataaaaaaaaccccaacctcctttattaaccaaaataaaattttaatgaattaacttgttatttgaggcttactgcattgagaaagattttacaaaatactgtatccaatatgagatcatttgaccttcttataaactgttggtgagggtttaaactcgaacaaactttctgggggatgatttgatgataattattaaaaacttttcaaatatatttatattacttgactagaaatttatcctaaggaatgtgatatatgaaacaacaatttatctattaagatgtttactgtattgctagtagtgaatgactgagtatattttcaagatttcacaacaaaggattgtcagttatgcactgcctaagatggtagtcattagtcacatgtgaatgtataagtttaactgaacattaattaaaattaattaaaactaaaaattcaggtcttaagtcacactaaccacatttcaaatgttcaacagccacatacgactagtatttaccttattgaatagagaatattatagagcaattccatcattgcacaatgttttcttgaacagcactggactgggcagatagccagcattaaatagctcattgagctacatgttgcaggacaccaccccaaagattctaattctaggtctgatatgtgggacctggggatatgaatttttaacaggatctacactcatgcacactgagatttgagatgatgaatttcatagagatgctgataatgtaagctttgatttgatttgagcagatgataagttttaaaaaatcaacagaagagaagattggtgggagtggtttttaagcagtcttatgggaaaccgtaaatatttgattgaatagcatacacattatttgataaacaatggatagggctgcaaatttataagcagagaagtgacatgttcagaaatgggaagattaatttggcaattgttaataggcaggactggtgtagagaaattggatgtggataagttaactgggagactattactacatagtttaggaaatggcaaaatgcaattttgaactaatcaggcaggacaatagcaggcgaaatcaggaggtacatggtagagaccctttatagataatatctggaacttgaaaactaaaatgaaatatggagcagattaggggtctccatttcaagcaacttctgaagatagaaataaaagctcaataacaaaggttttgagaaataaataagtgccgtgtttaaaagggaaaagactgaaaagaaaattatttgttacagttaaattgttctaatattaaaacattaagtttcaaggaggcagaattactatggtctctggccatgactttcattatcatgagattttagtcatgtaagaaataagctcacacagtatgatgtggagagtttttttctggttgtcaaacaaaatagattttcatagaggaaaggaattagatgaatggtctagagataatcatgaataaaatacttaatatcagatcagtcaagttttctgattctttattcttagaagccttcagtagtttcttcctagtgtaattagtattttatctatgttggtaaaaaagcacaagcttatatttcatatacctctgctaacttttattaaaaacaataatttaatcaattattaactaaactagaatatacagaatgaatacatgcacttagtctcattaaagctcttaacaaaagtataacaattgaattctaataaggaatgtaattgtgaaaatgaattatatttcatatgtagtagtggaggaaaatatttaaaatattctcaatcattaagccacttatgatggtaaataatttaacatggtttttttaattacaaaaatacataagtatacatttggttacataaacattttaatctctcatctgaatttattaaaatgtatgctggcaagagtgtcagcatacattttagtggtgataaaaaatatattgattttccataatatgctgtggctgtttttacaaccatttcatagaacagaggctgtgacttgaatatttatatttagctcttctttaaacataaatacacacacacacatacatatcctcatatacatatacattttacatatttatatgccatataaatgatattttactagattacttatagttagctttttgtgacctttataacaaatacttataaagactgtttatatgtttatgtaaacacacagctactttagtaacacatttttgtttgcctttaccattatattgaaatgtgttatattttgttgtatatgttcatatactgtaataaatgtgcataattttatatactgtagaatgcattgtatattccatatagtaatattaaaccattttattgtgcttatcatgtacctgacattgttctagatactttaaatatagtacacgccctcactccacatgtgactctgtgagagcagcacaatttttatttccattgtatagataaagaaactgaggcacagtaagttgaggtaacttgcttaaggtagcatatctaataactggcagaatatggacctgaatctaggaagtctggcttctgagaatatcctctaaaatactatgacatcacagaaagtaaatatagtgtatctaatagatatctgtatcatctatcaacgtgtgtatatatatatgtatgtatttgtatatgatcaacactagtaacaagtccacattgttatcactgataatgtcagtccacattgaagtctcttatttttgcatacacacacacacacacacacacacacacacacacatacacattagaatttagaattggagtaaacataatgtattgagagagggcatgcaactaagagaagtctatgtggctgattgtccatggatctgacacagtggcatttccttactgacttaatgaagagctagtgctactcagtgtgcccaagcatgacccagtctttgataaaggaaagacaccacagccaaaaccaccaagcctgatataagaatcagaatgccaatttattagtctaccaggatagtcttgttcgttaataatagaaactcctttgctgatgccaagatgtcatttatgaaaccagggtaattcttcctattcaaatatattgtttcctcgagtctggatgacttcatatgactaccggttctagtatataatagcagggaaaatgatttaacttctctgtgcctcaatttcttcatctataaattgtttgcaaatttgtagctaattcatagttgtgataaaatataaagaacaacgtgtgcaacataaatagcagcactactactgctgattattatattcgtgttaaacgttcagatcaaacatttacaaattaaagtcaaagctagagattttgattaaacatttacattttgcacaggtttcccgggccttccagcctgtataagtataccatttgtccaaaaatcagttctccaaacgaagtttgcttcagaaaaatgactgcaataatatatcctagcatttggtttaacatttggaaagttttgataaattggccattcagcaaactggccttttggtaattccattttatgaactgacttttagtaaatgtttcatgcacaattttacctagaactcctctttgtggttgccgtgcaatttatatttgcttgtaaagaaagaaagggtgtactaagattagcttgctctccattacatgtggactttgaacctaatatataagttggctatattagaatctatcctgtttgccaatgaaaatttttttataaagccctttctgcattctaagatttctgcttacaacattttttggtcatttagttttaaatcaaaacttgtatttctctttatgttacattttatgattaactcttttagaaagtatttactataaaatcattctttatattatttcacaagtcttgaaattccttgaagggagaaattattccattgtttttttgtttgtttgtttgtttgtttttttgagacgagtctcgctctgttgcccaggctggagtgcagtggcttgatctcagctcactgcaagctctgcctcctgggttcaagccattctcctgcctcagcctcccaagtagctgggactacaggcactcaccgccacacctggctaatttctttctgtatttttagtagagacggggtttcaccgtgttagccaggatggtctcgatctcctgacctcgtgatctgccctcctcagcctctgaaagtgctgggattacaggcctgagccaccacgcccggcccattgtttgctattttaaacatctattagtttgtaacatatttttctgaattctgtaaaaatttactggttaaacttcaattgactgtgtagataaaatggttattatttaaacgtattatacgttaaaatgcttgatgatattttaaaactattttcaggatgaaagttcaatagaaagtgatgaatttgacatgagtgattcaacacggatgtcagctgtgaactctgatcttagctccaatcttgaagaaagaatgcaaagtccccagaatcttcatggccagcaagatggtaagcctttcagtttgactaaataagcaaaacaacagcaaaaaaatgagtcagaatgcatggaaacaacaactacctcttaattcttgtgtcaatttttaaaaatctacccatttctatgggaacttttctctatgtatttaggttatatcatccacttcactattttttaattcaaaactgttcaaaaccaaggtgttagactgatttataagcagatattggttataaaattcaagttaattcatgttttgctccctgaacttaaaatatgtgttatatcaatacagtttggtttctgtgatattttctagctttgatttcttgggctgtcattcttccgactaaattaagcatttaaatatgatcaaaagattaatttggatgtttatcttttatgtaaaagacaagtttcaactaagaatcactagatattaaaggaaattttaccagagcaatagtgctgagtaagacaatatttgctgtgatttttgagctactttatccagctgttaaggaaagaaagttcatgatctcttattcctgggttcatgaaagatttctgaatcagcctattcttgataggaagaaagctagatatgtagagaaagtagatgtcatactaacattgtaggcctaatatttttggagatctttgaacactacctttgtagatttttgtctttgtaaatatacaattatgtatacaagtcaatgtgacttattttggtaattgctgacaaaaagggttttaaatagaaggaaattggccagttatattcaaaatttgtgtattatttctgtatttaacaagttcatatgaactttttgattgaagagttttgtacttacatttatagatactgaaaaaatctttgctttctctgacagttgctattacaaactggttgcaaaagattgctgtatttctagctgctatttgtgttctgtttgtgttggcaaggcttaagaaatccctagttttaagcataaaaaacgtccaagaacagaggggcttttctttttctcacttcagattaatcttaaaagatgctggtgtccttgttagcatgagttataagaaaatgaggaatgcattgattatcagtgactttaagatagtatcttaattgctacgtgctaaaatagctattgtagtagaaaagcgatttatttggaaatattataagaatgaagtttttctgatttagatataaattttctcttttcttctaaaacatgagtaggcattcctcagattttgtatttttttaatggccattgtatagtaccaagatcatagagtaactgaaatattcttagtaatgtatatcactccattaatttgcttatgcatttaacttaggtatctccttgccgtcttagtctataattttagggaatatagataatgtagagggtgtatagagaatgtagaggatgtctctcatcatgcaaattcattgtttacttgactgaagttgcaagctgcaggtctttggctatggcacaactgctgtgatataaatctatattgattttaatcaaatgcagtagaataactccaaatattatatactcttagggaaaagcactttctcatgatatattgatgatattctaacctaggcctaacccttccttgccttacatgtaagatacttttttcttacatttcttgctgagttttctcttgcagtgatccgtcctctttctcctgcatcagaggttttccccactctactggattattagaatctacatacaaacataatttgataaatatcttctttaaaatgcctcgattgattatgtctttttccgtttctgctgctacagcaaaatacctgagactgagtcatttataaagaacagaaatttatctctcacagttctggagtccaagatctgggagtccaagatctaggtgccagtaggttcagtgtctggaagagcttgttctcccacgatagtgcattattgctgaatcctcccgagggaaggaacaccatatcctctcatggtggcaggatccaaagaggggcaaactccttctgtcaagcccttttgttttattttgttttattattttatttttaagatggagtcttgctctgttgcccaggctggagtgtagtggagtgatcttggctcattgcaacctctgcctcccgggttcaagcaattctcctgcctcagcctcctgagtagctggggctacaggcacacaccaccacacccagctaatttttttttttttttttgtatttttagtagagatggggtttcaccatgttggccaggctggttttgaactcctgacctcaagttatctgcccgtctcagcctcccaaagtgctgggattacaggcatgagtcactgtggctggcctatcaagcccttttataagggcacctaatcctattcatcagatgagactgacacatcctaaaggccatacctcttaatactgctatgctggagattaagtttcaatatcaattttggatgggacagaaacattcaaccatgtcatatcccattgcacctcttcattcatcaccctatttctctgcaccacccctgcaaaagactttatagtgaaactctgaaagagttttcccgttatttccactctatcctttttggctcatctcaagtaggctttcatccttgccaccaacttcacttgttcttgtgaacatcaccagcaggcttcttattgcttaattcattggtcaacccttagtcctcatctccttcaacgctaatgtttaaggacaatgcctccccccctttttttttctggtgccatttctgtctcattcatctctgtgggctccttttctatgttctattctatagatgccagagtgcaggcttcaactccctcttcctttttctcactccctagtacactacatctaaccatgttgctttccataacatctctatctagatgaatcccaaatttatttctccaagccctgacatctttcctgagctcaggactatctccccttacctatttcctaattgttaacattcttcagaggacttatcactgtatgaaactgcattatttttctcaattattagctgtttctcttctagaatgaaaataccatattaattaatgagttttcacatgcttaaagttttcctttcattggcttcatttgagttagttcttacattctccatcatttaaatgattaaaatataactttttaccataattatattttgtaacacaagttttacatatttatcttcttttcttctgtccttccttctgacaatggtactctcctaggtaatccatattgacaaccttctgtaaaatttctttttttcctgtttacaaatacacacccatatacatactcagaaaattttgtcatcaaaaacctagaattatgtcatttatgctcttctgtatcttgatttatttgtctaacattacctttcttttagagcttcctatattaggggtgtgtgtgtttgtgcgtgtgtgtgtgtgtatcacagtaagaaaaaaaaaggcatgggacctacctcatataacacacaattttaaggaatgtatatcaaactcagtgttgccactattgacacacaactctttgttggagagggatgtcctctgcattgcataatgtttagcagcttcctggcctctacctgctgcatgttcttagctccccttctcccaactgtgacaaataaaaatatcttcagatgttgcaaatgtcccttgtgggacaaaattaccctaagttgaaaacaaaagaaaagcctaggaatcagtgcccagttgtctttctgcaatctcagaatagttctttagttacactgtccaacttgatagtcgctctccacattgtggctattgagtacttgaaatatggctagtgttactgagaaactattctaatttaattttaattcaaatttaaatagctacatgtgaccggtggctactgtgtcagacagtgtagatatagatcattattttattttgactggcagttaaactctgttctctgcagccattggttgaatgtgtctgaagtctggaaaaactatagaagaaattcctattttaacagttgactgaaatccctgtttaatattttgaaaatctaaacaatacaaattattttaagttaaattaaaatttttttttaacattaagtgattaagattttatttagagaaattgaagtaggacattatgatttttataaatccttcctaataattataacaggtaggtataaaaatgtccttattgggtaccatataaaatgaagagtaaaataactttttttacaatttttatttcactatggttatagaaaatttgaaaagtattcattaaaaaccaagggaaaagaagactatcaaatgtgcgttgtgttggaaatacatatctggatatatagatatgtatacactcagaaaaggtgaaaaagaagaaaaatatttttccccaggctagataattagataaaggtcaaaaagacacaaacctgaatgaagaatttgtaataagaagaatgcttcaggattaatgtatagtattctgcttcttttgccttttttaggtttataatatttccctaactcaataaaaacataaaggcaaaaaatgcttagaaactgaatcttcgcataaaaannnnnnnnnnnnnnnnnnnnattttaccctcatttttggttttgaggaaactaagttgagctatttaaatttttttttacagacttaaaagaatgtttttaagttaaaatcatttaaaggttatatatacgtctgctttactcatgaaagcatgagtaaaagcaaaacaccttgaaggtgttgtggaatataagggacttattatgaaggaagttttgctatgcaatggctgcggttcacagaatttcaaaaagcatctcgaggactaacagctaaaggcatccttcaaatattcagcagtttgtaagcattcttcttgttctgccagccatttaaatggattagaaacagaaattttgtcacttgagcttctgtgtttgaatctcagatcctagtcatttatggcagcatggattagctcaaaaatgtattccctttcctaaatcaattacttactttattatgaatttgtaccttctaaaacagctgatgttcattccttgtctggggttatttttaaaaaatatctggcaaaagaaaagtgtcagatttagaaacagacttaaagtttcagttcaaaataagcattttacttcattttatagaaggatacttttctaagaaccattttaatcacttttctgagttaacactttaatgtaaactattgatattttgtaagggagtatttgtgcttttttaagcacaaataattagaaagattattagatattaccaatatatttatgtatttttcaattgcaacaatttatatatatatatttgcattttaaaaaaagataataggaataaaaggaatgttgaggcatacccttaaattctctgtatgtcagcttaatcagctataaaagctattaagaaatccatttaaaatatttctatattaaatattttcccatggtcctttgagccttttggcctccatagtaaaaatctttgcctcccactaagacacatatgatatattaatagaattcaccaaaaataggaagcatattcagaggctaggtagtcaaaaaaaaaggcaaatgtaccattcagagatataattctaaaaggtaactcacttggatccttgggtatacttaggacaagggtaaatgatgtgaggtccaatatttcattattcactcaactaatacatattaaattctagcataagttggacaatggatttacaagcatgaacattgcatattagattaaaccatatgaaattgccatacttccttgatttgaactgatggttcaagctttaaaatagcttaaactagaatatgaaagatatggaaacaaagtgtttttgaaattgagatgcatttctgtttcagatagcaatgatgctcacatatgtacattgtgtatctcttgacttgtacactcgaaaattatcacaatcctcttttcagtggaaacatagaggggagtaagttaacaaaaaatagcaatctgattgtgagataaataagtacattaacagatataactgttggagtttcactttttcttatatcctaattcagattatgtgctaaactggcctcctgaaactcctacattgggaatttattttaaaaatacagattcatgggacccatctcagatgggatgactaagacaattgtgtgggatgtaagtatgggaaccagtgctccacactatgcttgtgaagatattctttactattctacctagctgttctggagtgccaaaatggcaataggtctaaaggggattaagtcacattggtgcacttcatgctcaaatgttgtgaccagtaacttctgagttactttttgaatgaggaatagcatgtaagttcattcctagtatatgtatgtgtttgtatgtgtttcaattagctctgctttcttagttatgacaattgccacatatgacagttcttttgtaaattttgaaaatgctcctattctactctaagaaattttacagtctgttttcagtcttatgtatatgaacactgcacacactggactttagaacacacacacaaacacacatgaaatactcctttgaaatgctgtttttactgcccagtttatatgtgaataaaattttagtaaaaatatgcttgtggctaaaattgaatttaatttggttgaataagatagttttatgtaattattaaagtgtataaaccagcagtaaaagcaagaactatgtgctgttcaccatttaatttcattggaaaatctaataaaacatgtttttaataaaagtgatgtaaaacagtatactgaataggaaattaaattcagtggttaacttttttgtgatggtgaattttaatcagaaaagctattaaaatgtttttcaggctgaacaccagattccctggagagattatgttgtcttgtgtaagtcattttctttcttgtgcaagtttgttttctttcagtgtttacaatttcttaggaaacttgggatagagcaaaaattgttaaaaggatgttgattcttttatacaaatgtaataaaatatttgacttcaaaattgaattcgttcctaatagtgtttttactctcactttttaatttgcatacacttctggacttaaaatacctaaaaatgatacaatgctgctcttttttcttaattcaagttgttttaatgcattattaaacctaattcacatgatgaatttgtttaaatattctgaattgagttagttaattcgatgaagcttttagaaaactctctttatggcagttgctctataaataattgtataataatttacagaagtataaactacctttataagtaatataaagaaaacaagtaatttgaaggaatgttactatgaattggaggagattttgattattaaatccattcataatattgttatttgtgtgtatatgtgtgttcatgtgtaagtatttaatcatttgaaattgcttttaagcagtaattctctgtttccaaaagcagaagaaaaggcaatttgacttacatataaaggataggtatgaaaaatgatgtttagttgtatatttatttaaaatgcatatctagggaatgttatttactttttacatttaagatcacttatttgggagtttgctctaccttttttagtgacaattctgcctttcaatactttactcatattacataagtgtgttttcatataaacgagtgcttgtttagagaattagctcattgatttcaggctcaaacttgccacaccctagagaccagtcccatcttagctaggttctgatcctctgggaaactaggggaaatcggcttggttacatgcttgctttggagagtctaatctgatcagtgaaggacgtcagattaatttgaaattttactgctgggttagttctttgttttgagatattgctcttttggttttgtcactatcttcttgacagtgtttgccagtccatgaatgtttatgtggatccaaagttcaatcagtttcagcacctccaggagatgccaaatttctgttaggaccaaatagcagatgctagaccgtttaatccttaaatatggatttctgtctgtctgttaaggcataaataaaattaagaagcctcataacaactggagagatgttagacaatacatatcctttctgaatttattcaaataaattttgaacctattgatttatatatccagctatattatagaatcagaccacctgcatttccaacttgaaagtcttgaacaactgtcttttttgtctatttttgtttttgtttttactatcacctggctagcctttataaactcttaccgtaaactgaacaccatgctgtgttcctttataactttcttgtactaatttgggtcagctagctactacttcttttaaaaacagctttagcctttaggcaaagcaatttcagtgtttagtagggctttgaagctggtgttgcatgccagctgtgcagacagataaatcaactacaacgtaggggtaaattggccatgaaaatctttatttactaggtttatagagatcctagttagattgtgggtgatataaagaaagaacagttggaaagtattgaagaaaggggttgaaaggatatttcattataattattataaatttacagtgtaattattttcttaccagtctcatttctccacttgactgggagtgctttggggacaaaaaacaaagtatatcttatgtatccttgcatattctctttggagccacacacagtatttgaaatacaataaaatataaatactttttaaattgaaatagtattttgaaatttcttccccatctgcttacttttatagtgaaatgcactcaacccttagactcagttattcttgccaaatattatataggcagttgctttccttatcctcgacgggcggggcctccctgttacaatttcagcatccctagccaggggtttatggacagaactctggtatccctgagaagagcccctaggaggaagggcgaccgcagtatcttggatcagcagccctagtctttcctgtctgctagctctggagagtcagggcagcccagaggagggggattccacccagcccagcacacccgctccaccaaggggcagccagactgcctatttaagtgggtctctgatctggctcctcatgactgtgtgagacctcccaacaggactctccagacacctcatatgggagcgttccagccggcatcaggtcagtgcccctctgggaaaaaacttccagaggaagaagcaggctgccatctttgctgctctgcagcctccactggtgatacctccaggggcaagagggacccaggtgaatagagtccagagtgaacccccaacaaaccgcagtagccctaaggaagaagggcctgactgctaaaagaaaaccacacagaaagaaacaacaacaacgtccatggatgaatattctgtcttttttatatcttactttggggttcctgaggcctgtgaattcttccttatctacaaccacaatctactatgaagcaataaaataattagtagctttggtatgttaaagtgaatccattaagaagacagcataaaagacctctcagccataaatattgacactagctcggccagtaactagttctgcaacattatttaagtattattgacaactttggacaaccttttctatatttgtaaatgagaagctttagataatctctctctaaactttattatagttccagaaccatctgtgtgttcaccctgttagggttctctttcttgttcctaacattttatcttgtctcattttctgtacatctctaaactggtttagtgctttcttaaactagagaaaggaattaaaagcaatggagacacccccatttttctcccagctggcccttccttagaaaaccaaggtgattcctgaaagaacagactttccactcttctagtttctccctcccatcctggctgcgagagtcattcagagttgtttcctcctttttcctcccaatctgccactccattttcaagaaactatagtcaacatgaaagctcacaaatattgccaaaatattgtgaaatcatcacttccttctttttcctctatgaagaatctcattcataagaacccttatccctaatccatcttgaacgtacatgtgtatatatgtatgggtatgtgtatatataaagacagagagagagagcaaaatttagctgtttcaacaataatttttaatttccactcaatcacttttcataaaatatttcctgaggttttgaggtactggagtatttcttgggatttccttcaaccactgcattgttatgtctttggcaaccttaaatgttcatatacattttagaaattttgagggtttctggcagtcacatatcatcagtcagcccatctctccctatgaggttaattcactaacatgtcattattgttatggtgtaacaatgttagggagaatcattcctggtgccatacagaataaaacgtgcaactcatcactgcttagccctgtctttattcaaatctgtgatgaaacaaacaagagaaatcaggttatcaacatagggacagtggagtttagtgcactgaatggtgatgtggggttctaaagtggtctctgtgaggacatgcctactctcttaaagcatgccagcagaaccagtagtttgtttatctaaaatattgtgtgcatgattctattttagagtcaataaaaaccatataaactctcatccaattcaaccatataaaatcaaattatttttaaaaggcatttctaactcaaaggacagatgatgacgagaactaaaatttcttgactgtttactgaacgctaggcgctgtttgaggaataagctttttaaagtttttactagagccatttgaggtggacactttttttttttctttttctggtatacaagaggacacggaggctaatttactagcctatcatcaccacaactactaagtagtagaaacaggattggaacacagccttctggttctgatgcccatggctttaagcatgagtttctaagttgccacaagcccagctgtgtaaccaccgcatttattatatcctatagtttatgcttgctcacacctattgttttatgctttgcaggctcaaccattccattatgttcttattttctaaacagaaaattaataatatagctaatatttttatatagcttgtgcttttataatctgtctataataaccacttgtagatgttttcctgtaacttcctattatcatgcatgtatcctctttgtttctgcattgttataaagaaattaaaatattatttgtagccattgaaatgtattggttctgtctagctctctaaaacaggagtaggaaacctaaattctgtttgttcagtaatctctcttgacaataattgccctgtgtttaaaattcatattttcttatatctgttaaatatgtaattgacttttgacagtttctttcattccttccaattctcctttgtctggaaaggacaataggaaaatgtggctgccctctttggctgcatttattattttgtatcttctcatttcattttactgtgctttattctaaataataagaccaagctatgatggaaggaaaagaaaaacactcttcattcatgaccatccactcatgtcaatagtgatgtaccttatcttataagcttattttataactattcagccttgctttgtgtgacatacaataaaatatatatgttattgatgaagagtgccattttcctacataaagcattcagaaaaataggctattttcagctatcaattatacaagtcacatgtcttaaaataacatacattatataatagtgatagtcatttcaatctaataaaatattttaaaagaatattaaaatgtgtataatgtggaaattatccagattatagttaagtagacttatcaaatatgttcagtcctacacaaatgtgagcaaacttttcaaaataaaatgccaaacttcaaaagaagttttaatattattaattgaagttacttgcatttgtggaaataaagaaactagaccaataaaattcattaaaagtacttaaaagatattgtggtcctgagaacttatgtttagtaaattgagaagttaataatagaatcagttaccacttaggcatattttctgtctaacaattgtgaatctgtaaataggccagcttctgcatttgcatcagtagataaagggccatcttctaatttcttaaaaagaagactgcagaatgttattctgggtatgaaaattttataaataagttccagatagactagatactttggctttttcctttgaaaactgtttttttacccattgaggtactattacaataatgactatcatgtagtttaacaatcaaattagtatcttatgtcacacattattcccatttcaaagctaaaccttacattttattttctttccattaaactgtgcttctttttgccattaacaatgatgctttacccagttaaacatgtgttttctaagacttctttataaagcacatcctaactgttattaaagatgatgatgtttgtggccagcctgggcagtgtagcaagagcccatctcttaaaaaaggatgaatatgatggacaaggatgtggtacaatggacgtagcagtggcccagccttcacagtatcaaagtttagatcccagttctgtgatataacctgtgtgccctggtgcatgccgctttttatgttagcctatgagcccttcatttcaattaggggtaatatatgccttattaacatcggagtctataggaacttattagataataaagtcatttacaacagaatgttattgaccacctactatgtgccagaactatatgcagggctggagattcagcagtgtgcaaaatagaagaggcccacaatcttgcagatgatatgtaatctggttgcaggggtgaggccattagataactataggaatatatgtataactacaaactggaagaggagtcttatgagagagtctagcagtggctacagtttgacctgaggatggaggagctgcaaatgcttctcaatgtaagggacagagatccagaggatgaatgacccatcacaggtgacaaaaggcacaagaacatgtaaggcagaagcaataggatgtgtcaaggcctcgtgccttctaaattgttgtggtacaaatggggcaatattttggtattaggtatgctttgtttttcaatgccttttacttctgcttaccacatctcctttaagcagaattcaggattttcccaatgaacagcccttaggctaagtctggtatagaaagaaacaacaatcaattgcttggcttttgagtgtttaagtagatattttaaaattaatagcatagttatatatctttaaaaccatgactttgacttgcaagatgcaggcaaagaacagaattctaaaaacttggctttaaataggagcaaaaacctaaaagtctgaatgaataaattatagaagagacaagaatgcataattacataagaactttttttttcttccaaaagaagttaatcgttcaatcatatgtgtgtgggaaagagcaatttggagaaataagatgtgatgctcactgggaaaagcatactggatattgtccctgtggcagggtagttggtatatggttgaaggtacaagatcggagcaagtgtgtgtctcattactcaaggtgtagtcaggaaaactgctagcctcatttgtccaacatggcacctgaagggttcagcaacaatggcatggggtatttaggtacttacactaaaggaaaatctcacagatacacactccagcctaggatggggtggcaaggagaagcagctgggaggtttggtgaactgggagaatctccttaactggagattcagcacacagaagtcctgaatctgtcacctggaagccttgacaagttcatggtcatcatcagcagatttaacaatgatagacatatgatgcgaaagttactctttgttggggataattaggggagaatacacttgcctcctttttctgccaacccacacttccaaagcctcacaaaatatggttatttaggttcctagagagaaaggagtggtggtagaatcctgacaaaagttactgagttttagcgggctaaactgagttttagttggctaagcgagcttcatttggccccggtttccttccctgaccagaagtggggcaaataaactagattcaattaaaaagaaaaaatgtcttctatttttgtacagttgagttgatgaccatgtgaatttatgccagtcctacctgaagtgcaagtgttagtaacaaccgctaaccttaggtttggggcagaggccagaaattaccatatctagagcttcacagctaccttaaatttatcatcctgataaatgtctctccttttttaataccttgtagtaaattggatattatgtttattatatacctatgttcttttataagtgatcacgaggcattttagaattccttctctagagcaaaacattttaaaactgtgtttgctggatatagtattttgttcccatgtaagtaattattgaattattgttttcatattggcttgccattatagatacaccaataagttatcttgaacatgaattattaaatgttttatcttctcctacacttccccttttgaaatgatttgatgatttgtaggaatgaaatgtattgttacttgtgggaagtaattgatctgttgaagtgatggcattgaggttgtccatcattgtcctatggaggtaatttttatgtccatgacatctagtttcacatcagaaatggcgttgcttaaagacatcctttacattttgacaattgtctttactaataaaggtgaaaagtcatccttcaataacaattacttaaatttaaaagaagggaattaacttcacttcagacacaatttatgtctccctaaaacaaatttctgtgatgtgaccaatgttgatagggttacgaccaccatcctctgaagctaacattcatttcattctaaggtaaagataaatacaagtatttatttatagctcacatatttaaattttgattaaaacatcttgacatcaagaaaatgccaacatattgtaattatctaaaaatgagagaaagtaacatacagatatgcaatgggtttctctttcagttcatggaaattttatgatgagaaaagtgaatttctaaaattaagcatgtataaggacttttcttaggtgtaaaaattattttatttgttagtttgtggttaacttattaagttagtttaattgttttgctttgttttccaacctacatgagtaggttactatttgtagtattgccatgggaaataacattttggcacatttgaaaactgttttaggtcacagaaagcagtaatggagagtagtaaaattatcagttactctaataaccactagaggtctactgatatcaaatttctgtcaatatatttcctttctacaaatattttaaattaattatttcatatgaatgaaagtgaattttctcttctttgttttatgtattttttattctgtagactttaattccacttaaaattaggatctttggtaggttttagtttgttttgttgtccttgcatgttgtgtttaaatactatattatgacttatatttaaagttaatcgttaggtgctttgtgggaattaagtactttaaatatgtatacatatatatacatgcatatgtgtggatatatacacatttttatatgtgtgtgtgattgtgtgtgtgtatatatgtgtatatatctatatatatgtagatatatgaaagcattagtaaaagagaaatatttgtcttgatttttaattcagtagacaatatgagttccatttgatttgttttgtattgttttgttttgttttttgagacagtctcactctgtcacccaggctggagtgcagtagcatgatcacagctcactgcagcctcaaccactggggttcagatgatccttccacctcagcctcccaggtagctgggcccacaggggtgtgccatcatgcccagctatttgttttgtattttttgtagagaccgggtttcaccatgttgcccaggctagtctcaaactcctggactcaagtgatccacccacctcagccttcgaaagtgctgggattataggtgtgaaccactgtgcctagccccatttctttctaaggcaagaatttcctgcctggtgttagatattttcatgctaacttgtgaatgcacccctgggaatttgtagatgtgtgtgcagatcaaatataagcagagagttcatcatttaaagactcatgtttatcagtcatgttgctaaaaagagacattttctactttattataaatgttactagcaacgattttgtagaaaatttgtgtctaagaattctggaagtattaagggttactttgctattcaatatgatttaccattttgcattcttttacataaaagaaggtagtaactcgaatctgtgtgaaggaattaaggagcccatctttgaactcggacgcataggaggagctcagtacaaattgttcaagtgacttctgttcctggagtgggactcaggtgacatttgaatcactaagaaacaccctccagtctgagggtctcctgcaactgcagtactttgaacagtcccagctttcaaagcttagtaggaatatcattttcatcgttctttcaagtctaagggtaacttttgctcagtccagttaatgggcagtattttttgtcacattgttagataatcatttacactattcaggatgacctttggagtaagtagaataggccactgccaatgtgagggatttggtggatgtcagaaatggttcctcctggccgctccgtatgggtataataaagtgaaaaagtttgtgcgcactacaaagctgctaaccatggagaaagtagaggcccattctaggtcatgttctgctttgccaagccaactttgctagtgggaagctgcatttgcgtaggggagagggaaccttttcataattcatctgaccagaggaagcacctttcgtaaataggcagcccttctgtaatttactcacagatatactctatgctattgactgtcctctattaaagtgtctctcattcacctatgatagtatttaaatttttaccatcataacttggggatctgaaacttcttatattttctttcttataaaaaatttatactccccccacaaaaaaataaagccttagcaattataaatgaacacctaaaatgaaatgaccaattagtaactgggaaggctctgcaggaacttagaggttgttttctgcttttatggaaatatatatatatttcacatacaactcatatacaaaaattcaaatgcactcaaagaaagtactagaatatatgaatgtactcgtcttccagctgtaacagttatccatgtgaaaacttttcaaattggaggaagaggaacataagagaatgtgttttgacttttcataattttgtctcaccttgaccgtgtctctaatgtcatgacttgcagtaagatttacatggagtgtagcctcttccccacttttgttcaactgtgataaacatgacataggttgaacattcctaatccaaaaatatgaaacccaaaatgctcaaaagtctgaaatttttgaatgccaacatgatgccacaagtggaaaattccaaacctgacctcatgtgacaaatcacagtcaaaatgcatgcacccaacacaatttcttcagtattctcagagggaaaaaagacccttggctctattcagtggcaatatatattttctgcacactcctagattctctcacacacacccacaaaggttaataaaattgttcaatgtacataaaattgaatgcaaaaaatgatttagaatgttgggtaaagttaacttcaggctctgtatacaaggtgtatatgaaacataagtgaatttcatgtttggactttggttccatccccaagatgattcactatatatttgcaaatattccaaaatctgaagaaaaacctgaaagttgaaacaattgttgtcccaagcatttcaaataagggatactcaacctgtataatgtacgaagaattttttcactcttggaagcacttcaaaaatttcataaatatgattgaggagacaattgttaatatactgagttttaaaataatccatccatttcttaattattaagtacttactatgagccagacatttgtttattaccagggctattgcaataagcaagtcagacaaaagatactttgttaactgaagtcttaatgacttaatgagtaagccaattacataatataagctaaaacattaaaccctacatatgagaggaagtatagaaaagtaaaaccattttgtattggaacaataacagaaatactactttattctcttaagaaccatttttattaaaattgtttgataaccagaagagaaaagtccaaaaaagtatctatctgtttattacactgtgccctaatattcccttaattcttggtactcgtgaaatatcatcttccttgggctatgaaacttattcctcttccccattataaaacacatttttattattctttatgcttgcattagtttcatgatttgtgatatattgcttataaatttagataagcataaaaaatagatactataaaaactgacaattcaaagtgttatcagttaagtaaaacaatataaaaacttgcaaatttcttagtgtatgtattttttgtttgtgtttattacacaaggttatatataataccacaacaatatgaagagtgttatctctaaaatacattaaatatgatttttcttttctttagactttttgtatttttcaaaaattctataatgagcttatatcattgttaatttaagttttaatgaaataatgcatataaataatttacaatctcagatattaatatgtaatattaaaaaatatgaatattgaaaaatccaattatttgagatttacaatgttaaatattaccaaaatattccaaaaatatgaatatttaaaaaatacaattctttgactattctccttttttcttattctacaaaagtaattacttcaaatattttagctgtttcctcttattttctaatgtatttataagtaacttcttgtttttgctatttcttgattttttccttagttagacattatatattggctttttatagcattcacccattctttctcccctatcctcccaatttagtcataccacattttttggttagacattatttaattgtacattgctttggctatgtaagtgttgtccatagatgactatgccttctttcctataaaagtttttctattgtttttttcttttctggaagaaacaaatgcctagttttttatttgattgcattactatatccctattattttgtagcttcactacttaatatatacaaggctatttacatttactgttcccttttgtcacaagtgtgttttaaaagtattcagccctcttcatccatgggttccacattccatggattcaaccaactgcagcatggaaaatatttattaagaaagaaatggttgtctctgtactgaacatgtacagactcattttctgtgtcattattccctaaacaatataatataacaagtattcacaaagcatttgcattgtattaggcagtttaagtaagctagagaatgatttaaagtatactggagtatgtgcataggttatatgcaaatactacatcattttttataagagattgaacatctatggattttgggatatccatgggagtaccagttcccccacagagaccaaaggacgactatcacctctctattttatctaatttgcctaatttattggcttaaagtgttcagaataacactttattgtcctgtgaatttctgtagagcgtgtagtcatatcacctttcattcctgatattggtaattgatgtatttttctttttattattttcctgattggttatttcaaggggttatcaattttattaatattatcacaaatgagcatctagctatattgtgctttctctgtattttgtatgttttgtatttaattgatgtcacacttattaacttaggatttacttcattctgttagtttgcatttaatttgttttgtccctggctatttagttttaaactcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttataataaagtgttgagtatctcatgtagtttattgaataatctactgaaagttaaaaacagaatggtcgtatagatactcaaagtatggtttctgctgaatctgcatcactttcatacctctgcaaagtcaaaacattataaactgaaccatcgttaagtcagggatcatctgtgtgtgtgtgtgtgtgtgtgtgtgtgtgtgtctgtctgtctgtctgtctatttgtgtatatcttcagcctgacaatctctgccttttaacgggagtattttaaactctatttttttagtggttgtctgggaatttcaatatgtatctatattatagcaagttttgaattcatacttcaccatattattttactttttgtttactaaaagagctttgttcactattttgttttaaattaacacaatctttgtacgtatttagtgggtacaatataaattttgatacatgtatacattgtgtaatgatcaaatcatgttttttggtatatccaccacctaaaacatctatcatttctttgtggtgagaacactcagaatcttctcttttagttaccttgaaatatacactattgtttactattgtcacccctgctatgctatagaacaccagaacttatttctcctaactgtaactttgtacccattgaccacaccattttattttaatgtaagaattttaaaattatatatttccaattgtttcctttgttctttgtgttattgattttatatattacacttgttcataaattataagattcatgtttatattgttatttttgcttataatagccttttacaaagagtaagaagcataaagaatctttatatatacctatgtatttattatttctttcaactttcttttaagctatgtttctttctgaaataatttttctttatactgaaaaatttaccttatcatgtcttatagtgcagcttctactagtgacagattctctcagccattgtttatgggctgtgtctttattttacactcacttttaaaggaggatgttttcactgactgtataactctacactgtgaacatgttttccgagtactttaaagattgtgttcctttatgttctggcttaagttgtttatgtgcagtcagacatcattcttatggttgttcctctctatattatgtggaaataaatgaaaatcaacaaatgagaagaggcaaagtctatttattcagggcttggtataacaagggagtcagccaccatcacgttttcatttgtcagagactgaaaggcaagtagagatgtggtgaaactttatagtgtaaaaaaggcaaggcgggccgggcgcggtggctcacgcctgtaatcccagcactttgggaggccgaggcgggcggatcacgaggtcaggatatcgagaccatggtgaaaccccgtctctactaaaaatacaaaaaattagctgggcgcagtggcaggcacctgtagtcccagctactggggaggctgaggcaggagaatggcgtgaacccggaaggcggagctttcagtgagccgggattgcgccaatgcactccagcctgggcgactgagcgagactccgtctcaaaaacaaaacaaaacaaaacaaggcaaggctacaggtatgctctaattgaagactgttggcatagcgaagctggaggtgggctacctagaactggggtatcttatatgattagtgagggatgcataggactttctctggttggtcctaagttggaggcaggactaaaattaggagatctgtctgttattaatcaagtcttagccatttgggaccaattatttcagatgtttttgtttgattttgtgaaatggttgctagagatagtggtctgacttcatacaagtctgacatggaaagtaagctggcttcctgagcgggttactgtggataatgggttggttttctggactggttgctgcgattgtgggtttgtgtatttagtctctcagtcatgttcattttgtctctcttcttttaaaattttattttctctttggttttcatcagtttgcctatgatatgcctaaatgcattaaaaaaaattctgcttagtgtttgttgagcttcttagatctatgggttgatatttttcatcagttttgttaatttttcagttttctttctagaaattatccgtcttattttctctcttctcctcttttgagattctaattacataattgtatgtgtatttttgaagtttatgccacaggtcactgaccatctgttttccacttgattttacaatcttttttctcatgttttagtttagataattccttttcacttgattttaaatccacttattcattctttacccatgtccaatcttttgtaaaagggatccaatgaattttaatttcagacacttttttctacaactccataatttccatttggtgttttcttagagtttctaattttccaactaaatatcccattatttaatccactatatccatattttgttgtcaattgtttcacacatcaataatggttattttaaagcccagacatgttaatttcaataactgagttatacatgggtcttattctttttattttgctttacctttattatggataattttttccttcatgtatcttttagagttttattgtattctgagtattgctataaaagaatgattaaataataatattttattgtttttgtttatttcccagataataaatcccttttctttcaccatagttttaataatattgagttcatctttgagttgccaaacctctaatctcccagacatagcttttcaaatctagtcagtacttgaactgagaggatgttgtattgcaattccagatatggttattcactatttagtttaaattggaaaagcttttggaatacaattactgtgaggatgctcagaaataagcaattctctgccaggcgcggtggcttatgcctgtaatcccagcactttgggaggccgaggtgggtggacatgaggtcagcagatcgagaacatcctggccaagatggtgaaaccctgtctctactaaacatacgaaaattagctgggcgtggtggcacgagcctgtaatcccagccactcaggaggctgaagcaggagaattgctagaaccagggagttggaggttgcagtgagccaagctcgcgccactgcactccagcctggcgacggagtgagactctgtctcaaaaaaataaaaaattaaaaaattaaaaaattttaaaaaaagaaataagcaattctcttagcattgttcctccttcactgctgctgttttcatgttacaatttagggaggaagaattagttgacacactaagatatttgtctttatatttggggctattttccattttttaaccattttgccacagtgaactgtcacctagtcttggctgatttccccagccctgcaaagcctctccctctgtagcaggtctgcttctccattattcatgcacattaatgcccacttcatgtatggaagcctaagagggtctttgctcacctcctaattttcctcccacctcactggcttttctttctcattttctttcttaattttttctcatttctcccatctctttactttgcagtgccttgtggcttcatctttggatggtttttgttgttttatatacaatcactctcttgatgatattgtctagacacatctttaactactgcctatgcactgatgactcatgtttatatctccaaaccagacccaccccccaaaccaggcttatatacccaacaggatatttgacagtaccattcaggcacaaaattaaaaaaaataaacacatcccaaactgagcttatctctttcactaaataaataaataaaataaaacctactccacctgcagtcctttccttctcaaaggcaactccatcctcccagatgctccgaccaaaagacttggatttataactcccatttttcttgaatacatatcattctgtgcatcagaagactcttatgtttgttccttctgccttcataatgtacctaaaatctgaacacttttctccactttcgagtctctaccctagtccaaaccatctcatcatttgcctggtttattaaagtagcctcatacctgatctccttgcttctactcttgtattttttcctatcctacagtagattctaagcccgatgattcttttaagactggagtcagatcacatggctttttttactcaaagccctttcagggtttctcatctcttagtgtaaaatttaaagtcctgtaaatggcatagctacaacagcctccctgctgctcctcaaacatgccaggaatacactgacttcagagttctttttgatcattggtacttttgcctaaaattcttttatctactacatttcttgccccattgcctttttcaagagtttgctcaaatataatattccaagtgaaatcttctatgattgctttctttaaatcgcaaatcctgtacaccacctccattttatgttctctataacacatcttttcttctatctatataacttactttagtattttgtttattttcttttttcacccattggaatataagtaggatgaaaaaatatattttctattttctgtatgctttatccatagaataatgcctgacgtataaaggtatttttaaatgtgttaatacattagtggctgattctttattagtcagctattgagttgtattaccaacgagtctaaagatgaagagccttctttgttttatagtaattcctgacttctttctgattattcttttacattaattatatatagagttttggaattattgttacagatagaatagaaaaagccaacacaattttcttgaacaaaggttaaatgttatcttaggaaaggaacatacacttatacttcagtgttgttttttttttttttagaagaaaagctttggaaataagaaacttttcaaatataataaattaaaatattttgtttcatagacagttttggaatactttagtactgatttgacatgcaagctttctactagccactacatgctgctttgaaaggttggggtgtacagtgtaaacatatttgaacattcaagttctatgtaaatagttcaatattgtttgtaacagatctccagaatattttctcttcatagcaaatttaaggctatattgtagtaatattttaagcagctgtgaagactcttaaataattggacacagaaaaattaagagtagctgctcacaatttaagaatggacataagaaactttctattttaatgtaataaaatgatagcatctcttgagagttgtttgataattctcaagtgaatgaatcatctgtaataaagaatgactgttttaccatataactttgcagaaaagaaaatgatatttcaagtttgccttctaaattaaattatttatacctattattttttaaaacttacacagaaattacattgaatcactgcatataaattcccaaaacaaatttaaatttttatttttgttgttagaatatatacttcaaatcaatcctgtgaacctgcttataatttttgagattaacaatccccaagtcaaattcgtaagggttatattttgaaaagctatacagatatttaaaacctctcaaagtataataactatatgccatttattggcaaagatttgaaatttcgacttcctttttataatagacaaaaatctcctctaatattcagccgaagtcctcaactaaaccaaagaaacaggtgttttgaaaattcttagaaatcaattacttagcatttaatctcttatcaaaagtttttatgtacctgtaatgagactatgtagttaatagattattcaaagttttaaaagttattatactatgtactagtgagtagacatagatttgcatgatttataataaaaaaataaaatgaagcttcactacaatttctgtgcattttgtaatgtaatgacagagaaatccatttaaaaatgttttgtgtggggtggggctcatttgcatgccagaatccttactagtagcacaattgatttaaaacattctgcattttagccttaaaaaatgaagcattgctttacatgaaattattgggtagttacttttacaatacttcatctttctctcttttagtctctaaattgtagaatgcactgtgacatcattttaacttcaataggcaggtagggaggatgcatttaaccgaaagggtaatggaaaccagtttatgtgagggttaataagctcttactggttcttagtttctttaacattttaacctccagagaaaattaataaatattaagtgtcaaaggggctacacaatcaaatgaatttatgagatgattggggatccttgagagaataaactaaattatatgtgtgtattctctttcaagcatttgctatctcttctaggctggatttctatgctagtttctaaacaagactaagctcctttctctgctaaaggacgtagtgatatcattatctaaccctttttattcaagttgactgcctgtttttattgaattgctttaataaatccaaaacatttctatagattgtttctatagattatgcaagtaactattgtatatttttcttttttggcataaaaacaagacacatatgatgtgtgtgtgtgtgtgtgtgtgtgttgtgtgttaaaaaataccatagggaataaaactcatggtttttgaaatttttatgcattacagtaattatagtaagctcctttagatagaaaatatagaacatacttgtaagatttgcaagacttaagtcaactgtatcaattttggggatactaatcatacataaagacaaaccacagaactttgtgtaatgattgacttacattgctataatacaactgaattatgtgtcatagagagtactactattaactactgcatatttatttatcattttagaatttcaaagggtagttttcataataataataatctatgagcataaattggtatttcataacttggaatgcatgctaatctatcaggataaactgtaccatagtatatgatccttaaagaacagttcccctttttaatgattagatgtagattctgcaatttctctgatactatttcagacgaacttctgaatggagggtacagggcccaaggtttttataatgttgtagtaaatgtggaggaggaaaaggacatgtgctctgaggctgcatacaatctcagacaatacaacgagtacaactgcagtattatttgcatagggtattgatggcaatcctttgttgtagctttcatttttctttattccttgacctgcttcattaaatttcagcaaataagaaaacttggctaaggatagattgtttagtcctgtggtccctgcttcactttccttggactcattctatctttcaataatgctcaccttgcaccaataaacgagtcagaatgctttgtgtttcataagtgacaatatgccaattgtattctgtaggttatatttgatttcatatgatggtctttgtagtctcataattgttaattatttctaaacacaagaaccactcaattataccagtcagtgtgtggcaaggaaaaataaatgtcagcttccaacttcataaatagagttaattgttttctctagagtggtgtaatcataataaaagcacttttgtagaactcctaggatgtgttcttttaagcaatataatatcaccttgagagaaaataatctatctttaatgtaatattcagtgatatactactgatatagtttatatatttattaattattatcatataacaaagcaacacataatatctggaaacaataatgtttgtttatatttttgtttcacatcatgatttataaagagaatgtacagacattattttatttggtcctaacaaaaattctttaagatcaacagagggttggttatgttcacttaacagataggaaagctcagatttgaagtgctgacttgtgtccaataacacattttaagtgcaagagcgaaaacctcacgtacttcattttaatactgaatatttattcttctacattgcaatttctgttgtcagagattgtaaaatttttattaaataattttgattaattatagtccctaaaacatatattttaggggtaagatggagtgcaaatggaaggggaaaataagataattagtggatattaagtaatgggatgataaggactgaaaattccacttaatttattttggaaaagcaaaatatttgcccaacacatattcctataagggagtacttgtgttgagacctttggctcagtggttctacattgctgctgctgatttcagggctgctgtccatttggctttatttcccatagtctgatcactcctgttggatcaagtcaagagatagctgtggtttctcttctccatttacttcatttgggttcagtttttcatctttcatccatacctcacccagcaatgagtgattgaggaatgagtgagatgtaaaaaatatcaaaggtaaatcactcttctctaccttttcagaagcaagggttcaatgctaatagaaaagacaatatagcatccataagtaaattctcccgtaattctatgatataaagttgattgaatgattaatggcattatatttgacaaatttgaaaatgtccaaccagttctgtatattagcaacgtttttggtttgggattttcatttacttcaaatattcaagacattttattctggatatagatagtttcttatatgaatatgcactatggctttctatctgctagtataaaagtccaagtggctttcttctatgacaatagctatagacatattttccatctacctgcctatttttattttgatatacaaaaaagttggacatttgagtaaaattgaatatgttattctatttttaaaagtcatataaccccttctttaacacattctgcattcaaaccagattaaatttatttcttagaaattttgaaaatttcaaatggggaatggaatggaaatggcaggcattattgctgctgcatgttatacacttatgaagaaagggtcatactgtacttctttagctaatttataaattccagaagaggttcggcaacttcccctccttgtcccttaggtgaagctcagatatttgagatctaattattcagtactaaatgagatctagcattattcagtgttacatttctggttatctgaagtatataactaatatctcttattatgtctcttctaccaaatttttacagccccttttcttcttttgttcctttgagtctttctgttaattattaacagcacaaactttgatatttggcatcttttaaaaaaaaactttttttttaaagttcagtggtacacttgcagaatgtgcaggtttgttacgtcggtgaacagaataccaaatacggcatgttctcattgggcatttcttattttgagtcttcaattgcttcctttgaccatttcccttagcttgccaagtcttatctttacctcacttttatctgtgctcctgctatatattttttcctatcttggtaggcttaacgtctctctcagtatatgtcattctgaataatacacagttatttcctttggtaattgaagaaagaggtagttcctgataacatgactagaggagtgtagcaactatgataaatattgttaactgcctactgactgttcaatcattctggatattaaaagaaatacaatagatatttaagacgtgatccctttatctcaattagtttataatattatgaataaaaatattgcccaatataaaaataaacagtaaatattataataaactgactatattttattgtctttcatttattcgtggttcttaggagttattactccaccatttaggagttattactccaccagtgtggaattaatgaaaacaacaaggtcgtccttcctgagccaactttataatcaacacagtagtgtcattcaagctatgttgtatatgtgccttgaaagaatgtgtttagcttgactattggttgaccttttaggtaatattttaaagccctggccaccatcccataagctcattttgtgtacatgatatttttctgaagggctctgaaactgtctcaacttataatcacagtaatgagtattataatagattaacagattaacagtgatcttctttccccatataattaggtctacaggatttgcatattgtcaataacacctcattatatttttcttacccactgtatgtggaagagtatcattaagaataatgtattccttcaacactaattcagcaaatatctttcatatatctatgatgaactgataactaagccaaatacatgtatataaacctagattttaactatgttctctcttacatttttatatcttataacatttaagtgagtgctacatgataatataaggctgtttttgttttatataaaccttggggtttctttttctataaaactcacactcttagggcgtgtcagcgtcagacatttctctaagtaattttgaagttctatcttctgaagaaaaaatgctgaatgtctgagaaatacctttgtgacttgcactacatcaagcagcaaggcaggaatgatgtctttgtgcatttacatagcacttttatttttaagaggtcagggaatttcatatggatgatctttttcacccagattttccttctgcagtagttgccaaaacatagaggaatgaaatttattgcctcaggttatgtagtccttcttaggcaccacatgtgaactttctctaagtcctggttttctttacagtgttgtctcacagatttgtccatttcctcctaaaatgaatgaattaattcaaacaacaagtattgagcatccactgttactagacactgttctaggtagttgggagaaatcaatgaacaaaacaggataaaaaacaaaacaagatcaagcaaagcaaccctttctttgtcctcctgaaacttatatttcaataatgggaagaagggtgtggggaagacagaaaataaacaccacccattaataacatacagtattttaataagaaataaatgcaatggaaaaataaagtaattatgaggaagttaggccatgtggttgggatatgtaaataagttaagccagttgattcagaaatgatttaagttcccaaccatataaagcaatatcattaaaaactagttcaaaattgaaagagtaaacacaatcctgtgtttacatattcaaatggagaataattaaatttattaattcaatcagtagacattcattaatgaccacttggtagaaagtgctgttccagggactgtgagtatgggggtggatatagtgtagattcactctcaagctgttcagagactgggggacaggatattataattacttattgctaattaaaaataaccatccaaaagcatagccctttaaaacaataaccactttagtatctcttgtgattctgtgagttgacacagcttagctggtgatgcttctgcttctcccagtgttggtgggagctgtagtcctccgaggacttgacttgcccggactgtcagaggtggctcactcaatgaccgatgctctggtgggggaaggctggaaggctcatctcggtaatgaatttgggatactagaccatttgggtctgtttctctccgggtgtcagagcctcttcctcttcatgcgacctctccctacatggtctctgcacatggtttctccagcagatagtgagacatttacttggtggctcagtggtacaaaaagtgctaaagaacttgacagaccttcccaagagttagttccagaacttacacagggtcatttcctctatattctactggttaaagggagtcccagaccagaccactccagattcagggaggttatttcacaaggagaaagttatgggtttcacagattatttgaagccatttttggaagctagtgatcccaagcgacagtgtttacaatatacacaaggtactgtggaaaccctgaagaagataatctatcactctgggtgcattcaggtgaggcttccaagagcaaaaggatgctgagctagacattaagaaaaaaaatcagaattaaccagtcagtgaggaacaggatatgccaggaagagaaacagcatgagacatatacaggacatggcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggctttctaggtcaacagaaagacatacagaaggcagaggctgtggaaaaggatttgagaaaaaactagaaattgtaagttaaatacacaacttgttttagtttccttttttcctaacatggtagatccatttaataattcattcattattgcaatatgtatattcatattttttaaggtctctcacagtgcaggcactgggttaaaaactgtggatacagtttctagttgtgagatacagctttacattcatgaagttcacagatttgttatgaagattgcaatattaatgataattacgatggaatatgacaggtgcttgctagacgtaggcacataggagtctcattacacccagatggtaaatgtctgtgagggtttttccagtaaagtttactcaagacatgaaagccagcaggagaaaattttagaaagataaaggcctcacctagcaggacaaagcaggggcaaaaacaaagagttagaaataaggaggccgggcgcagtggctcatgcctgtaatcccagcattttgggaggccaaggcgggcagatcacgaggtcaggagatcgagaccatcctagctaacatggtgaaaccccgtctctactaaaaataacaaaaaattagccgggcgtggtggcgggtgcctgtagtcccagctactcgggaggctgaggcaggagaatggcgtgaacctgggaggcggagcttgcagtgagccgagatcgtgccattgcactccagcctgggtgacagagtgagattttgtctcaaaaaaaagaaataaggaacaacaggccagcagaggaagagcacaatatagacctggagatgtgagcaggcctgttaaagtgaggagctggatatagcatagcatcattatggccagaacttagtatacaatgaagagaatgggagaaatgacatttatgagaaaaaataactggaaaattatcaacagctgaaatcaataagcaaaaaagtcatttacaattcctgaaatcatgctctgcattttttaaatccatgaagtgcagaataatcatagaagcttaaagataaagtaggcaaatgtgttagtaacttacactgtgtaataattaatattaatttttatgagcagtattttatattaacttgctatttccatagcaatgtgcaactagagctgagatgtataaggcatgattcttaccctcaaaatctttcaagtgcaacttccttcaggaaatattccttgaccatccagtgcatgtaatcatattctaatttgtatttaacaaattgcctagcaagtaatattgtcaatagatactgttacttattactattattattaataaagatagatcacagatctttcagggcaacagcagatgccactgataggccatttacccacactcctgaaattcagttctactctcattctagaaaacagatttgattgagatgttgaccaggtcaggacaatggcacgtatacaaggcaaagaacattttagttttacctgggcttaaccttaggagcccaatgtaaacagaaaccgcatagtttttcaatatagcagtattctttatctgagcaccaggtgaataaatcatgtgccaaattatgtgtgctcgtgagtgtacatatgcacatgtgtgaattttggaggaagagaggatatatgtaaatataagtacatggtggtggggaggggtagatttctttagattctcaagaactccaaacagtgtaaaatccctgccttaaggtgatgcttaactgaaattcctgctttaaggtgatgattaatattagaattgccctgtttctaagcctttaagagggacatgtcagggttcattaagcactccaggacttcctcctatgcctgaagctagagaagaaacaaatcttcctaagtcaagggttgtattgcattctactaaagccttgttcaatgttacttttcagtaaccaactatcatctttaagtatttctcagcatttcagttaaaactaaactaacagaaagtgatgttggcaagatggcaaaccaagaggcccgaggccctaattccccccttgaagacactgagttaacaatatatggaccagaatccctttttaagaactctgttgaccagttaagaagtagcggcacccagaccaatgcaaaaccaaaaaaaagatcctagtaaagttcagagaattttgcatgcccatgtccttttcttgagtcagtgtagcatagtgcacactggaggaaacattccatacaagggctcttcttttacaatagcaacaagagagtggattgtgagtcagatattctggtttgtctaggggcttcctgaagtattggtttctatatcatagcactgatgggaacagtagcagagtttggaaaccactgaaaaaagaggcaagcggtttggcatggtgggtcctcagagctgcagagattctgtagttctacaggcagatgctagaaggagcaggagattatgagctcctgagaaaaaaatgggcaggctgcttagggaatttgagagaagtaaagacatacacgagcccagaggagaaacatcctcagaaacgttttgagagtctcccaaacatatagctaggctcattgatgaaggccgttctctgcacaaatccagtgcataatggcttgggcaggtgaatgtgttctcaaatgcccaaatctcaaatatcaagaaatatcacaaggcatgcagagaaacaaagaaatgtggcttgatgaaatgtacaaaacaaaaccttggatatagaacctaaagaaaggcaaatcactgaactttctgacaaataattaaaaacaactattttaaatatggtcagtaagctcaaaaaagaacatagagagatgactaaacaaaatccagaaaacaatgtatgaacaaattgagagtatcagtgaaaaggtagaaactataggaaagaatcatatagaaattctggagctgaaaaatataataactgaattgctgaattgaaaaattatttagagagacttaatagcaaacttgatcaggcagatgaaaaaatcagtgaactttaagacaggacatttgaaatcattgagatagcggagaaaaaaaaaggaatgaagaaaagtaaacaaaacttaagggacttatggggtaccatcaatcagaccaatatacaaattatggaaattcaaggagtaaagagagacagagagagagataaaggggcagagtttatttgaagaaataatgacaaaaaacttcccaaatttgaggaaagaaacggatatacatgttcaagaaactcaaccaactgcaaccaggacgaatccatagagactccaccaggacccattacaatcaaactgttgaaagtcaaagagagttgtgaaagcagcaagggaaaaaagactcatcatgtacattatagcctctataagattatcagataatttctcagcaaaaaccttataggccaaaggaagtgtgataatattattcaaagtgtttagagaaaaaaatgctgtcaaccaagaatactacagccaacaaaataattcaaaaatggagaggaatttaagattttatcagacaaatctgaggaagttcattctactagatctactgtacaagaaatgctataagtgagtccttcaaagaatgctagatgaaaatacaaacttcagtaaagaaaaatacatggccacatataggaactagtattattataattttggtgcacaaatttacttttaattcttatataaaatttaaatgacaaaaacataaaaacaaatataaatatatgttaatggatataaaatacataaagatgtactttgggacatcaataacataaaagtagggacaataaggagtagagtaagttgttagtagtttaaaataaaatgttataatttgtttaatatgttatatataaaatatatataatatggaaatatgcaatatagaatatattaatatataacattatatagaatgttatgttacaactttaatgttttgtctaattgcaacagtaacaatgtatatgaaaggaaatgaaaagaaagtcaaagcatgccattaccaaaagtcaacaaaagacaaagaaaagcagtaagagaggaaaggagaagtaatagagctacaagacacacagaaaacaattaacaaaatggcaatagtatctccttccctaaatcagtaatgactttaaatgtaaatggattaaactccctgatcaaaagatataatttgctgaatggatttaaaaaatcaagatcaaactatatgctgtctactagactaacattagatgttaaggatacacataggctgagagtcacaaagattaaaaacatattctatgcaagtgataactaaaaaagagcagaggtgctatactaacattaaaaaaggagactttaaaataaaaatggttagaagagacaaataataatatcacataattataaaagggccaatttgccaagaaaatatataatattttataaatattcgtgcacccaatatcagagttcccaatagatgaagcaaacattggcagaattgaaggaaggaacatacagcagcacaataatagtaggagacttcaataccccacttttaataatggatagaacaacaaccaaacaaaagatgaataaggaaatagaggactagagcaattctataagctaattggacctaacatacatataaagaacactccagtcattcttctcaagtgcacatggaacattcttcagaatagacctcatgttagggtacaaaacaagtcttaacatatttaaaatgattgaaattataccaactatctagcatttaaaaataattatgtgagaatttgcttgcatcacttacaagtatgtgaatttccagtattcatctttaacattcactttcatcttactcataaacatgagtaaataaaaaaatgaaaccatatccatgttgaagtatacttgattgtcagttgcagtcatcttgattgtcactgcctacaaatataatagtttggtaaaaatcaatgtgagtattctgaaagaatcaattggatatattaaatttataatagagtattgaatattttataattcaaaaactgtgttaaaaatcttttatatcagtataattataatattgctcccccttttttggaaactggttattaaacatttatcagcatagaactgatattaccatttatctgtttcctatatgttcctaacattattttcttaagtatgtttcttaagtctggacattatgtatgaaaaatagtagagtgataatagagagggtcttaggaatgttatctggctcagagacaattttccatcttccagcagataagggggcacagatcatttgaattaaattaagtattgaactggcttgatgctgggttttagttcttataataagcttttttctccatatgtttccttccactcatagggtctaacctactggttgtcccagctgagatccaggactcctcataaaagctcttcctccctaatggtccttggctttttagtttagaactgagagtacagcaaacactactgtatttttttttcaacagttttctgtttgtctcatttgtcttttgctcttggcaatttaagagtatgcaaagccttaaaggcaaatccatagaatggtggtcttacttctctgctactaccttctctctgtaatcttgactacttacatcattgctaccatcttcaatctgaaatccattttttcttcagtattttaagagttccaaaagttctctacctattagcaatgtatgttcatattcttcgtctctcttttcacaccaaaattggtgttttccctgagggaaaaagctgcttacagaatgttggttcacatttctctgatgtccttccctcagggatcttgggctctcaagtcctagttctctcttagctgtctgatgcctttaaatatattttaatcatctatatttcaaaattagcttttctggttattctcattgggaacattggactgctccaatctattccattatgactgtatctacatgcttgttatatgatttcataagcctacctccctgtaccaggaaaaagttctctcctagattctctcgtagcattctgtgtataattttataaaaataattagcactttgaatcataaagtcctatgtttttgtccatctgtactataatactagaccatgagcttctagaaattaaatactatcttatttttctgtctattcctaatacattgcacatgattgctgctgaataaatgattgtttaataaataatttaaaagtgtgggaatagatttgtagatttctggaccaaacagccaattatttacctgacagatactccaaagtttgttttcctctatgtttgtgtttaacacattttccttaacttctttcagtacttgtacagctttttaaaaaagagttaaatgtttaagccatctggaatttattttgctgtacaaataaagtgagttataattatccttctttagttgttttttatcttagaaaaaaaaagacaatggtgtcaaagtaagggcaatttacttttacttttatagatcaaccatgtattactccacttgctagaataacatgctttttaactaaaggaatatttttgagcattgtaaacctataatggattagttattagacaaatttctatttctgtcctgatactttagtatccttagatagtatttattcactttgttttattagatattaaattatatagatgatgtgagtaaatgctagttaatatgcagataagaacctttttacatatttaatcctcattagatttttactactccctctgtgaagccttcccatattccttaggagagagttggccactctttttcctagttgcatggtgctttctttgtggctcttttatggcccttatcaatttgcattaaatgtatctttttaaaattaaaattttatccctatttctactgcctttcttattccaaaatttgaatttattttcctctgaagcactaatacttaaaatacattcatttcccctgccggaaaacacacacacacactctctcacacactagcagggagaaacttccttatagtagacatttctttctgtttggttcactatcatacccccagcacctagagcagtgtctggcacatagactatgctgagtgactgtatgcttcctgcattaaattgtgaactcactgaagacaggcacagtggtctaagcctttgtatcccagcacctactacaatatctaataaagcagatgctaaatcaattttctaataagtgataactcattctcttataaaactaaaggagatgttattgttattcacagtcaaagataatcctacttatgttgtttacttattgtttagcaaataattcttaaactataaaaagtataaaagaacaagaaatatttaaaatttagttcattgattacttgaatacatatttatttattgaattttataaaccaataataattatgtagacagatttacatttttcttctgacacatttagaattctaaagtattgtctattcactttgctttattaaatattacagtcatatagattttattaaaaatatttattttcatttattaagtatatacctgatagcagactttgtattaagaacaggggagacaaagctgaataatatttagtccctgtcttcaaggtcctaaatgacacctaacatttacatagtattttcaatatgtcaggcattattatgagaaatttatacatatttactccttgaattctcataaagatactcttattatgtccattctgatggtgagaaaactgaagcagagagagattagtaatgcagtttgtcattagagtctgtgttcagtgtctagccaaagtctagaggctgtatccaagcctttccatgaaaggcggctttttagaaaaaaattgttctcaactccgcatttgttccccttactatgtaggctccaatatttcagtctttttactcagaactgccttggggtttatatttaaaacttgttttgtgaaaagtgctgtttttcctactctcattttccctatttcccataagacaaacatattgttttaatttaccagatctgctgaatattatgttgaaaaattagggctcataaaaataatacatgaggaaaaatttaaaaactatagaatttcttgcagtagtgatttctggcattcatataaccttagttgtttataactcacttttaacatccaaatctaagttgtggcacactcaccataactacttaaataattttttctacaaacaatattgtcttcttggggaagctagacaatatataatatgatcgatgtccaggtagtcagtcctaaaggaatagcagatagtaacattatctattatagcagtaaattatttcaacacatttttaactaagaaatgatttagaaataattctggttgattgattttgaaagtaaaccatatgttgtttacatgtgttggcatttatccagtttccctgaatatgagagtgaatttttttttccaaaaaatgaaagccctttactaattagataataatgaacataatgaaaacaggtgctataactttttgaattatgagaatgcatcttcagagcaagctctgaaaagaggatcatgaagggaaaattatctgcatatattgtgaagtgggtacatatgtatcctggagatatattccaaggcacacattagcaaaaatttaacagcattttttactatgatggaaataacaaatacaaatcaaaatgagttttaaaatatgctgtctcttttaaatgaactactaaatgtaaatacatgcattatgtgcaataatgagattctagttaacatcataaagcttttcaaacgcattagggtgacaagcaagaagtaactaaagatagccctatgattttctagaaggccaatgtggcattgaatctgactaacatatagattctcacacctctgagtgacagcgacatccataaagtcctgttcgctctcagcacttgaaagaatagatgtagatgatatagattccattgcttcagccacaaaggagaataattacagacagtgggggaagggtggtatgcaggaatagatgctcctaacataaaaggttgagaaatagaaaagattacggggaaattaaggagtaaagaggacaggtcagatgactccctgggtgagaacctgaatcagagtgattgagtaaactgaacctctgctgctgggaggggaaaacttttcctgccctgtatctttccttccaattgaaaaggatgtactcatttgaatcgcagtaatgtttctgaagaaaaatgaatgttcaatgttcaaaatagtcagaactattacagtatactatcaactgtttaaaatatatattaatatacgtgttcattattttccagaaaatttaactgccatgtttgaaaataacgtatgaaatctgccctcctacaatgtggcttgatactagatctcttctgctgtggcacaggcacttaaattccggttataattatttttctaaatgattagcagttattgtgattattctctggataatatatgtatgcaaaatgtggctgcaggatttgcttttgttagcatacccctcccccaccctgaaacctcaaggctccagacgttgatgctggagagagaaaatggatgtgtgtgtgtgtgtgtgtgtgtgtgtgtgtgtgtgtgtgtgtcgcgcctgtatctaaccttcaagttgatacaatggtgatgatatacaaacaaaaaaaaggtaaagcttctccttgatagtgccattctcaactcattgtaatcattttaaaaaatctaaaagtaagcaaaatgcttttaatttaaagggggtagtgttttaacaagctacacagagtatttaaactggaaaattattaaaactgaaaatggcacttttattaaataactctgtgatcttccagccatgttcttaaccagtgatctccctgtagcaaaatgtacagataatcaacaacccagtctgacagtaaacttgttgggagattaaatcctcaaggaaggagcccatagccctggaggaagactgagtgcatgtttccctgagtctttgaaggctcatctcagtagtcccactgctagaatgtgctccgttgtcatagcaacaccatctcctgcttcatacaggaaagattagctcttactgtgcagaggagagaatttaggggaagtcagactaatccctgggtgcacttcgagagaaaggttggacctcgcctgagggatgctggatctgcaatgatagaattggcctgccacagacattggtatttaagttgaagagcagaattcacagtaagtgtcagctcctccagagtagaatattgatgaatgaggtttgtctaagtcttgttgaagactgtcccatgaagcagtagaatgacaggagtagactctgataaatgccaatgttttcctagttcagttgttatttaaaggtctgaccagattagaaacttgaggaaaaattttaggtactttttaaatatccatctaaaatctcaggagcatggtaaaattagataagcaaaaagaatatattatatgcttttggcatttaatttatttaccctagattgttgtgcatttaaacctaaaattccatcaagagagagaaaaaatattcatggacaaatctgcatgtgtaagcaagttgtgtttcttcaacaccaaaagtgatgaaatttcattttaggtttgtaaatgtccttttctaattatgcatacatattttaaaaatccatttagaagtatgcaagtggtgtggttttttaggtcattataatatgatgaaaaggcatttttgagtgaagagcaattaatatagctattctgtttggtgctggtacttcaacttttcagcataaggcatgtgcaatgtgtatacctttcaggattttttgttgatcgcctcagatggattttgttctggggggatgtctacgtctatgtgggtttgttcattttcttttcctctttggtttgtgcttacacagttccttccccaattcttatgaagcatatgatttttagcttagaagctagaaaccttgtatgaattttaaatatttgatattagtgtctattgtgaagatatctagtctttcaaaaacttaattacctcaaaagacactttaatccacatacaaaattgaaaagaatttttcaaaactatgtagattttacatattatattaatatataacccttgtgtttatgactatcaatgggtattcccctgaatgtatttatttagtatttaaaatattcatgatgaaaattgtatcaggctacatccgtgatacatgatgttttttaattgtttccatcatgtttatatatttataacatatatttagaaactgggattgtttcccctgtgtaaaatcctgctagtaatgtactacacactacaaataacattacagtctacgctaaatatagctattatcataaaaacatttaattgccaattgaagtgtgctgttttaatttctcagaatagacagacttgggtgttgctgcaaaaacagagcacagatcacacatgcacttcttttccctgaaacttaatgctagaagagaccattggtcctagagttgaacaggtatattaaaatgttggataaaattattatcttcatatgttaggaagtacacacaaaactagaagggttatactttgcttaatagcatttgggttgtaactatgcagaacctggtactcttaagaaaatggagacaaagcaggaagtcagggagtccctctcaatgaatgatcataaattattccaacaacctttttggtgatttctattagtagttcgggataggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattctttgctcctgacttcatgcctatgtataattttatattgctgcctgaacctatatttttgtaaatcacatgcataacttcatgcaacagaaaactgtttaaagattattattttgtgatagaataaattatatcccataccttttagtaaaatctatctatagcaattataaactgtagccctgtataataaatattaagaacaataatcaacattacaatatggctaaatatgacttgtagaacaaacccaaggtgtattttaaaggtagaataagaaattaactttgattgatactgtctgtaacttccaactttgtttaatatcggtcaccccaactactaaaaggttaaaatttaaaaaggaagaaaaaaaagaaaatctataatgcttttctaatgctttgaaagaagtttagaaatttagaaaatcccagaagccagggctttgttaaagaatgcagcaaatgtgaattcacttcctagaaattgctttaagcatgtaagaaatttaagggtgataacgaagtggctttttttttttcattttagctaataaggtccccatggataactatttcccatatcaggaaagagacatgtgcttcccttaacacctgccacatagaggaggatattaaggattttctttgcctttagttctttcctctgtttgccattcttcacagtagggattgggggtaaaggcccaagaatgtgatttttttcactcagtttttgttacaattgctcaaggcattgctcccaagttcttctcttaagctgagaattttaaccttttactttagccttgcttcttgttgacctcaagacttgattttcttagtggctcatcctgtcttcaaatttatatcatagtttttatcatctcaagaaaagtaacaatgctgggactaacattattagtaactctcttattttaaatatttgggttcagaggaaatagtaattgaaagcaaaatatgtgttattggacctgcaatagaaaactcaatttataatctggcaaattttttcattacgttttttcatcctagaatatttttgattatcagacaaaattatctggagtgttccttgccaacttaaatgttctctgcacccatttctaatattttgaagaataaacacttcttttactaattttacaattaaaggacgtgaatataaaatatatttctgaccaaatttatatgaacaattttctcatgggattgccctgaattctgggctgtatcaatgtcaccagagcatatcacacatggttcttttcgttgtttatcctccgtgatacctaagttagaaacacaaggagattccattaaatgatacaattgactcatttttcttatccctgcagcataaggcagtggaaagtacacagactatggcttaacacactatctctgttcgtatctcagactcacatttccacaatggtttgtgcacccatgtactaatgggctaagaacctccacctcgcatgttgttttatttcaaagttcaattgattaataaagtatattaataaaatatagatttgttttaaaaatacatattcatgattgaagcatttttcctcaggaaaatagcttcaatcacttcaaaatagtttctattttgaaaatagcttcaatcacctcaaaatagcttaatcctcaaaatagcttctatcagcaatgtaagattaataaaatattacatattcatgtgaagtatatagtcatgaaaaaattccaaaaagtaccaaaatgtataaagagaaaggaagggtcccctattcttcactcccaatctactgtgcccccaacaataatctccattaacagttcggtatgtacctttccaaacgagagataaatagatcaatcgatcgtttttattaaaaatatagtcaccaaaattttgaatacagatgcttctcaacttacaatgtgattgcatcccaacagacctattgtaaattgaaaatattctaaatcaaaatgggtttgatatgcccaaggtacttaacaccatatcttagcctagcctactttaaagatgctcagaatacttacattagcctacagttagatggagttatctaacacaaagcctgtttataataaaatgttgagtatctcatgcaatttattgaatgctgagctgaaagtgaaaaacagaatggttgtatgggtgctcaaaatgctctttcaactgaatgtgtcttgctttcacaccatcataaagtcaaaaaattgctaagttgaaccattgtaagtcaggaaccgtctgtatatgtttttcctttatatcatgattttgaatcagttgttggaaagaacattttgccaatgttttgctgatgttttcattgtgtttaaactagctgttactacaaaagaactaacaatttacaggctaaagaaaagtggaatgggattgaccacacacttatttttttggaaccattcattaattgtggcaagggttttgctgaaatgacaagtaaatgcacatcttaactttatacagaaatggaggctaagccaaataaagacttgctcttaaaatattggtctgcaaatgtctgcagagctgaaatgtgtaaattagagattcattgaagtctgctagccaaaagtgaaaatgaaagtgctttcagcttgctaattaatgctgcctgtggaatttgcaggggaaaaaaaaagccacccagacctatgagcaaaagtagtgatctggttgtcaaaagaattgtgtctcattctattatgctattatgctactcaatatggaacccttagtaataaacctgtcttttttccccaatgtaaccacttaaaattaggtgacatattctctactttgttattgtgtgacaataagacgagggaaaagaatatccaaaattgttcaaattccagaataagatatgatataactataatatatagctgagattttaatgttctgatgtctatattgtttatatattttacattttgtttcttttattgatacataatacttcacatacttatgtgatatttgtattttttacatgcatagaatgtataatgatcaaacctgcttatttgggggcacccatcaccttgagtatttatcatttcatcaccttgaaaagggtaacatttcaagttctctcttctagctattttgaaatatacagtatactgttgctgatcatagtcactttaggctgttatcaaacattagaacttgtttttctatctaaactgtaagtttatacccactcatccacctcttttcatttcccctactcattctaacacacttacccacctctggtatctatcattctgttctctgtcaccatgatactaagttttttagctcctacatatgagtgagaacatgcggtatttatcttattatacctgggttctttgacttaacataatgacctccagttccacccatgttgctgcaaatgacatgatttcaatgtttgttatggccaaatcatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtagtttgtttcctttactgtgtagagctttttagtttagtataatcttatttgtctttttgttttagtttctatgctattgaagtcttagctgtgaaacctttgcctagaccagtcttgaaatgttttccttacagtggttttataattttgggtaagtgtaagtctttaatccatcttgagttgatttttatatacggtgagaaatatggatccagtttcattttttggcatatgagtatttaaatttccctgtatgtgtatcgaagagggtgtcctttccctagtatatattctttgtatctttgtcaaattagctgggtgtaaatataaagatttattttggggttccctattctgttccattagtctatgtgtttattttaataacaataccatgctgtattggttactattgccttgtaatataatttgaagtcaggtagtatgatacctccagctttgttctttttactcaggattactttggctattcttctcatttttggttctatatgaactttaagatttttttatttctgtgaaaaatgacattgttattttgatagggattgtgttgaatttgtatattgctttgggtagtatggtcatttaacaacattaattcttccttttcatgagcatgggatatctttctatttgtttgtgtcctcctgtgttattttaatcagtgttttgcagttttccttgtagagacctttcacttccttggttaagtttatttcttgggattttttgtagctattgtaagtggaattgccttcttgatttcactttcagctatttcactatggtgtacagaaatggtactgattttttctatgttcattttgtactctgcaattctactaaatttggttatcagttataagagttttttggtggaatctttggttttgctagatataggattatgtcatctgcaaagagggacaattttaccttctttgtttttgcaactgtgatgctatttatttatttatttttttaagatggagtctcactctattgcccaggcaggagtgcagtggcacaatcttggctaactgcaacctccacctctcgggttcaagcgattctcctgcctcagcctcctgtaatcctgagtagctgggattacaggtgtttgccaccacacccatctaatttttctatttttagtagagacggggattcaccatattagccaggctagtcttgaactcctgacctcaagtgattcacccacctcagcctcccaaagtgctgggattacaggcatgagacactgtgctgggctgatgccatttatttattgctattgcctcattgccttggctagaacttccagaaatatgttgaataggaatgatgaaagtgagcatccttgtcttgtttcatatcttaaggaaaaagctttcaacctttcccattcagtatgatgttaactgagggtttgttgtatacagcttttattgtgttgaggtatggtccttctatgcctaattggttgaagcttttacatgaagtgatgttgagttttatcaaatgctttttcggcatctgttgtttttttcccttcattttattgatatgatgcatttcctttttactgatttgggtacatgaaaccacccttgcatccctggtataaatctcatctgatcatggtttattatctttttgatatgctgttgctttctgttgattagtattttgctggggatttttgtatctctgttcatcatgaatattggcctgtagtttcactatttgtcaaatccttgtctggttttggtatcagggtaatattggccttatagaatgagttagggaaaatttccttctctttgatttttttgaaatagcttgaggattattattatttcttctttatatctttggtggaattcattagtgaatttatctggtcctggtctttgctttgttggaagattttcattactgattcaatctcactactcattactggtctgttcaggttttctatttgtttctgattcaattttagtaggatatatgtttccagaaaattatccatttcctataaggtttctggtttgttagcatatagttgttcataatagtctctgatgatcttttgtatctctgttttatcagttgaaatgtctccattttcatttctgattttttttaatttgagtcttctatcttctcttcttggttagtctaataattattagttttgtttattttttaagaactaccttttggttttattgttttttgtattgttagtctctatttcatttagttctgctttaatcattatttttttttccttttgctgtttttgggcttagtttattcttgcttttccagttccttgaggatcatcattagattatttgaaatctacattatttgaaagattatttgaaatctttctactttttaaatgtaggcatttattgctataatattccctcttagtactgtttttgctatgtaccatgagttttgatatattatattcctattttcatttgtttcaaaaaatttttaaatttccagcttaatttcttcataacccagtggttgttcaggagtatattgtttaatttccaactatttataagtttccaaagtttaacttggcgttgatttttagttttattccattatggtctgagaaatacttgatataatttttaatctttcaaatatttttagacttgctttgtggcctaacatatagtaggtcctggagaatattctatgtgttgatgagaacacagtgtattctgcagttgttaaataaaatgtaatgtttttttaaatgtctgttaggtttatttggtctaatgtgtagtttaatgtttccttgtagatcttctgtctagatgatcggtgtaatgcttagagtagggtgttgaagtctcccactattcttgttttagagtctattgccatctttagacatctttagatctagtaatatttgctttatgaatctgggtgctccagtgttgggtgcctatatatttagaatgtttatatcctctagctgttttattgttttatcattacataatgaccttctttgtcctttttttttcctttttagtgtttttgacttgaagtacattttatctgatgtaaatatagctattcctgctcactttgggattgtttattgttgcttttttggggggtggggtggggcagggtcttactctgtggcacaggctggagtacagtggcgcaatctccactcactgtgacctccacctcccgaagttcaagtgattctcatgccccagcctcctgagtagctgggactatcggtgtgcaccactatgcccagctgatttttgtatttttagtggagacagggttttgctgtgttggccaggctggtctcgaactcctggcctcaagtgatccacccgacttggcctcccaaagtgctgggatgacaggcatgagccaccgtgtctggcttcccttttggttttcttgtgtggaatatctttctccatctctgcactttcattctataatgagtctttagaggtaaagtttattttttgtgagcagtttgtagttggattattttaaaaattcactcagcaagtcgatatcttttaggaggagaatctaattcatttacattcaagcttgttactgatgtgtgagattttgttcctgtcatgctgttattttctggtttagtatattctttgttcctttattttttccttattgtctgtcattttggtttggtggttttctgtagtgttatcattgagtcctttctcttcctcatttgtctgtttgctttaccagtgagtattagttacaacgtgttttcatgatggtaaatgctgtcctttcgcttttgggttgaagactgccttgagcatttctcgtagggagagtctagtgctaatgaatttcctttgctttcaattgtctgggaaaaattttatttctccttcatttatgagggttaattttgctgggtatagtatccttcgtgattttttttttctttttagcactttgaatatgtcatcctattctctactggcccataagatttctgctgagaattctattagtctaatggagtgttcctttataggtgactacatgcttttctcttgctctttttagaattccctatttatctttgacttaagctggtttgactataatgtgccatgaagatcttgttgcattttatctgtttggggatctcagaacctcctatatctgaatgtctaaatttcttcctaaattggggagttttcatttattatctatttaataagttatagaatgcttcaattttctctttgctttatgggactcccataattttaatatttgattgctttatgggtttatcatatgtcacaaaaactttgctcattctttttattctctttatttttttctgacaaggttattttgaaagacctgtcttcaagttctgagatttttttcttctgcttgatctagtttattgctgaagctttcaaatgtatttttaactttattcaaataattattcagttctaaaactctggtattttaaaataatatctatctgttaaattttcattcatgtcctgaattgttttttctgatttctttaaattgtttttcagatttctattgtaactcactgagtttcttaagaatcaataatttagtttcttattctgggatttcatgaatttctttttgattgggatctattgctggaaaattatggccctttaaaggtgtcatacgtttttgctttttcatgtttcctgtgcctttacattgatatctctgcatctggtatatagttattttttccaaatttctgaatttgctttcatcagggaggactttttcctgaatatgtacctatggtgttggttgagcagggcactttggctttgattttagatgtgtgcggtagtgtagtctttgtaaaacttctttgactgtaaacatcatcagtagtatctgtgattttcccagtggcttagggtgcaattgttattggaggctgtgatgaagtttttctgtgggctaggatgtcaggaaggccagtctttaggccccagtgatggcagcaatgggctgggatgcctgtccttgggtcccagagtggtgtaccctggtgtttgttggttcaggtaaacctattcttgagcctccaggtggcttactccaattctggtaggcagcagtgggccaggtgggtgggttctcaggtccctggacagctagaatggcatgggtgaaggtaacaggacaactatctggatcccacgtggtgagtgcttatattggcagtgggactgtgatgagccgagtgggccagtctcaatgctcacaggtgctatgtgcagatagatgccagctgtggtggtagctgggtgggtagtcccaacctcaggccccaggaggagtgttcatgtgcagtggtggtggactgggctaagcaatctttttgcctccagagtctgtgctctgggatgggagaagttgggcaacactgggccaggtgagctcatcttcaggcctcctgatggtgtgtgtgggtgtcagcatggtaggcaggggtggggtgatccccaggccaccatcagaatgctcaggttgtgggcagcagtggttatgctgcagccctgctactggatagggtggtgctaccttccgtggcagcagcctagcctggtggctggggaatgtgcacaccacttgcacccaagctttagtagaattcatacctaagacctgctgtggtagctggcttcttgcttgcactttctttgtgctttcaccttagacgcagtaatatttggtggttgctcacatctaagccccagaggcaagagccagggcttgtctagcacctcagctgcagcaccactagtccccggaagagtgcagtgtgttgccactggcactcgaaaatggcagcttgttgtagctgcttagatctccaggtgttttttgggacccactgtgagccctctctctggggcagtgccattgcaaggtctcccagcagctccctttgttggtttcaggacctatgaagggtgaagaggctttcctgtggcttggattgccacactccatgttggaaatgtggactgttgagggtttctcacttactctttccttgtattgaggagtctctcttggcatctgacacccagttgatttcaggtgagcagatgcctctcttccttctactttaggtagttcctgtcactttcatattgaattttagtgttttctcttggataatcatcttttgaaagtataaaatatctactcactattttgtttcttcttagtgaaggaggcatatatgaaatgcctctaggcaaccatcttgaagctcctctacaaatttttaatgagggtctatcaaatcaataagaagttagtggattattgctggtgacaactgctggtacatatcagtgacaagatatgtacaggacttggaaacaagcaatgatatatctgttgaatctaataataaatgggcttggattttacatgtcttttctttacatttcatgtttaaagttgttgcttttgttttgttttgctttacaaattggttgtccatgataaattagaaacacaggactggagtcttcatcgctgagagtttgagaagcactgcagtaggggactagcactgcgctagatacaacagagaacaaagacggacatagcctgttctctcagagcttgagtcctgggagacacccggatattaatcaaataacaattctccagtgattttgttattcaaactgagataagtgcccttcctgaactactcttctcctctctccatcccttcccttttattttctcatccattcagcccccttgtgattccctatcctgccacctctttacccattcatctctcctctccctccctctccccaccatgacttgttctccctattgtcaaccttaatcttctatttttttacatattttgatttttatatctgaaaaactttatcaatttaagcaatagagtaaataatcatctttttaaattttatttttaattgacaaataataattgcacttatttacggggtacacagtgatgtttttacatatatagtatatgtagagtagatcagagtaattagtatatccattacctaaagcatttattatttcttggtgttgagaacattcaatatgctccttctagctattatttgaaactatatattattattaactacagtaatccaaagtggtacagaaaactggaacttatttctcctatctagctgtaattttgtatccattaacacatgtctctcctatcaacaaatacaaaacaatttcaatattccaatttttgaagattattatattctcactttgattaccaaagagtatatgcctatatcccttttcctttgtcccttcctcctttccttcctttcttccatccttctattgaggaatttacttagaatctcttgagcccttgctatgtggtgaagattaggccttttgtcccactatatgcatgaccctgtttcctctccatacccccagaagaaaaaataagcaaaagaaataagaatttgaattcaggattctttgaatatttaacctagttatgctctgtcttaggatgcagtttctttgcatgtatcctttaaaaatgagtagagattaacatttatggcttttgaaaattattaagaatatcaaatataataggcattgctcctttttctagaagcccaaaaatataatcaaagtggaattttatttagatcattactttactttgactttgagataggactcattatataaatgaagaaacagtttattttctgaagcacagaatcactgaattatagtacatttcccactacttaataacatttgtaagtaatagctgaagtgatttgtatgtgaaaatttgtggaactttttcctggtttaatttactactttattttagatttttgtcactatatttattattgaaaattggttattatgttgtgttggttgtataaaatagtactttaaagaaaaattatttgaatagaatttttaaaatctcacctcttggctttgtattatctagaaaataatgctcaatccacactacaaagcgtctaaacattttatcagaaaactagagatacagagcatagtatccaataaacagaaagtttctgtgccctcagagatgttcatgtatggcatggtttcctcgcatggcaggtgttcgcagtatcaccagagaattgggagacataagctcatagcctggaaaggtacatggtggagagaaaaggccacagattatggagtcagctgctcctgagtgttaagtgggctttggcacatagatcatctggagaaagccattcaatcaggagccaaggatatgcccctgtgacattaggtaacctgggcttgctttgaggattgataaattagtaccccagtatcatttttaattactctttagtggcacctagtatctactaattaaatagtaaaatttttatgtgtgtgggctacttcaaaaaatcagggcacaagggtgtcaatttttttaagaatgatgtgtcccaataagggagacagtgatttaagggacccaagactagaatgtgcagaacagctaggccataaataaacctcactgagtttcatactgagatatcatatagtttattgtctaaaccaggatatatttgagatccaaaggggggcatgattagtaattgtactgagagaataactgtacaccaagactgtgtgaggtagaccctacacagttcccttatcttttctgtttctacgtgtctccctacttggctttctctgatgaatttggctcaagagattctaagtaaattgctcaatagaaggatggaaaaaggaaggaaaggaggaagggacaaaggaaaaagggatatagacatatactctttggtaatcaaagagagaatataatactcttcaaaaattggaatattgaaatagttttgtattcatcatggacccctgtaacttctccagctcaatgctcccctaccacttttacttctgctgcagctactaacgaagttagtggtttcaacttttcaaattttaccatgcaaatgaatcttctgggagtctggttaaaatgcagattctgatttagtaggtctgggataaagtctctgattctgtatttctaaattcactggtggttttgatgtggtcattggcccttaagaagaaagtgttagttcaaattccaagagatgaaatcctttggcctaattcatttttccggtctggctgcattggctgtgggtttgacttgtggtttcattgccctttggtcaggcgcctgccttggcagtttcagcctgggctagttgtgtggctatcaatgcagtaggctgttggcatgttgatttgtactagaagggagcatagaaatgagatgtgtacaaccaaatgatatattcaatgtaattcattgttctgtttagtttagttgcatggataaccactaaataaggatcctggaaatgtgccatcagcagtgaacactctgaatcaggtgctgcaaagctcagtaaatgttccctgtttggcttaagtaaagaaacaaggattttcaaaatagaatctactgcgctttatccaaggaaagattttatagatggccatgcttatgtgacattggtgtagcagcataaaacatggaatggggttgggggggtactatgaccagctcttgattaattagtagtaatcacattgtgagagctcttaatttggcattattcaaagagtttaaattgatacagttagtacagtaacttagattagtttttcctaatggtcatccaagacagatttttaaattttgatttgatgagaactcaatgttttattctgacagaaacagtttaaatgaaaatgaatatatataccactactataaaaaggatactcattatctgggaatcctttctattcttagttgtgtttttttcctcaaatcagtctgacattacttcttggctatcctcttactatgacaaaaataaaatatccacaaaaacaaaatgttttctcttcttctgttgattttttaaaattatattttcatttggcgatttgctgtatgtactgctttacacaaagaactgttaaagtaaggtcctcactacctatgaccatttgggaaaatatgacttacatccatgaaaaaattagtgtataatacaatataaaagttttgggctatgaaaatcatgagtttagaaaatagaataaaggtggtttagagtcattaatttatagctttatgcatttgctgaatatctactatacacaaagcataatgctggcttcaaggcatacagcagtgaagaaaagcctagcccctgtcctccacctatttgtaatttagttgatttgctcctcagaggaagaggtgttctccttggagggttgtttctcctacttcagtacctccagacattaacccccaacaattatcacttaatttttgataattcccaggatatttattgctaatcccatgattcctgaccccaacaccctttaccaaatacctattctccaacccacatgagagctccctactactgagcttgttccaaaccaccgtcatcatcacctttctctcatcatctttctcctctctatcctcctctctgttctttgctgctgagtttactttctttatattctactatttctataatccaactctttctaaagcctgccttcactgagagacaatataacatagagaaaagaatgtagaatgcgacacatgtcattaagtgctagtgttgccattaattcctcataaatctaaaattaattcattttcttcccctacataacatagcatctgtctttttcaggctcctctcctcagaatacccaaacatgtgtttcctgctgagatatactagtagaatttagatggaagtttattttggaattaggaaaccagtttctaatactatgtttgtcaacaaaacttttattgatttttcattctttaagatgtcgataaactcccttaataccactgttactgacggtaattaatttcaatgcaagagagagaaacagtaaagggaactgggtgaaattatcttgtatatcaaataatgaatttatattatttaaaaaattacaaaatatcgtttataataatatcaaagtttttagacaaaagtcttgaggctaaaggaaaagaaattatatcagttgggattgggatccatctggaaaatggagcccattccatgacatccattaggaaaatttaacactaggcactatttacagtggtgtttgaagagctaaaaagccaagcaggggttagtgaagcaactctggaattgataacagaaagaggcggctcccatagctagcagtggaagggccagggaatagctgatattactagagctcaagcccagagctcctacatgggaatcagattcacaaaagaggcttcttagcaggaactagggcatagaggatatactccccatgctggagatggagagactgcctgaaccagagagggtgtgtgcatggggagggaggagggcataaccaggcattctctctttgtccaattatccatctcttccagtgtctctcattgtctaaacccagtcataaggcactaggcaagaaaacctaggaaataaaatttgcaatagaaggagaacagatttgagaacaaaacagccaatgaccattgtgttagataaaggagcaggtattgtggatccttacagaataattattttaggatgtatttgttctgtaaatccaggaagaggttcatagctcaggcttcttgctgtctcagaatattggcaataagaaattcagctacatcaatgagtagtcctggctcacccattaccatagggagaagaactgttgaagggcaggggtaggagagtttaggagaatacctaaaggagtatacattctaatcattcacctctaagttactttaaaaacatgggtacttaacaggtctagtatgatcacagggtttctctctccgcacaaactcccaaaacacaatacacttcacctgcttgctaatggctgaaaataccaagagaaaaagcctttcattctgcaattagagataaaaggtttaaattacaactgcctagttgaagtaacatttttctgtgagggaatttcagataaaggataatcaatcaatcaatctgtcaatccattactcagtaaaatgacatacatagagccagtgtgcacacaaatagctggagaattagtgatcaagaggggaaagagaacatgcaggacccagaggacacactttgatggttttgacaattcttcccagggtgatactctttacctgctatgtgagcaaaactgatagtgacttcagcacatgtgaatgcttatatgataggcagctctactttagaaggggagtaaagattcttgattttccaaacatacacttgacccaggtaaaggccttttcttccaggggtttgttaaccaaggtaattaagtttatccttttcccccagataaggtttatagctccttagttacacatttacctttaattctttgggcaagatcatatcctttcatgagtctttttaaaaaatgggaccattctggcagtaagtatttttgtttattagttttgataaagggaaagaatatttggcttttggcttctttttctgaaatttttccagatttttataaaatgagattaaaatatcctcagattcagccttactgaacccagaattgagggctgttagtcatctttagttctgttgctatccacagttgcctcctttaattgcgtattctactgggtagttgttggatatcatctacattaatttctcacatatggctcctaagcacttatatgagaaatgcttctagattccctgacctcaaccaaaataaattaaaccaagatttctagcctttattgtgttagaggttttagtgcccacatggatcctacagatacatatttttaatcatctcccccaggaaattccaaagcaattaaagtttgagaactactaatacacatctattattcgaaatatactatgtatattattccagtatagtattccagtatactgtgctggaaagtgctaccaaggattcattcagcctacattacctgctttgtgttgcagagtaaaggcagttatggtgtaagatttaaggtatggcctagtgatagataagcttcctttgttgttgttgttgttgtttgttttgttttgagcctgggaaaagacagagcagagaccacaaggggtaaaggagagttgcacttaaactattttgcaattagatttcaaaggaatttttaattttttttcttttttggatatgaaggtactaatcttttcagcaaggctatttacatctatattttggacctaatacttagttttacggtaagatatgaaagagaagttttctaaggggggcatcaaaggactagaggaggaaaattgtggtgaatttggggaaaacaataaaatctttgtggaccctgtgagcatctgacctgaattttgggactaaatttccaagtactaatgttaaaatgaggattttatatatatatatatatatattttttttttttttcctgtttattttgcctaaggcacttggcctaaaggacatgatgctgagctactgaaagtaactgaataagaaagtaggtcaggtactttgggagattacatatacacacacacacttaaatacacacacaggtacacatatacattaacataatattttaggccaattctcttcatacagagagagctaattgttgaatatgatgctgatgaaaccacttttctacaaaatgctggtgggataacttaacagtatttctagggtctctactaattcatggagggaatggggagtagcaaaagagaaacaataaaatgaataatctgccatttactgtgttactagaccttctagacaagaaggagtctcatctgtgctcgcagagatagcacaataattctccaacactaaatccatcccatcaaaagtagccacagaacaagttaactcccgacgtccaactgccctcctgatgtcactagattccacacttccttgtcatcacattccacattctcctctgttgctaggtaccctgggcactcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttgggtaaggaagcagattacccctttaaagtgatgacctgatatgaattggttacaggagtctgagatccgcgattttaaattcttaaaaagtatcttttagggagagagggaaagagaataaaaatggttaacatgattacatgaaactcagcaatagaaaattcttaatttgtcctcagtttaatatctgcttactgttctatatggtatttttaaaataaagacatcaaaaactttgttttaaatttggatttataggacagtgttgtgagacattattgttttttaccatttaaattgcaaaatatgtgagtatgtatatttgatacaaatgagtaaatcatgtatttgtttttcttaaaacatactgatttactcaggaatgaaatatgtaacgctgttgaatttagttaccttggtaacatctggagtgaactactccatctaaaaatattttctaccttattgtttatactttttattgatataaaaacaaggcacttattaaagcctttcctgacaaataataatgtttaccttacctgaaaaataaatgaatgatataccatttattagatatacataatgatttcagattgaagaaacagatgtaggatgtttagtttttaaccaagatagatattggatttgtcttatgctaacgtagattttattttaaaatataatatatacttagggttatttaacctaataacatattgacaaagctttcatacattaaatgttactatattttttaaaggattctagaacacaaatgttaaatcactttttttcatgaattaaaaattggagttgaatattttcattgtgctcttctttggacttttgtgggaaataataaagtaataaaaatcatcttcataatttagcgtaagaatttgaattggcataaaaagaacatgcacacatttatctaaattacttatataagtcatccccttaattctgcatttcagaaaccctagacatttcatgttaaaataatattttgaatccctggattaatacctatggaaagtaccatgtaataaaaaatgtcatattatttatggccagtttcctaaattttcctatgtattttttctttccacatcaattctttctttgatgggtacataaaaagtaatttactagaattttgccatttgaacatattttaacatttttcacagggtagtcttagaaaactgtttaaaaatattatttcaggccaggcgtgaaataatattatttcattacaaattaaacttaaacctaatgtgctttgtttttatattttttattttattttatttatttatttattttttttgagatgcagtttcgctcttgttgcccaggctggagtgcaatggcgcgatttcagctcactgcaacctctgcctcccaggttcaagcgattctcctgcctcagcctcccgagtagctgagattacaggcacatgccaccatgcccggcgaatttttgtattttaagtagagacgggggtttcaccatgttggccaggctggtctcaaactcctgacctcaggtgatccacccacctcggcctcccaaagtgcatgagccaccgcgcccagcctgttttttaattttttactacagatctggcttcatcttagactcttgcctattccattactactagtcgtaccagttctattctcacgatttttctaattgtctcctctttttctgcattgccactgcttcagaagtttgagcttttaaatatgccaaattagatgacttctaaatctcttaactggtctccccaacttccattttgccccttcataccattctcctcatcagagtcagaatagtctatttgaaatataactttttccatgtcacttcccacaataaattaaaactgttatttgctcccagaataaaatccaagttctttgataaacaaaatgcttttcttggtattctctttttttcttctgtttatcttttcccattctcttttcttgcactccagactactcttacttctcacttgccctgcatatgctgacctctgtgactttgcacgtgctgatccctctatagagaatgctcttccccaacttctccacctggttaaggctcactcacctttgagaattcaactcatatcaccttctttaggaagccttctatgatgtctttatcccttgtattagatcacagccttcttgctctgcattttaatagcatgtttgtttttctgtctctcttaattatctgtgaccttgttgaagacagagtctttacaggccaaatacttaaccccatattggtcagagtaagcacttaacaaatgttagtgaataaatgaaggaacatgtgagttatatcactctttcagaatttgaatataattcccatgaatgtaattgattagaaaacattaactatttcattacatccctcaaaaaaacatacttgataacattcagaaaattaaaaatcacaagtattgaataatatttcttttgctcagccatatttatatgatttcactactagcttttaactaaatgaaacaatttaataccttttccatcataatttttaaaaatcagtagcaaatttttatcatataagataaaattaagaaaaatagaatgttatttcatgtaatctttgtctatgtgtttttttttaacaaaattgggatcataccaaccacactcttttgtagctagatttttgtgtttagtacttcatgactcacatccccatatcttaaaatgcaatattgaataactacataataatctaacaatttcaacatttatttaaataatctatttgtggtaatttaggtcatttctaattttttgctattatgaacaacactggtataaatgtttacctacaaagagatacacacaatgattaaacttcttaggtattaaactcccagaagtgtaatgactggaacaaagtttatgaggacttttaatgctttagatgcatcttaaacagtcattcagctaatactgatgcacattccaccagcaggataaatgatgctttttatcagagaatttttaccaaatctagatattctcactggaaaaacaaaaacaatttgcaaaataattggtagttatttaattctctttgtttttttttctttgagattgcatttgagattgaactgttctctcaattctgttttcttcttcctgttttatttcacttattgtgcctaaatgtgctgtgttagcccatttgcgttgctataaaggaatacctgagactgggtaatttataaagaaaaaaggattatttgggttacagccctgcagactgtacatgaagcatagtgccagcatctactcctggtgagggcttctggaagcttataatcatggtggaagatgtaggggagccagtttgtctcatggtgagagagggagcaagagagagagagaagaggtgccaggctctttttaaacaactagctctcctatgaactcccagagcaagaactcactcattaccatggggatggcaccaagccattcatgaaaaatccaccctcatgacccaaacacctgccactagaccccactatggacattggaggtcacattttaatgtgagatttagtgaggacaaaacattcaaaccttatcatgtgcctactagattaaaaataacaataactgctttacaagcttattgctgaggatgaattacatattgtatgtaaaatgccattcatataatgggagctcaataaatgctagttgaagtagactctgaatagcatattaattaaaatcaaaatataacttttcctttccaacagatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaaggtatgatcacattacaatttccagaatttttgagttggtcatgaaggtcacaaaaaatacctatgcatatagcagataaacattattgttaataaaaatattataaacaaatccaataagaggataccaagaaacttatcaccaagcatattgtgtgtttataacatatgatttcaggaataatagcaaaatgaatcgtgtctcaaagctgtgggtgtttttagatccggagaatcacttgagttaatgtttctcatgtatataatctatttgtatgaatctctctgggaatttgttgagctcagatgtgacagtttcagtctcggtacacaattttctactataaaaggatcactatctagtttctcctagatggataggtgtaagtaaagataaagtttcaattaaattcttcagtttgctttggagacctggggactttgatcagtaattttctttgtggacactaaataactgttaagtgtgagggtcctggatgaagtttgtggattaattattttaagaaatgatttatcataaattatatcatacaaaagacaaaaacatatttcagacatatctaaatgtttagattctttatattaatattagaataaagtacaaccctctcccattcccagctgacttttttttaattaagcttaaacttctgctagtttgagataacacatgctggtgactttgctctatgatttttgaaggtgtactttggaacatatgagggtttttatggaatataccttttgagtgccttccccagcccttacctctaagtcagagttgtagaacttgttttttgacatagatccttaaagcaaaatgtcttaatctggattaatttctgaatttgctaaggcattatgcttcctaaattggctctatttaaatcttctggcttgcctgggggtgtgttgttttatcctcttttaagcaagtcactggacattagccgacacctaagcactcctgcctgagggaggctgctacaacttttgctgtggcaaatgttcaaatatcctcctcagtggtttaaagccaaattacataaacacaaatgattttatatttgatgacatgatctgattcactgtgcactgtgttacattttacagaacaaaataactcctaagtttccctgccctccacgtaaacctgtctttatgaagtttaaataatcgtgaaatgctctttctatgctatgtgtctattaaatttttttctaaaattattcgatagtttgctcttcttttttttattcccttattcagtattactctgggaacgatgcttattaaaacatattcttgcacatattagacagaatgaagtgacttttctacctctgttacaatggagttgagaagcacagatggtttgggctgcttgtgagggttaagatgataaatgagcctagaagagaagaagatacccctgatgcacttaataatttatggcttagtaaatgaagaatgcttcccacagccaactgaggaatagccaaagacgcagaagaaaaatcagaagggtgtaatgtatgaaagctaagcaaagtccacctttgaaggagagtgtaggcagctccaatggacaatgttgagaaatcaaataagatgaagatagaaaatagttaaatttgtgagagaagttttgatagcacattgggaaaagaatcaagagatattatttttattattgtcttcaaaaagaacatagtaaatacttagcacctatgaaggacaaatacatctagagatataaacggcaggagtactagagctaataatatcatatcatctattgaaaatttgctaaaagtaaattttagatgttcttaccacatggaagtgatggctctgttaagttgcttacctggagtaatcatttcactatggataggtatacaaaacatcatgttgtacatcttaaatttatgcaattaaaaatacttggcatacttgcagcaatggagtaggtagcagagacaactcagaaataacagtctttattcacaaggctcttgatacttaattttgagaaagaggatacacatacatagaaaagtttcttagaacaagtacagacaatacttattctcgtattaaaacagtaagagtttaagtaagaaaatgctatttgaagtaagagtcaaaataggtttcctagaggaactgaggcttgaactttgaaggaaatataagattaccattttatttctttcagaaggggtctcttgctagacactatgaagggcctggaatgcagatagggaagatgacttggtctcaggctagggaatcattgtccattctgacctcagtatgattttatcacttcctcatggcattgaggaagaacatgacatccttttgcaggataaactagttgccaccaattaatttattctccaaatatttactaaaggattcctacatgcaagtcactgttgtaggaagcaaaaatatgtaaatgagaagagcaagattcctgccctttaaaagctcatggtctaacagtggggacaaacttgtggttacagtctgattctgtaagtgatatgagggacatatggtcaggagggtgaaatgaaagaacagaggaagggtgctgagggactgtaatgattcttcaggaaaactctaaagagagattgatgccagaggtgagtgtggaatggcaagtaggagttattctgattatgtatgggagaggggtaagcatgttttaaggcacagagccatgagagagcgtacctggcatgggtatttgcaaggagcttagcatggctgcagcagagaacaagtgtgaagggatgaagtataaagcggctccaccagtaaatgtaggtcattttaaggacttcggattgtctaatagaaagagcttagtggtcagcttagaattttagaaagcctgtggtcagcttggaattttataaaaattattctggcaacgttttggtgaatgaataggataggcactagaaaaaagtaatgagagaatgccggttagagagctattgtggcaatccaggaggaaaatattgacagttggaatcaaataactgacaatgagaaagaaaagcagagatatagtacaaaaaattactgaacatgttatttttgttcttttgacattgtatttgcaggactacctatctaacctccataggttgtattaatatattgccaaactcctgggagtgccattcacatagcctacaatatgaatagcatatttacctttctatatcccattaatgtgaacattctgtgaatataagaatgatgtttaccttgtccactgcagtatgccttacacctggcttactatctcgtccatagatgtttctcaatactttgaggaaatatacaaaggtttattgaatatggaaagcaaagcatagaggaacattctagaatgactccaagatttttggctttgttgcctaagtggatgacgaatccgtttactaagattcagaatgagaaacatttgaagaagcaggttttgacgtgtagtttacggtgcacatgcagtgtccattggacatatttaataggcattcgggggacatgtgtcagctctgaagaaaggtacaggatggagagagagagacattttaaagatttcagagcaaaagtgctgcttgaagctgtggtggttgataagatcaccttgggagagcatagaatgaggagagagttgaaatatgtcacctcgcagaatatcaatccattaggaacaagtgatataaaaggaatttgtggagaaacatatacccaaggagaaaatgaaagtaactagataagaaggggatattttagaagccaaaatgtggagcatttcaatattgatataaattgttaaactaagcgatccttagatgaagtgacattggcctgaacctgaacattggttaggagagttagtgctcagaggtggattcaaatcacatggcagaagaaacactaacagaattagtgggaaatttgattgaagacagttatagaggctgagataggaaagcagaatcattttaattgcgaaggagactgtgtctggaatttcactttagagattcttcctgcaatcttaatccaaatgtagagtgctctaggattcccgcatctggatcaatacttgctttaccccaaggctatgaagtgaacttcatagtaaagttctgttcaatctgtgcaatcttttgtagtcctcaggattgttccatcacttctgtgtgaccttttgaagtgacactacatttcttcttccttggagggctataaaagcttaattatatagaatatgtgaaaagcttagattccagtgagtttaatattgacctgtttcacaattttattgtgaataaaatcaaacaaaaatgattataaagcattgaaaaattgaacagtgaatagaagtgcttaaaacgaatagttgagttggactatgtcatttactgattacttattattatgcaaattaactcactagactagcagggaatcacattaactaatctaaggactaaatgtattgcactgaatgaagttaggtgatatttattttctacttgctgatggccgcattttaaaaggacaactaataacattagagctccaaagagggctgaaatgatgataaagagcttggaaaatgagacccatgaggaagtgttaagggattagctatatagaaaatgaaaggccaatcaaacaccaatctaggtatagatgttttaaattattaatcaatgagaatagaaagaattctaatggcagtgaatacttaaaaacactgtattattgactttttaatttttgttttctatttatcttttagtatttgtaacccagctgcattttactttatatggttaaatattctgaagcaatttcccagaagaataatgtttccaataaggactgcggtgggcacgtgattattgttgaacagtttatgtgcaactgtggttactgcatatttgggtctcagttcccaagacccctaaatcttcactttatttagtagtattttattttgtccactgtgtttcatgtaacttttttcaattaatctttaattttttaccaaaactgatactaccagttagtttataaaatattaatggtaactaacattaatatttgctatatttaatttcatttaaatatgattaatggaagcagcacaagtttcaaaatatctctttaaaaaaagaaattgtcttttacaaactaagagcgatggattgacttctgtaatattatctttgtctttgttatatggatattcctgctcattattggttcaatttaatgatttttaatgtctggcttttaggtgttatacatttatttggcccaggtgttgtttagggtagaagcaacaacatgtattcttattcagggtagaaacaacaatagtaaatgtgcttaatatgtgtgagacactctcctgagtgctagacggacaaagttaaaaaaaaagagtctctatcattaagaattcacattttggctagaaaaagcagacatataaatgagtgtattataatacagaaattgatttgtgtgtgagtctcctctaggcttacttatgccttggaaggttcctgagttaattctcattggttaaataggagatggccacttagcaatagggaatagagaattccaaacagaggaacattgatgaacagagcactgaggtaaggactagaaatgctgaagatggaagatgatgatttaagtctggagactagagtgtcagactagggaaggttttgaatatccttttgaagcttggattttactctttagttgacaaggaatcacttaagggtataggatggaaaatagtgtggtcagattgtgttttggggtaggaaaaattctggcgtgtgttttacaagatgactttaggtggcataagaagggagaagtctgctaacagagaataagacttgccttagtaaggtggtagttgggatggagaggagggcataaatttaagaaatatatagaaaattaaatggacagaattgggtgtttgattagataggtggtggagagtataaaagaaactttagccacaggataaaggatatatcagttttgatattgggatactatatcaactgtagtaatgatgaatattgtgtaatgctttcttattcataactcaaagcaacccaatgtaagaagagcaaatacagttattagctttatttaaacaaaaggaaataaactctagtgccatttaagacattccagcgacattattaatacaatcagataagtgataaagcctggtatttaacccaggtcacctgcctctgcagcccatgtaattttcgctacacccacacctgctgatgctgtgtgagaccaatcatctctctggatcatgtggtgactatgacaggcaagctatacagaaaggaatagtatctaatacaatcagtggatagcttcttgataaatagcaaatacttgcaatggcatttcttattttcttatttgaaatattagttttgcttttgatgttttagttactttataccatgaaaagaatgtaacagatgcctctatcataaaactaagcatttcttcaaagtatccttttattgctttggttcataaatgtaaatgaatgcgtaattgaatgagagtggttcttttaacagctctagggtaaattttgagcttatattttattaaataccaatttaaaacagcatcttcatattatatacatatataaacatatgtattttgcatataaacacacacacatataaatagtatattccatacttaaagatcacatattcttcagttctgctcattactggatacatttttttattatgttcttagtagattttttaaaaataaaatgatacataagaaagatataataaagttaatagctttatagtatatgtcatattgcaatctaaatttaaatgtatacaatgcttttatgaataaatacccacattactagggattgtaaaatcaactatattatatagaataatacaactttaaaatcaggaaccacttcattttacagacgaggaaattgagacccacccaaatgacctaacacccaaatcagtgtccttttgaatcattatgctaccatgtttgccattgcatatgctcatattctctatatgttattgcaggaagatgaaggacagggccattaattacaagtgcctatgcctactatgcatgttccagtccatgttggttcatttcacattttatatctcaggaaaatgaagaaggtgaggggcttctataatttatgccttgaaaagtgcaaggtgaagttgattttaattctgcacattcggtgaaatgtgcattttgagttcctttttagacatataatagttcatatgagttagtacaaaatcttaactagccctccagcttctgatgccatgtattcataaataatctggttagttatagattgtatttttgaccaaaatacaaaacaaagaaaattgacccgtcattatccttatctttatttgagggttcatcaatacctcaaaaagaagttgtctattttgtttatttttgtatttaatttttgtttatttgtttatgggctttctgttttttgttttttattttttgcttaagtgtgtgtgtgtgcttgtctttttccacttgagttctatcgttaagaataaggtcaaatgcttaaaaatatcattccagtctgtagatgccttgagaatagtggagaatctctaagagaaagaactatattttaaatactcagaagtgatttatatatgtctcaagataattgctattaccaggactccttaaaatattcaatattgacccaaatttggagaaagaataaaagaagaaaaattaatactagactcatagagttataaattctaatttgtttcaatatgctagtttacattttcattattagatgagccttacattatgcaccataaagcaattatctgtagccttcttattactatttattttatttttatttaaaacttttaattattatggctacataataggcatacatattcataaggtatatgtgatggtctcatacatgcatatgatgtgtaataatcacatcagtgtaattggagtttccatcacctcaaacatttatcatttatttgtatcagtaacattccaatttcactattttagttattttaaaatatgtaataaattattattaactgtagccaccctgttgtgctataaggtactagatctttttcattcttctaactatattttttgcaaacaacccatctgacaagagattaataaccaaaatatacaagaaactcaaagaatttgatagaaaaaaatatgataatacaatttaaacaataggcaaaaggtctgaatagacatctcccaaatgaagacatacaaatggctaacaggtatatgaaaaaatgctcaacctcattgatcatcaaagaaatgcaaatcaaaactactatgagatgtgatctcacccggttaaaatggcttttcttcaacagacaggcaataatgaatactggcaaggatatggagaaaagagaaccctcatatactattggtgggaaagtaaattaaaacaaccactatggagaacagtatggacattgctcaaaaatctaaaaatagaactagcatatatttcagcaaccccactgccatgcatttgtaaataatctggttagttataaatcgtatttttataaattgtatgttatagatatatttctaaaggaaattggtatatcaaagagctagctgtacatccatgtttattgcagcactattcacagttgctaagatttggaatcaaccgaagtgtctatcagtggattaatggattaaaaatgtattacatatacacaatggaatactattcagccgtaaaaataacgaaattctgtcatttgtaacaacacggatggaactgaaggacatgttaagtgaaataagataagcacataaagacaaattttgcctgtgtttactcatacgtggaagccaaaaattaaaacatttgaaatcatggagatatagtgtagaatgatggttaccagagggtgagaagagtaatggggagaggggggaagtgtagatggttaataggtacaaaaatatggtatgctttttaatacttttaaaatggcgatcttagggttagctggggtcaagaggataactcagatgacaaggttaaaaaaaatagccaagtcataaactcagtcccaaggaaaaatgaaagcgtatattgagtacttgtatactatgtgccaggattattctaataactaacttatgtaattctcactgtgatccaatggaattaggctctgttagttttctcatttttacagattggaaaaccaagattcaaagaaattgtatatatgattatactaagaatttctaaaatttgtatttaaactacaaataatttaacccaccttttaaccactataatgttaaacgatcatggtgtaggccttgagaatgagtagctgcaaacttgacctgatgctgagacccccagctactagtttggggttcataattatttcccgatcaggaagcacacttatcagctctgtgactttgaacaagtctctatcttttgagcttggacagttcatcaataaaatgatgataataattcttaacctataggcaattatcaagattaaataagatggtgtgcatgttttacaataaatgaagttgctgcagtggttgttattggctccagaatttagggtttagctgaatcttgcaaaaatgtcttccattcgttaatattcatttggaagtttaatacctgtttttaatagcctaaaaaattcttactgagattggcaacttgaagaagaacattgatttatttaagctagcaaatactagttttcttttcttcttttgtcccttcttccttatttccttttagttacacttattatccaggaatctggaatatacacattcccagaggcattttataggcattcttgatcccatttctgtgagtaacatgcactcataaaatagattctaggatgtcttatctctgctccttaatatctttcctgaccccattggaatctatccaattaaactgttacttccttcataccacctctcctgatcactacctcagctagaaaaaaaaaaaaatcttttctgaacttctggaggggaagatccatgaggaatgagggcaagatggcagggtgttgggttgtaaggtagcacactaaagtgatttacatgcgtgaagcttgcttcctgtcaaatgtttgttaaataaaatgcagtgacatgggaatatgttgcattgatcttatcccatacactttttcattctggtaatttcttctcattgccatttggcttccctgaactcccagctatgcagctgactttagccttaatttggaatagagtcttttctctttcaggcaaggtgtaggcaattttacctctctgatgcatatattcccttttgaatatttcaccaaaaacagtgaatcaaatgaaataaatttccattatggtgattaaggaggattgcatcatggcgggctggtaaaggagatatttggggccttatgagctttgcattgcgattctcaaatcacaatgtgcaaacttcacgtaaaataattaagtattttttatcaattacattttcacgtatgagacaaatattttaaagtaaaaattaacctgtaatatttatttttacatttttcattaactaagatattatcactggtgttagtcctctgtattattcaggattctccagacaaatggaacccataggatagatagatagatagatagatagatagatagatagatagacagacagatagaaagtgatatgttatgaaggactggctcacacaactgtggaggctaagaaattcaatgatctgctgtcagccagctggaggctcaggaaagccctggtataggtccagtgtaagcctgaaggcctgataaccaagggagccaatggtgtaagtcccagtctgaattagaagaccataaacccaagagtgccaacatctgagggcaagagaagatgaatgttgcagctcaaaaatggagtggacttgccctttctccacctctttcttttatttgggccctcaacagattggatgatgcccactcacattggtgaaggtgatattcttctttgaccagtttaccaattcaaatgctaatctcttccagaaacatcttcaaagacacacccagaaataatatttacaagctatctcaacaccctatagcgcagtctagttgactcagaaaattagccatcacaagtcccccacttattaactcggcacccatatgcaacttcttaaaccatactgaatctccaaataaaaaaaaataacaaggagataattctgcctgacatgatacaactatactacacgtaacagaaaacaaactaatgccttacccagaagaggaggtaaaatccatgaatgatgtttattcttctgatatgcagttgcttaaatatgatgatgtaaaatgaacaataattaaataccctaatatagcgtcagtacatcttttgttatttgtgaaggaaataagacaggaaagaaaacaaagatatttgcttaatatatgaatatatacatataagcatgttcataacaaaatagggaggaaacactcctggcaattattttcctatattcagtatctagtcttgtcttgatagctggtatttataccttcttctattacccattctgtattccattttccttcaacaagcacctcagctagtcatggttcttaacttcagattaaacccaatctttctttttgaagagtatgggttattagtagccttgtttggattgggttattgtgatttttaattgaccttatatcacagggcctggtaacactaagcaatgccctaatggatctcctgtattccaaacatactcttcctcatccccactgtggagtattactcaaatttctttgtggtagcctggagcaattaccccagccagcacagcaactcccttcttatcctattgattcagaggcatgagaggctcaaagaggctgggtggcagttttgacttccagctgaacagaatcattgttgtgtctcctggtggaagcatttatctccctggaactaagacctgtaggccagcagagcataaagtcatgggaacaggaagcaaaactttttctagtctgtctctagtggtaataatgagtgataccactcccattttcactccttgattcctgggctcataaatcctgctatcaaagacacagcatcatacattaattgctgatttgaagcacatgtagcctttgaagaaccttgccccagcccttcgaggtattcacacctagctggcactgtaactgagtcttccaaagatcatcccaccattctattaatcagctgtttcaggatggtagggaacatagtaagaccaatgaattctatcaggataggcctattgccacacttattttgctgtaaattgagtcccttgattagaagcaatgctatatgaaatcccaggtagataatgcattctgtaggttcatggatggtagctttggcagaagtgttgtgtacaagaagggaaaattcatatctagagtgtctgttccttccatgatggaagcagtccagttgaatcagtctgtcaccagatagctggctggttaccccaggggatgactctacatctagggctcagtattggtgtctgctgctagtagattgggtactcagcaaattggttaatgcccagccacactggtgagggtgagcttttttactctgtttaccaattgaaatgctgatctcttccagaaacacccttgcaggcactctcagaagtaatgttttaccagctatctgggcaccccttagcctaatcaagttgacacataaaattaaccattacattttctccttagagatgtcttagaatgctgaaataatttaataaatttagtattatttggaacaatctttggatcagaactgtacaagttatcaaatattcatcagtttctatataagtatggtgccctattaaagactgagagctataaaattgtttctgaaagagaaataccagttactgaattaactaaaataaaatgtaaaaaaaagtcagtttttatatgcaaaaaatgttctgtgaaaacacaaagtaggaaattgaagaaggcttcaaggaagaaggcatgttgtatgagcccaaattataagcatcactttcatgagagaaatttgagaaggtgaaaagaaagaagagaatagtcacaaaagcagcaggcagcaaggttatctgggagaaaataaccatggagttcagaaggactgaggggtgcatgaaggcaagtcaggagaggcactttccagagggttaggcctggcaggctatttgatttttttccctgagtatggggaatcatcgaagtatgtaagcattacagtgatgcaatgagtgtgagccttggccaggaggacatctcagcactacgttgaatggtttgaggatgcaagagacagaaggtggagatcattctccagaggacaggcgtaagagccattgccagggcaggagcattgccagcctcagttttgagattatggagtttcaagtgctagaggaccattaattttggctgatagctggcaatgtgaggtcaatagtgaggatgaggcccagaaagaaaagaaatagaggcctgaagagtgtcaccaggttgccataagggaagttgccagtcagaagatctgagcctttcactaatgtatgaaagaagagaaaacagtgatgaaggatcaagatgaagcagagagccagaaaacaggaagaatccagcatagccagtcccaaagtacacgaaaagatggcaatggatcattttgaaggatgcagagagagatggagtagatggaaaagcaaaatgggccattgaattgcatgtccctggaggacaaatctcaaagcactgaggcatgaaccaatatatgatttcttcagaaaaagaaaaaacatgtagtaaaaggattcattgcatttatattagtttttaaattacttttggttataatatctgtatgattaaaacaataaaatataagataaagttggtattttaacacggtatctcaacatttacttttcagttgaatttagcagtttgagcaccaaataggaaataagccctgaaagtgcagaaatggaaaaagcataggtttgcactcccaaggcatcaagaaaagcaaggagacattaaacttgctacaacatgacagtctgataagtgcaataaagtaatattgaaagtaagtcatgaatataagaggaagattcattttattgagaggaggaatagggatgtcagtttgaggtggtctgggaagattttcctgaaaatgtcaccttacctgggttttaaaagaaaaatagtttccagccagaaaaatgaatagaagcaattttaatttgactagggtgtgtgggtttagatagttaatctctctttaactcagtttacttaaccataacatgagagaatgatctttattgcaaaaaattatttatataatcatcaacataggtttgctttttattatatgctaagccctgagtaaaatgttaaggatatgggaactgtgatgaaaatcaaatgaaaacaaaacaaaaaatatctttaaaatgtttactgttgttccaagacaaaattaaaaggtgctgtcattacatgtgttataactataaatgaatgaaatgatgctgttgacaaaaagaatcaaactctgcaaaatatttgaagagatttattttgagccatatatgagtgaccagtggcccatggcacagccttgggcgagcttgagaacttgtgcccaaagtggtcaggctgcagcttagttttatacgtttttaggaagccataagacatcaatcaatacatgtaacatggacactggtttggtctgtaaatgtgggataactggaagggagaggagtggtttcctggtcataggtggattcaaagattttctgatgggcagttgattgaaagagttatctaaagacctggaatcaataaaaagtagtgtctgagttaagataagggattgtagagaggaagtattttattatgcagatgaagcctccaggtagcaggcttcaaagagactagattataaatgtctcttatcagacttaaagaatctgtcttaaggtctgtattttgatgttaatgctggtcagctgtgcctgaattccaaagggaggagggtataatgaggcacgtctgaccccccacttcccatcatgccctgaactaggtttcaggttaactttggaatgcccttggccagggggaggatctgttagttagttgagggccttagaattttatttttagtttacaaggcagtaagtgaagcaaatgataaccaaacagtcttgctgaagaacaggagagtgtgaagtgtgtatgagaatgatgggcactagggcatccttataccagaggtgaggcagtaatgagaggagataaggcaggggccagaacaagaaggtatcatatgcatactgaagggcttatactttatcttacagggaaaattaataagaaaaagatttccagcagcaggaaatatgtggttgcatatacatttttagaaagctaaatgatatgctcttctaaatccttaaggtttttaatataatcaaagtgttagatttgcaaaagtggtagggtaaactttatttcactttttaaacaaatatttattcagggtgtacgatatgccacatatcatgccagccactgaggatgcaaaaatcaacaaaatgcagttgctaccctataaaagctcaatctattgagtgagacagctacatagataattataataaaacacatacaataataaagatactcactaggcagcatacttacatgaagaaaatttcagaaccctgggaaatatcaataaaatccagaagataatcatgtactttaatgcttgttcttaagaagttcacagaaagggtagatttttgaactaaatgctcacgtaagtaacaaaaataacatgtaaaattatgtctgcacctccagaaaaacaattattatgcaaggacacagagaatgattttgagtgggttttcctggcactcctctttttgaaaaatggggataatgtttactcatacaagtttcatataaagaattaaagaatgcctacatcatgatcccaggtttttatcttaaatgtaaatcatggtcacttcagacttcaattacagtagagtaaaatgtgagcccttaatggaactttcatgaatccacaatgattctgagtcatcatgtagtgccttttttcataaataagaaagtaaatggggacttaattggtatgagtattgcaaattcttatttaacatttagattggagatttttatttaatagtacattttgatgcaaagtgtttacattttatttatcatttaatgagtatttattaagcctctcctgtgagccaagtactgtgttgctacctagaaataccagagtgaagaagatggaggtggttcctttttctcagaggttctcatctggttgggtcacgctgttcattagcaagacgttggaggtggaacaagaagacatggtatggtcaaagtgcaggaaaagacactggtttgggtcttgggagtcaggacttcttctccagaaggtataatatctcattaggaaactaaagaatgcgtaggagctagacaagaaagaagctttgcattctaagctaaaggtctagccccaggtggaaacaaaacttggagacaagcctaagcatggcatgtttgaggaactgaaagaacatcagtgcagcaagagcttggagaatgggggggctactggaaaaaaatgagtctgaaaaagtaaagagggccacatttcaaaagtccttataaattatacttataaatttgactattgtcactactatgagtagtgaggataagattttagttttaaaactgttgagaactggatgagccaaggtggagtcaaggagacaatttaaaatgcctttgaaataatctaagcaaggtattttgttgactttgtttctggcatggggacctgggtgagtggtactacaagtcactaaggtaggtttctgtgtggatggcactggcctcaagctgctgtgacacccagtttgaagataattgcctctcctagtccatgctttcacagcaccctctattcttcccacttcagtacctaaatgtagtattatgattaatttcagtattagcacttaacgctctctatggtgaaacctgagttccagtctttatgaaatattgtctttgtctggtctgagtgcagtggtgtttacaattaattgatcacacacagttacagatttctttattccttgtccattcccattgcttcacttgacaggcctaaaaataaaaataataataaaaaaagaaatgtcatcatcgaacaggtttttcttctatgtagaaagttcattgtgtctgctttccttatcctgccccacccctctaccctgcccttgccatcacacaaacacagacacacacgcacctgcacatgtcatgttgacgtggtgtgcttctatccattacttagactgtgtcagggctatgaagtctttaagacattaatatttagcacaatttctagcagatgtttactaaatcagactagctgaaaggtaacaaagggaatattgttcttagctaatgctataggtatgggaagaataaaaggtaaggacaattatgtagtttggaattgcgtagtagaacaaacctacagtccgtgattaggaaatgtagttcgcattatttgcagcgctaaaaaattagtgctttggaatgcatgctaatctcagtctatttaggaagaattcacgtaaagagaagttgtattgaattgtaccctactatactaaaaatgattatgctttctgaaccatctatcatatagttactaggaataactgaattacaatcactcttacactgagactgttgatgtacattaagatatattgtcctaatttctaaaatataggaacatattccttaagatttactttcttgtttttctgtgaggacctaccatttcagagtttaaactgtttacattttatttttgttacattttctatattcatgtttataattcctttagaaaataattcagtatgaaatcaccatctctctctaagtcatgtttttgaatgttaataacttctttgttataacagcattattcagtacttctgagtagaaaaaatagaaattagcattttatgttgtctgcagagaagtttccaggcactgaggtattttagataacctttgcccataattaataatatggatatttttgttcccttgagatggaagagacattatcaagtgcttacactgtccagagttttaaccttttgggattctttgatttaatttgggagaatatcaccaggtctcaagaatatgatgtggacattgagatcttgatccaattacagttgcaaatctcttcctagtctttcttatcaagactgaaactgactgatatgttccgcaagaattttgccagtttaatggaaaataaagaactatgggaggaaaagactggtataaaaacatacataggtttaaatttccttactctatgatagttagaatgaaataaattgagggcaaacacaatgtttttattcatagttgaatcctaaatacccaacagagtgttgaatcgtggtatagtataacattcaaggaaattctgacattgacaatctacaatacttgcaaagagaaggttgtgttttataggccttttgactggcttcccactctgagcaactggccagctcctgagcaggttgactgtacggaccacattatctcttagaaattagactcctcatggacagtcaggataaatgccgaatgattggacaagtctacaagactatttgttatctacctaacctggatttcttggatgagatatgttcccagtcagaatgacaattgaatatcctccattttagaaatgacaaatagttttcatcttttgtcttagttgcaaatacttgctagtggcttcctatcctgctgatatattatgttctggctcagaaggaaaaattatcaattaaaagttgtcaggctgggcatggtggctcacacctgtaatcccagcactttgggaggccgaggcaggtggattacgaggtcagggcttcgataccaaccaggccaacatggtgaaaccccatctctactaaaaaaatacaacaattagctgggcatagtggtacatgcctgtagttccagctactcgggaggctgagacaggagaattgcttgaacctttgaggcagaggttgcagtgagccgagattgcaccactgcactccagcctggtaacagagcaagactctctcagggaaaaaggaaaggtgtctcatgagcatggcataggggaacacctttgccattcctgagataacgctgtacagctcaaaattatcagcatcatcttcctctgaaacatctggtcccagctcacacaggtactccactcccaaccctgtaaaggaaattaccaataaacattgacctataaaaataagctcataaagatactagtcaataaacatattatatgtacattcataattgccttagaaaataacattatatttttataatatttcttagtgtgttatattcataataacaatgtaaccattattgtgagtatatagatattataaaagaaaataaaaaaattagcattatctagccaggtgtgatggaacacacctacagtcccagctactcaagaggcagaggtgggaggattgattaagccagcccaggagttagagcacacagccaataaactatgattgtgccactgcactccagcatgggcaatggagcagactgtctaaaaaaaaaaaaaaaaaactcagcattatctgtatcaaaaaaaagtgttgagggacaatacacctacttctctgaatttagacatcataaaaatgagggagttgcactaggtggtctcttcagctcaaaaatccactgtacaaaatctactttaagttttctgaaggactgttagcaagcagtttaagaaaactgtcattgtcttctctctccacattgttttttacattctactcagcaactataagtatatggtgatgaaaaatgtaagtgaagcatgtggaaggggaagaagagtgaggaggaaaataaatacatttcaagggccatctatgtactaaactcatggaagtgttttccctgcagatcctctgtagcacatctcctggtcattcattaatttaattgacaagcaagcaaacattgattgaacacttgtcacgtggacatactgaacctgtgcctcattactgaaacactaacttttaattttcatatatttaaaaagtgttgtccaaaaatataccatctatgggcacatatctttgtttccccatatattttctctttttcaagtcagtttattcataattttgcaagctttttctctacaaatcatgtaatagatagcataaatataagaaaaggctgggcctttctttttctgcccaccagtatattcttctggcagttaatcacattttctccttcatctgttattcctgacctcaaaaggtatataatactggggagcattcatggagaaaaagagtgatttcatatagataaaaaagaggtaagcaaatctatggtttatattgaaagggaattggctaacccattccatcaactctttcttttttagtagcattatttgtaaagattcatataccatgcaattcaccaatttaaagtgtacatttcagtggttcttagtatacttgcagatatatgcaaccatcactatggttaatttttgatttccatcacctcacaaagaaacattataccccttaactatgactctctttcttcccatcttactcatctctaagcaaccattaaactacctctggctctgtagatttttctattctagacatttcacatagggaatcatatatgatgtcatctttatgactgctttctttaacatagaatattattttttaagatctgtccattttgtagtatgggtccatatttcattccttcattattcagcccaatggacaataatatgtcattgtacagctatacaataccaaattttgcttatctatttatcaattgatggacatttgggttgtttttactttttggctattatgaataatgctgctatgaaattcatgtgcaaatttttatgtgaatatatgttttcattttgtggtatttctacatatatggagtatatatataaagtatatagagtatatatacttacctataaatatatgtgtatatatttatatataaagtatatgtgtatatatttatgtaaagtatatatacttatttatatataaagtatatatgcgaagtgtatactttgaagtatagtttgatgtgaggtaatgtgatgcttgtggctttgttcttttataaccagaaaagtcaaagcaatcctatgcaaaaagaacaaagccagaggcatcacattaccccacctcaaactatacttcagagccacactaaccaaaacagcatggtattggtacaaaaacagatatataaaacaatcaaaaacaatagagaccccagaaataaagccacacacctacaaccatctttgacaatgtgaatgcaaataagcaatagggaacagacaccccattcaacaaatgctgctgggataattggctgttgatatgcaaaagaataaaaccagaaacctatctttcaccatatcagaaaaactaatccaagatggattaaaaacctcaaactattaaaattctccaagaaaacctaggaaatacccttctggacatccgctttggcaaaaaattaattagtaagtactcaaaaataaatgcaacaaaaattgacaagtggaacctagttaaactaaagagcttatgcacagcaaaataaattatcaacagaaaacatacagaattggaaaaaatatatttgcgaattatgcatctgacaaaagttcaacatccagaatgcgtaaggaacttaaactaagagttgaactaccatttgacccagtaatcccattactgggtatatatacacccataggaaaataaattattttaccaaaaagacatatgtacctgtatgttaatcacagtgctattcgcaatagcaaagacatggaatcaagccaggttcccatcaacagtggacttgataaagaaaatattgtacatacatgccatggaatactatgcagccgtaaaagaagaatgaaatcattttctttctagcaagataactgcagctggaagccattattctaagcaaattaatacaaaaacagaagaccatatgttctcacttataagtgggccctaagcattaggtacacatggaaataaagatgagagcaacagatcctgggaaataccagatggaagagggaaagtgttgaagtgctacctattggatactatgctcactaccttggtgatggattcattcatacttcaaaccttagcatcatgcaatatgcctttgtaacaaacctgcatatgtaatccctgattataaaataaatttgaaaaaaaatcttggacttaaattaaaataaatagatacaaaattcatttttgcattgttcattacaaatgtacagaaatactattgatttttgtatatgaatcttgtatccttccattttcaactttctataattatttctaatagagttttaggagactgcttaggaatttctccgtatgagattatgtcatctgtgaataaagttggttttctttcttttttttccgttctaaatggccctatctccttcttatctaacttcactagctagaatctccaggacaattttgaatagaaatagtgagagcatgcatccttgtctttattctgatctttggttaattcatccagtctttcaacattaagtatgatattagctgaagtagatactatttcaagacttcaataccctacttcctggaatggttagaataactaggcagaagaataacaacaacaaaaagaagacttaaacaacattatactccagctagacctaataggatagactactccacccaacaacagcaacatacatgtattcttttcaattgctatggatcattctccaaattaggccatattctaggacgtaaagccaatcttcatgaatacaaatttattgaaatagtacaaaatgtgttctgactccaataaaaattaaattagaaatcaataaaaaatgacatttgcaaactcaaaaatatgtagaaattaaacaatacattcataaataaccattcagtcaatgaagaaatcaaaaggtaagttagaaaatactttgatgtgacccaatagaagaaaggaaagaaagggttttggtagacgtttctctgagattcattaagttccctttgatttctagtttgttaagtttttctcatgaaatgatgttggattttgtcaaatgctttttgtgtgtctattgagacaatatttttattctgttgatatgattgacagttttttagatattaattcaatatagtcctgaataaatcttagtagatcatataataggtacaattatattcatgtgcttctggacttggtttgctaatattttgttgaggatgtttgtatccatatttataaaaaatagtagtctttagttttctttctttgtgatgtctgtagctggttttggtatcagagtaatattcaattcatacataaagttggcaactgttcccttttcttctatttcttagaagagtgaataattgatagtcatctgtttttaaacgtttggtagaattcaaaagtgaagcaatttgggacttggcttttctttataatagtttttgactactaactcagtgcctacacttatatgtctaccatgattgcttatgcttaagtcagtttcagtagtttgtgtatttctaggagtttttccatgtcatctaaggtactaatttattggcatttaattgttcatagtattctttatagtcttttttatttctgttagttccctgtttcacttatatttggaacattagtttttctttcttttcattgttgatctactaaagttttgtctttttgttgaccttttcaaagaaccagcttttgattttattcgtttttgcctattgtttctctattctctatttcattaatttccactcaaatcttcattattttctttcttttgcttgtactacgttttgtttgtcctttgttttcctgtgtgttaaggtggaattttcagtttttgatttgagatctttattcttttttaatataagtgcctacagctagaaattttccactaagcactgctttagttgcatctcacaagattgggtatgttgtgtcatcattttcatttacttaaaagtattttctaacttaacttttgatttctttattgaccagttggttatttgtgcatgtattgcttaatttctacatatttgtgagtttgtgatttctaatttaatttttgttgaagtcagaacacattttatactatttcaataaatttgcattcatgaagattggctttatgtcctagaatattgtctaacctgcagaatgatccacatgcacttgaaaagaatacatatatattgctgttgttgggtagaatgttctatcaatgtccattaggtctagctggagtataatgttgtttttaggtcttctggtttttgttgttgttcctctgcctagttattctatctattccaggaagtggagtgttgaaatcttcaactattatctattattatttaattgtctagtcatctttcattgatgttattttttcctgtttattggtataatactgtattattaggttcatatagtttataattgtcatatcttcctgatagattttgtcattgtaagatgtctcgttttatctctagtagcagttttttgttttaaagtctattttgtcttatattaatgtagccactcaaccttttatggtttctatattcattatatatctttttccattcttttactttcagtatatttgtatctttgaatctaagtgtttcacttttaaaaaagttgtattttgtgttttcttttttttcctctttcttctatcaggtcaaatctactgttaatcccttctagtagatttttttattacaatcactatacttttcaactccagaatttccatttgattctttttattatttctatttattgatgtgaaattctcatcatatcttcctttacatctttaatcatcgcttctttttgtttttccaacatatttataatggctactttgacatcttattctgttaaacctaacatctgctcactcatacagtttctgttgcctatttatttccagtatacgggccatactttcctgttcctttgcatatattagggttttgttgttgttgttgtgggaaacttcccattttaaatactacaggtatttcccacctcctaacccccaacacagggtttgttattgttatttgcttgtttatttggttagtgactttcttgattatttcagtgaagtctatttttccctttctactacatcatgttaagggtctgatgttgcttctcagggaagtggagctttgggtatgcccacactcaccctggatgacagtggttttgttaagctctcttagactatttatttctctaatcacacccagctattagttgccactaattactggctgatatttctattattttcaacaatgcactggagtataatttgctgttcagactaatgctgtacagactaaggcaataaaactcaggtgcctttgaaggaatggttaccaatgtcagtgtttgagatttgttctgtccccaggaaggcacctcctaattgtctctttccttgttctctcctgcaaacttaactgccctacagtttagtctatattttcaattaatctgccaatctccttccagttgccgtccactaaaacctctatttagtttttggaagttcccttagcctaaaacttctctttgctctgttgcaaattaatttagttcctttagtaagagattaagtgctacattatggtctccttctcctcccaggcaaagtctccggagctgggagtgaggacaatgacgtacttctctccaactgacacctctaccttaggaactgagctctagtgtaggtgaagctttcattctatgagtgaagcctgattgaaagagatgtgctcccactttgactacatttacctagaacttggctttagcaataaggagctgaatgccagatgagaaatgctgagatcttgcccctcctgggtagatagccctcttactggtagctttgaatttttgctacatcagtgtagagtgaagtttctgtctcaactggaagggggttgttgtgagagtgatcttggttcaaataccacagactctcactgttattactaaatcttagctgttatttttgaatagatgtttcctcatttactgtatgtccttaggatgacttccagagactttttgttcgttgtatgttttataattttcaccaattttgctgaggtatgggtctacagagctcttcatgctgtcataacagtgttgatctggcctgttaactcttgagaagtgaaattaagtaatttaaaaagacatccataattgttaactgttcaatacatttttagggaaatgtatcagtatatcttacaccattttgaatttagactacaaaagaaaaatagatttagggttgaaacgttagaatgtgaatttatttaattttataaatcacaacttagttatgcaaatgccaagcaaaatttcaggttaagtagatcagaatggagagaaaatagatttccaaagtataaaaaccattctcatgttgtactggagtatctatcattaacattctcctgttaacatttaaagaagatctatgcacatgcttatgggggaattaacctctgaatctgtaactttattaattttatttgcagatatatcaaaagtacaaaaacctaggacttcattttgtctcattttatgcctcctattgataacctatccatgtacagtatagaattcagtttagctggagcaacactgttcgatagaaaggtttgcaaatgacagaaatgctctgctctgtctagtatggccaccactggctatgtgtggctattgagcatgggaaatatggttagtatgactcaagaacaaaatttttaattttacttaattttacctgatttaaatttaaattggtacatgtggctagctgctattatatgggagccacagggctagagtaattagctaatggtaattctgatgcattgatccatttataattcccctccctatctcacctctgtcagcacacatagaatagcactcaccaacaccacaattgtaaaaaaaatgcagtgtaatcatttcactgtaaaaataataagataggattaattgttgtatcccagagaaaccaagtatacaagataatttaatggctgtcaacagagtagatgttaaacagtagaaataaaaacatttagtttatttttattatttctaccattatattttgaagcaatgtgcaatttaaaataaaaatatacattcacttataaataaagtttcagttgggtggatttttacatgagagatccaagaaatgttgagcaatataataggtaagtttcccaaactctgtggcaggttcaatgggtggtagagtcagactgatagagaacagatgttttccatattggagtcagctagaggtggaggggtaagctagttgtggatatcggtgagaggatgcttaaggatataattaaatatttaagttgaatgagaagaaaatgaaagtgagcagagactggtagattgggagaaatttgacccaaagaattggacacctttatgaaggcaggtaacaggcatagcgggtataagatattgaaagtttgtaaatagagtaagttttaattagataattgaaaattcagattttgtatttttaaaaaagcattcattatgataacaagatctaggatatgagcttaagcctgtctggctgaaatggcatgaaaatgaatgtcatttgaattgaggagtatgtggaattactagaccagatatttgtttaaggacatggaattcactcaggacagggatgccatttaggatggaaaggaagactgtgggctaggtgataagtacttctttaaattctgggaagtggacaataggtaaatgataaagaggcaggagcagggactgtttaattggataacacagatttcaaaggaagagttattttcacgtaactgtagaagaataaatggctgtaaggggcagtgtaggtctaggagtatagcagcccaatgtctagaccttggcaatttgtaggatttggacaaccatgcagtataaatcgacaaactgcacaaataaggcagggactcagggaaggccaggttcaacatatggcaaggagaaacaggaagcatgttctgttctacaaaaattaaggggacaaagagatgtgtctgctatggaagggggtggtttcagagggtacagctggaagatctgggagtcagaggaggtaacctatgtgaaagatatacagcataataggatgtttcagagaatgagtgaagtgtgtacattttgggtagtgaccagttatgatctgatgtgagatacaaaaaaatagctcacttctattttctaagagaggttattttgtaaagttgttttgctgtcactaaaactgacaacttctttatcttcctgtcacaattacaataccttatttgatttttcatcatacacttcaaagtctaaaattatcttgcttacttgtttttgattatcttccctccctagtacaagatagtttcccatgagaacaggatcttgtgttttagtctgctactacacctcagcctctagaacagagcctggtacataacaggtgctcaataaatatttggtaaacaaaataatcaactcatttatattctgatatgtgatcatgagtgggagataagactaaaggagttatacgttgtttaatgaacattgcacgtgctatatagggcataatgatcatgtcacagctataatgaagtaacagtaaggaaattgtaacacaggtatggtaataccttttattttgtcagacatttacacagtgctttaatatgccaggaactattctaatagctttactaacatcaactcttttattatgaatgatgaattgttatacttccctagtaattccttaaaaacctgcttcgtgctctataaatatttggcttcaatctttgaaatatgctgagcatgagaatgtcatcttccctctgtctctacagaaaataaatattataaaaagattaagcaaatatccttagtagatcttcatttgggctactctttacaaaattgaatctttctttttctaatgccacacaataaccattcaatagatgctgtattaaaagttatctcttggcttggtttctagcaagctattttcattgtcttgtgtaaatacatgtatgctataaatttttcgtatttttttactcagctggttcataattattaacaaatgccaccattcaacttactaggatgcaatggtgaatggcagcgtatccctttaatatcactaaccagcctatattttaggccttcattcagaatgacttgccaatgatttttttttttttttttttttttttttttgtagagatggggtctcactctgtcacctaggctggagtgcaatggagtgatcatggctcactgcagcctcgacctcctgggctcagttgatcctccccacctcagcctcccaaatatctgagactacaggtgtgcaccactatacctggctaattttttgtagaaatgggcttttttatcttgcccataccagtctcaaagtcctgggttcaagcagtcttccagttggcttcccaaaatgctgtgattataggcatgagccactgtgcccagtcttgccaataattttaaacctctattttaaataacttgataaaaatttccaaattgtacttggttccattgcccgcagaaaaggaagaaggtaaaatatagaggctttcaaggcctttttttgtctttgacagaattccaatatatacagtgtatataccatgtggtgtagatgtcttcttttccttccccagaggatgcatatctggctatcttgggtgggggcgggaaacaagtgtctgcatccaggtaatcaattttactcactcttcagctgtgtcaatctacatcatctatactgggttgagcctcactgcctccaaatctatagtaatcagtgggggaatgctttttgtgtttcaagagtccacaaagaatctcatgcccatgaggagagtaactatgaaagaggagctgcccccacctctcctgcatcttcttacatgaacagggtttcatagtttggaccatttcctgggttgagtaatctttcccaaaagaaatgatcaggtctcaagtatctttttatgtttgaacatttcacacttctagcatcctctgaaactgaaatctccacctttgtctggttttatggccactcccatgtatagaagtagggaggtctagtgatagcctcttggggtggggaagagtggaggaataatattgacagtaggcattttacttctctggctaagggtttaatttcctccgaagtgtagagtcaattacaccttgccctatgacagtgtttttctttttcaaaaacaaccttatggcctgcataagaatttcatatttcattaaaaacatttggaccttgttttctaacctggaaacccaagacttcatatgctaagtgagcccttccccctgtgtttgacctcctccaggaaaatggcaggaaatgacgagtttcttcttggttcttgattttcttctttggttaggaaagtagtagggtagtgtatgtggagtggggagggtgctttcacttcaccaagctccgctgataaaagcagaaatcatctggcttcagtatgcattgggacatcagggtggctccaagtctcctcaattcagcctgcccactggtgcctacctactgctatgcccttccttctaggtggctgctagtccataggagatcaaccgtatactgggaaaagaacagtgtttagattcaggagacctaggaataaatcctggctctaatacctttgtcactttgggttaattatttaatctttctttgtctcatataattcatttataaaaatgagaacactgatactttcctgcagttatcgttgcttttggaatgaggattatcacagattctaaatccaaacacacattgtgtgctgcaaaggatcaaatatgggataattatattcttttccagcttaagaccacaaaaacaggctttgcctcattattgtgcaaaccataacagttctgagctcctacttagtcagggagtgaattgttttcccctgctgttctcctccccatgtcattcctagaagctttagtgaatgctttccagtcattctcgtgatcaagtgtcattcatctatggcatgcttctgtgaagctttcagggtcactttccaactgctgtatgatgtactttccaagctccgatcatgatcacggtcatttcagcccctatcccccaaagcaaataggccctagtgttatttttcagtctagcttttatggtatactttatatacaacaaaattcaccatttttagtgtaaagtactatgagttttaacaaccatatatagttgtataactaccaacaaattaagatatagagaagattcactataaaatcccaaaaaatatccccccaaattcccactttccattctggagtacatgcctgccccaatccctacccactgacaatcactaacctgttttttgtctctatatttctgcctttttcagaatgtcagatcagttgactcacacagtacctactgattagtatcgcaatatatggatctaccacaatttatttaccaactgaagcacatttgtgctttctccagtttttttgcaattataaataaagtggctgtaaacatttacaaacaggtttttgtgtgaacttatgttttcatttattttgggtaaataagtgtgagattttttttgattctataaacatatgttacattttttaaaaatgcccaactgattgtcaaagtggctatatcattttgcattctggcaggtaattctttccagtgactctacagtagtcccccgatctttggtttggctttccatggtttcagttatctggggttaaccatggtccaaaaatattgaatgcaaaatttcagaaataaacaattcatgagttttaaaccattctttgtcctcagtagtgtggtgaaattttgtgctgatcctctcagtcctgcctgagttgtgaatcctccctttgtccagtgtatccacactatacatgccttctgcccatttgtgtttttataaaaagttcaagggcatatttagttatttatttagctgtttggactattctgtttcatgtaaattgacacctttacattatactttggtttacagttcctctgagttgtaaaataaaacaatattatttgcttttgtccaaaaagtaatagatcaatactggatttcaaaccaatatattgaatagccacaattacagtttttaacaaatattactttcaaattcataaatataagagaatataacatggtttgcctcataaagtacttgttgatttacataattagaaagttcgtatcaggcacacttgcttttcttccttgatttattttattttactttggctaaagaataaagccaaatcattttattttcataaatggcatattctataaagccaagaggtttatttgatgaaaagtttatgaccatttctagtgattatttattcatctacatatctatatcccaatttcttcatctgtaaaatgtaagtaggtgataaccattggctctttgattactctcggctcaagtctatgatgaggcaatagatttagagagattaaggaagtcagaactttgcattcattttaaatctacttctgtatttcatgcctttcccaacatacaacaaagatagattatggataaaactttacccactaatctgctgaatgtacagcatttgctacaaaactaaaaattttgatagcactttatttcacccctattgtgacagttagtgggttttgctataatagaaaatattgaggaagacaagacatgagggtcttttcttattagcctagaggaaaaacaaattggagtgactaaaaggcgatttttgaggatcaggtctaaccgtgataataaatcattggtaagcaaaagtgatggtcctgaaagtttcatcctctcaatagatgacataaaataatttgtataggattgaaaaacacaaacaaaatgtgaaatacttgataacattttatgtaatcaaaatactggaaattaagatatttagaaactcacaattatgtgcctatcaaggttttatttccccattggtcagaggatatgtgctgcctcaccaaatacttttagattcctgaattcctcaggtgtcgaaaacattaccctcaaaaataacctcgtgtgagattttacaactgtggtaaacatttagagttgcttctttaaatttttaagaaagttttaaagctaattgttaaaatagttaatgttactcatttgatgcattatatcatcttttttctttgggaaataatttttgatcagtttttgttctgaaacactatctcatttattcctcattataatcctgtgaggtaggtactgttattattctgtttttaatgaaggatctcagacttaggtaaaataaatcgtccaaggtcacacaaataacaaaagggggaaggggaatgtgattgcttaagttaaagatagtccttgtacaaatgctaacactttgtaaaatcttgaggccatatcacccttttccagagtcgaaaaaatgtagaattcactaggttttgtgttattgttgttttgtattgttttacttcaaatgataaaattgaccagtgtattagtctattcttgtactgctataaggaattacctgagactgggttaatctaaggaaagagctttaattgactcacacttcctcaggctggacagcatctgcttctggagagccttagggagcttttactcatggctgaaaggcaaagagggagcagacgtcttacatggccagagcaggagcaagagagagaggaggggaggtaccacacacttccaaacaaccagagttcatgagaactcactatggtgatgatagcaccaagggggaatggtgttaaaccatgagaaaccacccccatgatccagtcacctcccaccaggccccacctccaacactggggattattattgaacatgagatttgggtggggacacagatccaaaacctatcaactattatagcattgggaagcttgcaaattctcatgcaccaacctagagggatatttctatgtaagtctgatatatatggtgtctatcctgaggtatatttcactgtatatttgaccctagggtaagatatgagtgaaaattagatcaatactcattctgcattctatttcttcataatttgttgtgtactatgaatgtattgagatttcgtttgttggtaaagaaataatgtctccttagtttctttgttgttgactagatattgccctaatcaagaaaacattttttttgaccctctcacatgtaaggtatgaggactcgatttcctatgatcctggaaaatattttttcacaggctatatcttggttgaaacccaaatgatttctttagtctgtctcaaattatgtgcaagcaaagaaatacatcatctttaatacattactttgtaaattaggcattagatttttactattttttctattgttaatttttaattagtactacttaaaattgtcaatatttgacttttttttgactcatataacaagtctgtatgattcaatctaacatgaatgcaaaagggcaactaagcttttggtttaacttcatgttaaagaatatttttaaaaagtgagggaagagtgaaaaagaaagccaaagattcagtgagtggtttgaaagcaacaatgtttaaatatatatgtaaatatatattatgcatgtttacatatatgtgtatatgtgtatatacatatgtgtgcatatatgtgtatatgtgtgcatatatgtgtgtatgcacctcctatttatatatatttatacatacacatacatatacctaatatttatatttggtttcataaatatgtgtatacatatatatgtgtgtgtatctgtgtgtgtgcatgtgtgtgcgtgtgtttataccacctatgtatacctctcatctacctcctatttccacatgcacataccaactcttctactatcaacatccctcaccagaatggtacatttgttataatcagtgaacctacaatgacacgttatcatcacttaaagtccatagttcacattagggttcatgctcagtagtgtacattctatggctgttgacaagtgtatacttatattatagtatcatataaaatagtttcagtatcttaaaatcctttgtgctctgcccatttatcccttcctccccctaacccctggcaaccactgatctttttactgtctccatggttttgccttttttcagaatgtcatttaattggaatcatatagtatgtagcttttaagattgtgttatttcacttagtaatatgcatttaagattcttgggctgggcacagtggcacacacctataatcccagcactttgggagacagaggcaggtggatcacctgaggtcaggagttcgagaccaacctgaccaacatggtgaaaccccatctctactaaatataaaatattagccacgtgtggtggtacatgcctgcaatcccagctacgtgggaggctaaggcaggagaataacttgaacccgggaagcagaggttgcagtgagccgagaacgcaccattacactccagcctggggaacaagagtgaaactctgtctaaaaaaaaaaaaaaaaaaaaaaaaaatcccattgtctggatataccacagtttatttacacatccacctgctgaaggatatcttgggttaaattgtgtccttactgattttctgcctgttggatatgtccatttctaacatttgttgaagtctcaaactataataacagactaatctatttctccctgtggtactgttggtgtttgcctcatatattttgatgctctgttgttaggagcatacacaatacagattgttctgtcttcttggagaattgacccatttatcattaagtaatatccttatttatccctgataaatcttctggctttgaagtctgctccatctgaaattagtatagctactccagcattcttgattagtattagcatggtgtatctttattcattcctttatttttaaattacatgagtatttatatttgaattgggcttcttgtggacagcatgtggttggatcttgatttttgatccactctgactatctctgttctttcattggtatatttagaccattgacattcggagggattattaatatagtttgagtaatgtctactatgtttgttactgttttctattcattgcctttgttctttgttcctgtttttgtcttgccctcttttcctgccgtatgcaattttatttgagcattttatgtggttccatgttctctcctttcttatcgtatcaattatatttttatttttactgtttctagtgcttgctctagagtttgcaatagacattcacaatgaactcaagaccaccttcaaataagactatatagattcatgagtagtacaagtaccctataacgaaatactcctaattcttccctcacttctcttatgttcttgttatcacacatttcatttatagataaactatggttattgtacgattgttgctagtattattaaaacacagttttatctgttagataattaagaatgagaaaaaatatttttatttgacctccacttatgcttcctctaatgctctttgaaaaaataagtccaagtcattaacctatattatttccttcaatctaaagagcttcttttaacatctcctgcaagccaggtctcctggtaacacattctcttattattttctgttttttagtctcagaaagtattcctccttcattttgagtgattatttttcaagatacagaattctagttagctggggcttttttaatcatcactaagtatttcactccaatctttttgtttgcctcgtttctgagaagtcagatgtaatttttatctttgctcctctctagctaagttgttgtattttctggcttctttcaagatttttctttatcattaattttctgtagtttgactataataaggctaggtgtagtttttcccacatttttcttgtttggtgttttctgaatttcttggatctgtggtgtggtgtttgacatttttttttttaatttcagtcattgcttcaaagattctgttttttctctttttttcctatcttaattatgtatatttcataccttttgtggttatcccacagttcttacatattctgttctgtttattcagaatttttctctttgcttttcagttttgaaagtttctattgacatatcctcatgctcagagattctttccacagccatgtccagtctactaatgagcctatcaatggcattcttagtatctgttacaatatttttatctctagcatttttttaattttctcaaaatttctatcccagaatttctatctctatgcttacattatccatcagttattgtatgttgtctagtttttctattagattccccagaatattaatcatgattattttaaatttattgcatgataatttcaacatgcctgccatacctgcgtctggttctgatgcttgttctgtctcttcatgttatgcttttggccttttagtgtgctttgtaaatttttgttagaaggaatacatgatgttcttggtaaaaggaaatgagataaacaggtctttagtaatatatttgtaagatgtttcatgggaggggaagcatcctatagccctttgattaggtcttagtctttagtaaacctggacactagactgtgactttcacaaatgcttctcagtttttctcttttattgtctttccactcttcttggtggtacaggatgcctagagcaggctagagttgggtaattttcttcctccaactcaactggactctaataaaaccacagcaatttaggctctggtaaaataatttctcttaataaccggaaagaacagaatgctctggcatgtttcaaaatggttacttttcccctccttttgctataagcctaagggtatttttatctgatattcactgttaaaaacttggtagaaattcttggaggtaaaagctcacaacttgtgaggacagctctatgactaagttctaagtttccttggagtttttccttttcaggcttgtccatcacactgagcttccagaaatttgtcaattacaatttaggttttccttctccaatagtggttcccatggatgtgggtttctgctttagtgagttgtgattctctctatctacctgtttgtctgtctgattttttgaatagcaatctgacctagaacctcacttctgtgacaaatccaaaaattgtttatttttcaactgtttagctttttagttgttaggatggagtggcaacaactaagctccttatatgttggagtggaaaccaccaaaaacattggttttgaatacactatataataattgtttgaaaattttgtggcatttaaatacttgtaattcattaaaattgctttcttatgaggcaggtcagaagcaatatctaatttaaacactgaataatttatggtgttatgagccgacagttccctttccataattctaaaattcaaatggctctgagaaattaaagcttttgcataagtttgtggcaaactaattttttggcaaaagctaaccagaatgaaagttttttatggtctttatccattttagtgtaaatactcacataattttctggagaaatatcaatatattttataggatgcttttggagtatttcaaagtacatatttatactccacatgctatttctaaatacaaaaaaaaaattctaagttcctcaacatttatggtaccaagagctctaaataaaggattgtggacctgttatagtatttttaatgtcataatttaagatgtgtctttaccaagtagtacattattttgcacttaactagaggtagaataagataatatggttaagacattttataaataggttaaaaaatagtcagaaaatttaatttacaattttaaaggataatattgtatctggcatgttgcttaagcataaataaatctcaaatttcaataaaataactgtaaagaatattgtcatattttagttatcattgtcttctttttgccctctcatccttctgttactacctctaaaggggaatggggggtgactttgtttatgttttgtcctggtccttatgaacaagcatgtgatagtgtctatttgagtcttccttctaaggttttacctctataatctaaacattcatctgttttatatattaaaaaccaaagctctacaatcaaccatttctcacatacctaccttcaagagtaaatgtcaaagtaaaatagtctgtgtttctattagcctttatttaatttaaatttatagttcagatcctctttttcactccacagttaaacatcaatattgcccaaacaattatacaccaggatttattaagcacttgctctatccctgtagttgaacctccctatttacatgttctacatcaatggattcaattaacctcaaatgaaaaatatttttttaaaaaacttaaaattaacaatataacaataaaaatgatagaaacaaaaatataataattatttaaatagcatttatattatattagatattataagtactagagatgatttaaagtccagaggaagatgtacataggtagtatgcaaatactatgccatttatataagggacttgagtattcacagactttggtatcagcaggggtcctggaaccagtctcccctggtactgagggatgacattatacatctaaattaatacttaataaacaaacccagaatatcttgggtgcttgctttgtatcaataactcatgcagttataattcctcaaggaatttcataagttctcaaggaagcttaatttcttgtaactaggacagataagaaaatagtaatttagaagataaatccttcttatggaagagaaaaagtatcatcagtagagacctgactaatggaatactacactcactagctctttctcttgacacccaagtctctcctttggccagaatttggccatttttcctatcctactctaccttcgcaagactctttgtctgtactggtatatactggtatcagtcactttgatatatgcatatgaaatttctagaaaaggtagacatatatctttcaataaatattaattttggaataagaaaatataaagagaatattcaacagatagataggtaaagaccagtttggcagatagcggccaactggtcaccaacccaatattctcttcctcctgagcacacagttaaacagcatttccaaattttccttgcccatgtgactgagttctgggcaatggaaaatgcatggagagaaaaatgcagttccagcaccagcccatagcaactttccatgcatgattcttctttccttctctactggctggatacaaaggtctccaaggcctagacttccacagtgggaaggagcctaggaaaccacatgtgaagtctttttccagtcagggaaaacatgttaaacttcatgagaatgataaccagactgtatttagtcactgagattggggggattttgtctgtaactgcagctagcattatactgaccaatacatatatgaacatataatttaatttaagaatatatttatatgtcacatgacgtcaacataataaatatcaaaccagatattatctcagttaaaccttgtattcgataacatagtaggtatggatgggtaggcattgaagctagatgtatgagttcattttcatactgctgtgaagaaataccctagactaggtaatttataaagaaaatgtggtttaatgtacttacagttccacatggctgggaaggcctcacaatcatggtggaaggcgaaagaggaacaaagtcacatcttacatggcatagtcaagagaacatatgcaggggaactgtcctgtataaaaccatcagatctcatgagacttattcactatcattagaaaaccttgggaaaaactctcccccatgattcagttgcctcccattgggtccctccatgacacgtggggattatggttgctacaattcaagatgagatttgggtggggacacagccaaatatcactaggctatagagtttaaattgcaactccactattcactctcatttttctcactgctaaagtgaatgtaatagtatctacctcatgggatctttgtgagaatgaactctgatatgtgtaaagtactaagtactgttctggaatataataagcacactataagaccaaattatcattactgtatatattattattattaatgaggatgatgatgttgctatcatttactattagagttatttttaaaataagacaaatgaaacaaaactattctatatgcaacctaagagtagtgcaaaaatagatgccaggctgggcaattccattgttaagcagcaattgtcttttaatgtctaaagcctaggccagtgaaataaatatttatataaaactacttccttttgaataaaaatattaatagtgccctcaaatcaatacaatattataattatttgaattggtggtgatgaaattaattactgggagttcaaatcaccttcaaggctcacctctaactcaaacttaactctaaaaggagaaaaatgtagttctataaatatgagataacagtatagtaaaatcagacttacagaaattcattaacagtatgcataactttttttcatcatcaaacatcaaagtactttcccaaaatctaaatgatattcacaataggcatcctgagatctgatatttttaccttctactatttcaattgtggaaactaaactgaggtatcaaaagatgaagtttgccattttgggacttctacttcagaatgataggtaataactttaataattgtgtttgtaacttggaaaggagttaaatctaggattgacattttaaacttaaattggttaaaatatatgtaaactctctcaagaaattcttttacaaggaagtatgtaatagcttcaaataaaatgcattgcttttgacatatgccttgtattcctaaatgaaatctgcagaatggtggagcaatttttctctgacagaaaaccttcaataaccatatagcacaccaggcttgtgtgctgtgagacggtcacaaggatcagttgttctaaacccattttataaagacagcttagcccctccccagcccctgacctgtatttctcttctcttctgccttgaaatgtgtttagtgtctaagattgttatctgttcagtgtttaatttctctgtgtgattgtactgcctgtctctaaggccctccatcctcaaaaaactctttctcataagatgatttcctgtcattaataaatcaaattacattcatcagaataaaaagttttgtgttcagcaaaaatccatgacagctgtgttctcaatgtcttccttactattcagaagttgtgtccaacagtgccttctgcaaaggaccaccattaactgagagaaaagggagagatgcttgacatgagggcattttatttccatgtgtattaatttcttcaccaattgcctttttaaaattaatttatttactttttttacatctgggctggagtgcagtggcgccaactcggctgactgcaacctctgcctcctaggttcaagcaattctcctgcctcagcctcctgagtagctgggattacaggtacccgccaccatgcctggctaatttttttgtatttttagtagagacagggtttcactatgttggccaagtctggtctcaaactcctgacctcgtgatctgcccgccttggcctcccaaagtgctgggattacaggcatgagccactgcacccggccttttaacaaccccattgtattgtgaatagtgagctcagtcttgtgaaaacaaatacatgagagtagatcagagtaaaggaaaagaagaagatattccttaccttataattagatttcttctttgtacaaatggtaatttttaatgaaaatattttatttctgtttttatggtggtataaaaaagtctcataattttagcatcttaactatttttaagtgtacagttaactacattcacaatgttgtgcgacagatctccagaaccttttcatcttgcagaatggaaacactatacccattaaacaagaattcccctttgcttccttctcccagccactggtaactatcattctactttttatatctatgagtttgactggtctagatacctcacgtaagtgaaattatcagtatttgcttttttgtgagggtcttatttaacatagtgtaatgaactcaagattcatccatgttgcagtgtgtgataggatttccttactttttaaggctgcatagtatcccattgtatgtatataccacattttatttattcattcatccagccatggacagttgaattgctttcacctcttggatactgtgaacagtaaagccatggatatgggtatgcaaatatcttttgagatcctgctttccattcttttggatacaggcacaccttgtttcattgtgctttgagttattgtacttcacagatagtgaattttttttttgcaaatttaagtttagaggaaactgtgtcaagcaagtctattggcaccattcttctaatagcatgtgctccctttgtgtctctgtgttgcattttggcgattcttgcaatgtaataaactttttcattattattgtatctgttactgtgatctatgatcagtgatcttcagtgttaatattgtaattgtttttgatcaccacaaacttctcccatataagatgatgaaataaataaatgtcgtgtgtattctgactactccaatgactggctgttcccccatctctctccctctccttgagccttctgaagaaaattaaaagtcctcctccattattcatgagcacatgaataataagaaagcaaaacagctttattgctgatatggagaaggttttaatagtctggatagaacatcaaaccagccacaatattcccttaagccaaagcctattccagagcaagtccctaaatttcttgaattctgtgaatgctgggagaggtgagaaagcttcaagagaaaagttggaagctagtagaggttggttcagaaggtttaaggaaagaggccttcaccagaacataaacatgcaaggtaaagcaacgaatgctgatgtagaaattgcagcaagttatccagaagatcgagttagtattattgatgatggtggctatgctaaacaacagattttcaatgtagacaagatagccttttattagaagaagaagccatctaggacttttatagtcagaaaagttaatgcctggcttcaaagcttcaaaggacaagctaactatcttgttaggggctaatgtagctggcggctttaagtggaacccaatgctcatttatcattatgaaaatcctacggcccttaagaatttgctaaatctacactgcctgtgctctataaatggaacagagcctagatgacagcccatctgtgtacagcatggtttacttaatattttgagcccactattgagacttactggtcagaataaaagattcgtttcaaaatattactgctcccgcacagtgcgcttggtcacccaagagctctgatggagatacacaagaagattaatgatgttttcaggcctgctaaccaacatccattttgcagctgacagatcaaggagtaattttgactttcaagtcttatatttcaggaatacatttcccaaggctgtggctgccatagctactaattgttctgcttgatcagaaaaaggtaaattgaaaaccttccggaaagaatacagtattccatataccgttataaacatttgtgattcatgggagaagatcaaaatagcaaaattaacaggagtttggaagaagttgattccaaccctcatgaatgactttgagattcaagccttcagtagaggaagtcattgtagacgtgtggaaatagcaagagaagtagaatcagaactggagcctgaagatgtgactgaattgctgcaatcttatgataaaacttgaacagatgaggagttgcttcttatggataatcaaagaaagtagtttcttaagatagcatctactcctggtaaagatcctgtgagcattgttgaaacaaacaaataaacaaacaaaaagatttagaatattacataagcttaagcttaattgattaaacagcagcagagtttgagaggattgactcttattttgaaagaaattctactctgggtaaaatgctatcaaacaacctcacatgttacagagaaatcttgaatgaaaggaacagtcaatgaatgtggccaacttcattgttgtgttatttcaagaaactgtcacagccaccctatgcttcagcaatcaccatgctgatcggtcagcaaccatcaacatgggggcaagaccttcttccagcaaaaagattatgacttactgaagggtccaatgatttttggcattttttagaaatagagtatttttaaattaagatatgtgcattgctttatttagaactagtgctattgcacacttaatagactacagtatactgtaaacatagcttttgtatgcactgggaaacaaaaatatttgtgtaagtcactttattatggtattcactttattgcagtggttgaaaacccaacctgcaatatctccaatgtatgcctgtatatacccagaagtgagattgctggaaaatatggtagtcctatctttaattttttgaggaagtgctatactgttttctatgttagttgcacgattttacaatcccaccaatagtgcgcaagggttccaacttttccacaacatcctcaacacttttttaaaaatatatatatagttgccatcctaatgggtgagaggtggtagctttttatagttttggtgtgcatttttcggataattagtaaggctaagcatcttgtcatatgtttcttggtcatctttagagaaatgttgatttaaatactttgctcattttttaatcaggttatttgtttttttttattgttgagttgcaggcatttttatacatttacttttagctttaaaaaattgcagcataccataaatgatttaatctttggactaaatttttgtttaaatttttttttttttttgagacagagtctcactctatctcccatgctgaagtgcagtggcatgatctcagctcactgcaacctccacctcccgggttcaagccattctcctgcctcaacctcccgagtagctgggattgcagatgcccaccacgcccagctaatttttgtactttttagttgagatggggcttcaccatgttggccaggctggttttgaacttctgacctcagatgatccacctgccttggcctcccaaagtgctgggattacaggtatgagccactgtgatcagccttaaaaaagtatttttggttcaaatgttaatttacacatcaaagagtctgatgtttgtaggattcataaattttagctgtagacaacaggcttattacagcagaaaaaaaaatatttatataaagtaatctctggaaggggtggagaatcaggcttggaacctttgcaggcaggaacagtgccccggtttactttgcagaagttacctgatgaaagtactttaagactgagcactagtaattacccctagaactgtacattttctcttaggtctcccaacatcacttacagttctaaaaattagaaatacttcctttgtaaaatgcagttcacaagagtaaactgaaaatatgacccctctacaaaaatacatcacctcaaaatttcattgttattgtaaacagtttcaagtctaggatctctgaataatgtcctttttttcttctcatttgatcattttcctatcttgtaaaggacagatccaactgcaaaattctcatacacagaacactttctacaaaacaatgggggaaaagagaaggttcactgtcacttctgtatgcatttgagttgctgctaatcatcccaatataggaataacttccagaaatatttcaaccaacaaacgtaactgcattatgccacacaggtgtttgggattacagattctgatatgaacatgtgctattattcctggtatgaaagtataagggaaatggaaacaggagaaacaaaaactgaactgttttcagccatagtttagaatgaaaaacattctttcacgttcttccaattattatacatgtaaaatacaaaatgtaggatttgtatctcaccgacacctagtcaaaatgaaaaggtctgtcctttgaagaaatattgaataagcacaccaccttttccttcttttattggaatcccacacaaaagactttatctgaattcttgtgtttgcatgacataaactcatagcaggcccgagaacacctaacactcttttcacacattgtatggatctcacctatcgaatttctctcagcatattgtatcaaacatataattgtccagatgaggcctggaaactccgagagaaataacatacaaagttgccactgacacacacatacacatacacacacacacacacacacacacacaaatagcttgaagaagtaagttttccagtaacgaaagttctatatatagatttatctaacattctgtataagttatgaggataatgtgatctgtataagttatgagaataatgtgatcctacagtttaaaacttttaatttttaaagtataggccttattatttgaattataggccttaattttataataattttgtgtatttcttcagaatcattggtcattctacaattcatacataaaagaaagtaagtatgtcacatgaagccaaaataatgaaagactggcataagcttaaaaatgtcagtatgtcaaagattcaacaaaacattaataaacaattttttcaaccatattttatgggaaagataaaaataaagtgtcaaactgatgagatactgaccagtttatttaaaaaccaaaggtcatatatactgttttgttgtaaactacaatattttcaacaagacaaatattacatatctgggtttttagaatggataaatatattaagaactctcaaatatcatgaagattccatggagctcataatggctatacttatttgaattacatgtaaatcaaacaaaaacactaagaactcaaagtgtgttcctcagactttcaggagctgcatcacttgggctctcgctagaaatcaaaattcttggaccccactgtagacctactgaatgggtccagtaacttgttttaccaagtcctttgggcgatttcaacgcatgacaaaatgaaaataacactgctctagccagacaatatcttgaaaaacaaggcttaaaataatgttctctatcattttgaagtgcctaaaaaatgtagctgaggtttaaaaattattaagcggaagagattttcattggcaggttatgataaaaggatttatttttaaatgacaatttcatgggaatcttcaaagtaattgttaaatttgatctttttttttttttttggacaagcactggaaaaatgtcaaaatgcaatgtcaaatgtgacttatttgtccaaaattgattaagaagaattaatgtaaataatgggaaagcatatacaaaatggtaaatgagtaaaccagataccatataccatctatggttatacaaatgaataattgcagattcacatgcagttgttaagtaataataaaaagatatcttgtgtgcccttcacacagtggaatgtgacatttaaactgcaatttcaattttgaccttttggaaaaagctgagaaattacagactcctaatttggaaatatatgaagaagcctacatcattttgttgtctatttatttaatacaagattgagagcacattcagataaagtgctaatgtaatatgaaaaaaataaagatgaaaagtgaaatataaagaatatttctctgataatgagaagtgagttgcaataaacttcagtccatatcgaaggtaatatttctttaggaggaagaaataatagaattaatgaagaggaatgaattatattatcatattgcgagaagatttaagttgcatgttggatttgacaaaaaatattgatatcaatgaagaaaacataagactcataaacgctgctttaatgaaggcatcaatcactgcgcagggaaacttaaaatgtcctgaaatctcatggttcagacatgaaaggaacttgattaaaggtttccccaaactaaacataatctaacagtttgcatgatattagcaataattaatttgaacagtaaaaaacataaactgtcaagaataaaagacattttcattagacagaataaagactgaattatttttctattctttcaatagaatatattactacataactgttgtcgtatgaagaagcagtcaaagagcatgcagccaagaaaaatgggaaaatgtcatttatttttgcatttgtgttgcttgtggcacttagaagatttttttaaaaaattagattcccggggtacatgtgcaggtttgttacatgggcatattgcatgatgctaaagtttggggtatgattgatcccctcacacaggtagtgagcatagtacccaataggtagtttttaaaccctttccccactaccctccttcctcctctctctagtagtcttcaaagtttgttgttcaaatctttatattcatttgtacccaatgtttatattcccttataagtgttgacatgtgctatttggttttctctttctgtgttaattcccttaggataatgacctacagctgcatccatgttgcagcatgatttcattattttatggttatgtagtagtccatgatgtatatgtaccatgttttctttatccagtccaccactgatgggcacctaaattgattccatgtctttgctattgtgaatggtcctgtgatgaacatataattgcatgtgtctttttggtaaaatgatttgatttcccttgggcttgtatgcagtaatgggattactgggtcaaatagtagttctgttttaagctctttgagaaatcaccaaactgctttccacagtggctgaactcatttacattcctatcaacagtgtgtaagcattcttttttctctactgtctcgtcagaatccgctatttttttattttaatttttatttatttatttatttatttatttgagatggagtctcactctgtcacccaggatggagtgcagtggcacgatctcggctcactgcaacctcagccttccgggttcaagccattcttctgcctcagccccccaagtagctgggactagaggtgcccgccaccacgcctggctaatttttgtgtttttagtagagacagggtttcaccatattggccaggctggtctcaaattcctaatcttgtgatccgcctgcctcggccccccaagtgctgggattacaggcatgagccaccgtgcccagattattttttgactttttaataatagccattctgactggagtgagatggtatcttattgtggttttgatttgcattttgctaataattaattatgatgaagattttttcatgttagccacttgtaagtcttctttagagaaatgtctattaatgtcctttgcccactttttagtggggttgttttttgttggttgaattggttaagttacttatagactctggatgttagaactttgttggatgaatagtttatgaacattttctcctattctgtaggctgtctgtttactctgctaatttgttttgccgtgcagaagctctttagtttatttgggtcccacttgtcaatttttgtttttgttgcagttgcttttgaggactcagtgataaattacttgccaaagatgatgtccacaagagtatctcctaggttgtcttctagaatttttatagtttgagatcttacatttaatccactttgagttaatttgtgtatgtggtgataggtagtggtccagtttcattctcctgcatatgggtagccagttatcccagcaccatttattgaataggatgtcttttccctattgcttgtgtttgtcaattttgttgaagattggatggttgtaggtgtgtggctttatttctaggctctctattctgttccattggtccatgtatctgtttctgtaccagtttcatcctgttttcgttatcgtatccttgtagtgtagtttgaaatcaggtagtgtgatgcctctggctttgttttttgcttagaattgctttggctatttgagctttttaaaattctatatgaattttagaatagatttatctaattctgtgaaaaatgtcattggaaatttgataggaatagcgttgactctgtagtttgtttggggaattatggtcattttaatgagattgattcttccaatccatgagcatgggatatttttccatttgcttatgtcatctctgatttctttaagtagtactctctttgtagaggtcttttacctcattggttgtatatattctagagtatttcatttttgtgtgtggctattttaaatgagattgcattcttgatttggctctcagcttgaacattattggtgtttgcattgttgatttggttctcagcttgaacattcttggtgtgtaaaaatgctactgatttttatatgttgattttgtatcctaaaacttcactgaagtggtttatcagttctagggtccctttgctggagactttaaggttttcaaaatatagaataatatcatctgcaaagagagatgatttgactgccttttctattttgatggcttttatttctttcttttgtctgattgctctggctaggacttccagtactatgtggaactggagtgatgagagtgagcaaccttatcttgttccagttcttaatggaaatgcttccagcttttgcctagtcagtatgatttttgctgtgggcctgtcatagatggctgttaatattttgaggtattttatatatttagaagctttcaaaaattttgtaatttgtggttattctcctcatcttaaataaatagtaactttttaatctaatgtttcaaaacagccccctctctaaattttataactttcaggctttacaaaatgtggattcatccaatcatgtgaacctaaaacaatgctctaaacatgaagtagtgcttcttaaatgttgttgaataagttaatatagaaatagtcaaaacagaggggatataaaatcaatcacaacatttataaacttaaattttattttgaaaatataaaatatattttaaaatagagactacaatgaaccagtagtactcatcacctaaactgaacagtgtttaagactttcccacattttttaactttttaactttttttctgtagtattttaatttctcttaagagacagggagtattagtccattcttatgctgctaataaagacgtacccaagactgggtaattcataaaggaaagaagtttaattgactcacaattcagcatggctggggaggcttcaggaaacttacaatcctggtggaaatggaagaaaacacatccttcttcacatggcagcagtaaggagaagtgctgagcagaaggggaaaagcctcttataaaaccatcagatttcatgaaaactcactatcacaagaacagcatgaggaaaacctcccccatggttaaactacctcccactgggtctctcccatgatacatgcagattgtgggaactgcaattcaagatgaaatttgggtagggacacagccaaaccgtatcacaaggtattgctctgttgcccaggctggagttcagtggcaggatcatagctcacagcagcctgggattcgtgggctcaagcaatactactgcctcaccctccccagtacacttctagggatgcatgccaccatgcttgtataattgtttttggtttttggttggtttgtttgttttttagggatggaggtctcactatgttgcccaggcttgtcttaaactcctagcctcaagcaatcctcctgctttgacttcccaatgttctgggattatagacataacctgaccttctatagtattttaaagcatatctcaggcattcttgtcgtatcatctccatatcttaacttgtatctctaacaagtgtggatattttgttacatatttacttaaccaaatgttaaggtattacatctaacaaaaattaataattccatgttactatatattttcctcatctataatagaatatttttacttttctcaaaaaatgtctcttgctttgggtttctttgaatcataatacaagcaagggttacacattttatttgattatatctcttaaatctcctttaatatatcttatttctctatcagtaaattgttgcaaaaccaaggtcaattgccctgcccaatgtctcatattttggatttacctgtgtgctttctctggtgtgatttaacttctctctctgccatttttcttacaaatggaatttagctccagacaagtggttctcaagcttgactgtgcctcagaatctcatggaggtcatgttaaaacacagattgctgggcctacatccaaagttgatcttgggagggagctgagcctttgcatttctaggaggtttccaggagatgctgatcctgctagtgcaaccagcacattttgagaaccactgtttctagattaaagtttgggttcaacttctcactctttctcttccttccttcctatcttccttccttccttcctttcttttctttcttttctgtcctttcttttctttcttttcttttttttcctttctctctttctttctttctttcttgatggtgagtttacttcttgagtagtgccatgtgcttcatataatatcagaagacacacagtgctagatcattacacttataatgatactgacattgcttgtaaactcactgatgaataactgatattttttaaaggaaatataagatagtttttaaaattgcaatttaaaaaattaaatcatcttcagtgtaactcaaaagtgtaatcagtcactcactcagaaaacgtttactttattccttctatgtgtttggcattgtgcaatgttataaagatgaaaggtgcctatgtgactctcccctcaagtaactctcagactgcatggaatatgaacatataaactcgtttgcatgataccttacgatcactgctgtgacatagatatgcaaagcacgtgaaagcatagacacctggcactgaattcatgtgttcttccctcatttaggacataatgaggaaacacaggttcgccttttttccactggctgcaaatatcagacacagctcccaaccgcagctgtgtctaacaccaagcactgtggtgttgctatctgagccatcctaggctctgactacagataagcaaacaggtcacgtttccttcaagtgggaattttcaaggcctaatgctggcagttctattgggatgggaaaatttgagaaaaggaaaggtcaaatgtattctcagaagcctctttgctgaggaaagccacgttttatcatgggaggaataagcaaagtatatagctaaggcaaaaatctacccttatccccataagccaacacctgtgttttgaggataagcatgtatccatcttccatagagcctaaattgtggttctttaataactttggatctttattttagttctggtttggatttttttaggtttatacttgaagtaagaaaacaattgcacctgaaatgaaggtttcctaggctatagtcatccaaagttcttattaaggcaaggcaggcttatggggcaaatggctgccatatattatatgggttatttggagacctatagtaacttgtattccctgagcctatgataccattccaatactcacattcccccatttatgaaaaccaaatagttttatagaaaaaagagaaattatagtcagtcttgaattgcaatctgtaaagctcatgtcttggattctgtgagggatatgtgttggttcttatctcagactagtttgaagaaaaatgcaaattaatatggaaagtagagaacaattatagtgtttaaatctgtgtcaaattaagtaacttggcttcacagtttagggaaagattgaagtagactagggtagaagctggaatctttgtggaaagtgaacttaattcggccttaaatgataggtcctaaatggtaagagaggcaagaaatgataatccagctgaaaagcagaattcagttataaaaatttcagtttgttttgtagagcaaaataacatcaatcatccttgagatttagatcctgaatattttcagatctgcaagattgcacgttctttaaaacttgagtaaacagggctatacattttttactgttccaactggttctgtgtccatcaaacagctgcattgaatgaattagcccagaatatttgcattcaaataaccatattgtaacatttttaaatatttcacattgccattcaaaatatattatgcttattacattttagatttaaaaagatagacttttcaaacctatggaatattttccttaatatattttattagctaattccaccttgttaatgatgtgaactgtaaagatattatgctgatttttaaaatttaactttactgttaatgtcagagatctgttctagttttattattcctccactgactatatagttatgatatgttagtatgatccttaaagcatgctacacatatgttatcattgcatggaggcagttttgaacactgtcaatttaaattttcccttcataaaggttattcactatcattttactttgttggtagattcgagaatatctcctgctgcttacaaagatagtattattcatttggctggggccatctatatatttgaatgatcatgtgtgaaatctatattgttaatctggcttctaatgattggtggctgtgccactccagattcaatctcaggtgactgaaactcaaatttaagcaaaatttaaaagcatgtgggtgggtggaggatgtatggtattatacaacttaagggtccagggcttaatttcagtaatagtgagatctagatgcacaaatgatgctatcacgactctatgctccttagctctgctggattcagcttgatttgactcaggccagccatctcacgtagaggcaaagatgcatgcttagcatagagaaggttggtacccaagggattggcaattttacctggtagagcgaggggccatttctgaaagaaaaaggtgctgggccagcaaacaagtaggagataccataacaggccccgtggttggtcttggacacaattatagaagttaatgaaaattgtctggattggcattcatcttcctttacacacttgcctttctccttctactttggcaatccactgagattccaaaactcaacattttcatttcttttgctaactcccatgatcctccaatgctgaaatcctgtgtagtgttaccagcccagtgatgaatggatggcctctacttaacttctctaccactcttctcagtgtcggaggttatctcatcaagttaaattaactgagccttaatgaagtcattgataatgtgaataatataattactactcagggttctccagagaaacagaatcaataagatatataatatatagaataaagtattggctcatgagattatggagactgagaagtgccatgatctgctatctgcaagctgaatatccaggaaagccagtggtggagttcagttcaagtttgaagccctaagaaccaggggactcagaattctcagtaagtctcttagctcagcagtcaggcagaataggcaaattttccttccctctgctttgtattctattcaggccctcaagacactggattatgcccttaggccctcccctcacccaccctacacacacactgtgaagaacaatccgttttagtgaatccaccacttccactgccaatctcatccagaagtatcctcacagacacacctggaaataatggatagccaaatacctggacaccgtgtcatcctgtcaagttgacacataaaactaactgtcagatatattaatatcatttattattattatgtatatatttgaaaccatttataatgtaatatattaatatattaatactagttcttctgtgaagttattatgtcaaggttaaagctccatgtaaattttaagatgcttcattaatacaaaacattattaaataggctccagcccatataaaatacatatattctattagattggctcaggggaaattcatagttagatgttaaataatgaaatgggtttaatatgtcttgtcacagaggtacttctattttaaaagttggtgtcaagaaatacagtgccttaggaattgatttctactgatattataacaataacctcataagtagtcatgctatagagacagcatagaatagtgttaagatgataaactcagagccaaactgcatgggttcagatcctttttcacttgctagctatgtgacattgggaaaatcacttaaccagttcattgtaaatgagtcatatatttaaaaggcttagaatagtgcctgatgcataatagctgcccataaatactttgttgaatgaaaattgctctgtggcagagtatcttggcacaaaaccaaatgtgtagtgatacttaatgtaaaggtttgctgagggaagaaatgattgactttgagatagatacttggagttggagcaggagattttagaaattactactaaccatgttggtcttaaaagttgtatgttattgctgtttattaagagtttattctcttaaatatatatttttcctaaaataaatatattccagaatatgtttagtcctaagttgaaaaaagaaagcttgtcactatttccttctatagatgttttgtatttaagaaactgtaattatctgcatttgattacaatagtgtatctttattctactttatccagcaaaacaaataagcaaaactgtgtatgaagcactaataaattatttaaatagattctattatatgtggaaattttatagcaagtgataattcttcttactcaagatttataaattgcagcttactgttctataagaaaatgtaaataatgtatccaatttatttaggtggaatagcagttttaggggaaatcacttataaaatattttgtttaaagattaacatgtacataaaccaatgcatattttatgttctttcaattatacacacatgtgcatacacgcacacacacacacacacacacttagaaagaaaaacttcatatcgaggagaaaaccttatgtgatcactcttagctcttaggcagacctaggttcacacagtagttatataatctcattctttagataagaagaggttgtttagatgttctaaagctgtttccttatctgtagaatctggaggataatcctttctcaccaggttgctatgaagcttaagggaaccaattgactaggtatgcagttgttctaagtactaatttcttctctttacctctcacttgcttcattatttgctttattgtatgtgatgtctcaaaaaatatcttttatatcatgaaacagaaataaatagagaatactcatttttaaatttgattacatcttagtttagtatcttatcaaaactacctagaatatgctaagaagattgatcaatgttatggtctcaaagagtatataaaatagtttgtggttatgctgtacatggctgattcaagctccttatcacaccatatacttggattttctgtatttccaggtcactcttccaaacttactctggaataatcctagagggtcccaagagaaaatatttggaataagtgtaatcccaaaatgaaaagtgatcaaagccagtttatttattttaaacagccccattaacatgtagatatacttatgcattgtattctgacaacggaggctctacgaaggctatctatcagctgtttcatgtgaaaatgaactgttaaacattttcaatttttcagatgtttaattatttttacatggaaatatgtgtcactattatttaattgttcttgctttaaatttgttgtgtcttttgaatggtgttagaatccagaaacattaaacttaacagaggattaggaagaaacccggttcccattttctaaacccaaatcagatgacctcttaagactcatagacaattaatacatttattttaaagcatgttaactaataactaatagtcaataatattttgtatagctcttgctgggtaagttaattgaacatccctcagtttccataactgtttaaagaatactaataaagttagcataatactgatatgatataatacaatattatataaagtgtaatactagtactaatattgacaatgctctgaggtcatattaagttctaagaatatgtgactcaatgattcccttgcaaaatcgattacagattgcttttttatttggaatatgagtattgagaggaaacactaattgctcttgcatagctaagttcaataaaactttctgcagtgaaggaaacgttccatgcagctaacaagtacttgcaatgtaactagtgtgacgtgaccaaggaaatgaaattttaatttaatttgaattaatttttatttaaactaaaatcaccacagctctagagttatcaactcataaacaagatttttgagaaacagttgaaattaaagatgaaacataaaacttataagcttgtgcaatgaatttaaaagcagttatttcaccttctcttttcagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgtgagtcctgccacactccaagtgtggtttaatttttaccacttcactttcatgttgttgcttgttggtaaatgtggatattttagagacatgtttgtttaatttacagaaggatttaaaaagtacatgaaacactctttgccaaccagacaccagaattgctgtgttttgtttagaattttaaagccaaatgtgagctgaaaactggagttgtgttgtgtgagtatgcatgtttacctagtggatggagggggcctcagcttagtcctcggaagagtacgcccgtcatctgttatttcttttgctttcctagcttatctaattatgcatgacaaaagagtcagttgtttgatttcagagattagtccactgtgcagtgtagcaatgtaacagtcgtattcatcattaatagagattgtaaaggggtgctcaattgtcacagtctctgttatttcctgatttttttctacacgatagtctattcttttctgtatgtttgtctgtctgtctgcctttctctctttttctctctattttttaatccaaccatttagaaagtctttaaagagtgtttgcttaaaatttctggctttccattgcaaagttctccagtgcataaaccagaaaacagtattttcctatcggtaatcaagacaggaagctaggaacagaagagagcagccctccaaacccttctcctctgtctccctcttgccaacagatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatggtgagttttgaattaaaacacagccctagactccatcaaaatcccacatgtaaaccatgacactattttttttccatcttagtgtctttttttatttttttccataatgtcaggtcaaagggggttttgtttgctcgtttgttttttccccttctccttttcatcttcctgaagtatttattctctttgtttatttaataaggaatatcttgtgagtccagtgctcacagaaccacgtggtaccatgtcacagaaaataaaggtgatatgagtaaacaccagtgagaaccagcatctcgttcatatttgttttctttctgtcgctactaaagtgggcatgaggttatttaagttgtgaactgaagcaccagtcactgcttgagatggcatgtaacaatggcattctctaaatcaaaaggaaacagatggatctacctaggaataccattttcatatcaatggttaacaaattgcagtccttgaaagtaaagatcagagaatgaaaatgcttaggtgaaatataaggatttgttgtactggatatgtttatttgtgtgctggtggatggtaccaagagctttcatattcaggtggatgttatagacagatgagattatgttgacattagattactgatagggtggagattagaaatcaatgatttttaaactttattctatttcaccttgctctaattgttacatctagaaataacgcacacatttacaatgtatgcctttcccattttcttatttcctatgtatgtgagcagtttcgaaattttgtgaaaccatttttttcttgtcttatttgagaaggcgccataaaagcctaggctgttagtgtttgtgatctgtgaatctaattagttaggtgtgattgggtaggaattggtgtacataagagaggtttcagagtatgtctgtaccaattatctcaaatcataaaatctccagagttggatataaaaggccatgctttatgaaagataaatctaataaatctaatgtttgatcaatactgtcttcattttcattagattttagaaacccaatgagttaagtaaccattaaattaatctgtagacaaatatatcaaattgttattgagtctgttgtgtggctttgatgctcaaattcagcaatttctctgaagaatatttattgttccagaaggtgtcctgatcttaaattcatagtaatagaaaagtccataaaaagcacagctttatgaacaaggtagggcatctccaataggtgacatgatttctgttttttgtttcctgaatttgcattatgagactctttcaccaaggtgcatacatgtatttctgtaaaacccaaatgacaatatttagggaatatataggagacttttagtccattgctcctcttgtatcccaagttttgccactgtacctagttaaaccaaatagcctagatatttaaatttaataatctcaatctattgaaaaattacctagatagttgcttttaatgttatgcaattgactcttttcccttgtagaaataaatctcatgcaagtttttgtattgtcaaggtcattgtttactaggctgctaaatgtccatgacagaaaatctgatttcagaagtttcttctagaatttaatgcaagaaaaataattgttttcctgaggaaatggaatgcttttacctgttctcaacaccgggactgtgaaccttaatatgttcacttttgtgccttactgccagggagttcagagccaaactctccattgtctttctgtttaatttatcttggtggagacaactttccttggtggatttgataaattttaatggaaaagaggagatataaatttagaaacaaataaataaatagtctaattatgaaagcaccagaaagcaagcctttcatgtttaggaaattatatgtttttttagaggatttaacttttcgatcatttgcttctatttgtcaaacacagctcacagtagagggatcagaccttgttttcaatacatagtttccctgatatcataagcatgggaatagctacagtgacacttgctattaactttttaacaaatagaagtattataaaaatgaattaagcgattctttaaactgaaaattatatcaaaaatatacctagcctttcatataagatcttgataaaaactttataatacctatgtagctattaatattcttcacgcaacatgagtataactatgtgtttctctttgtcaccaattaacttaattgatgctaattagcaaacacattttgtttgaattttccacttgctatttgtactaactcttgccctctgtcttatagttgtcatttaccatcccccaggttacattcacattctctaagatctttatttataatctttatttttaattgcatcccatagtatcctccttattaattttgatatctaagctgatttcacatttcttttaccttttccacttcagggatctggatctctctttcacctcagtctttattagcatgaatacaccttggtcttagtcatcactccaagagcctgaacaagcaatattaaaaatttcaaagttttctaaatgttctcaagtattctctggtgactttacagaggaaaagtcttgttcttatttgccctggataaataaacctcacatctctgcccccatataattctaccttcttcagagcattgctccatcaaccacccctactgttttatatattcagttttcccttttcaatgagaggaacatttaatccctttttcctaaaaaaaaaagttctcagatatcaaaaaaagttacatctcttcttcttcttctacaatctgagttcatctttctttctcaggtttctcgaaagagcattttatactcacagattatacctattaccaccaaatcctgcagtagtcccttacattcagattatccagactatggttctcaccactgtgtagtcagccgtatagatctgcaaggtctgcatctatggattcaatcaactaattgaaaaatatatggggaaaaaataaggggattgtgcctgtattgaacacgtatagacattttttacttgtcgttattccctagacaacacagtataacagctatttacatgtcatttacattgtattaagatttataagtaagctagagatgatttaaagtatatgagacagtgtgcctaggtaataggcaaatactatgccattttgtgtaatggacttgagcatcctcagaggtgctagagccaatcccacacagataccaaaggatgactctactgaattagttcttataaagatcacatgaccacctttgcacaaaactcaaagactgcatattcaactaaagtatatgctctttttcttgaaacttgttgtttctgttcctcctcatttactcttacctgcttttgggcagttactacagttccgtgtttagccacgtactgtatatcaccctaaccacaattacaaatgtctgtccttgtgtacagtgtcctattctcaaagtacaataccaaaaatatacaaatctttggtatttaattccaaatgtcagtcggacactagggcaataattatatcacactgaactctatattctccagcacctattttctccactgatattccacttcatttatcaagacaccagtaagttcctcttgacttgcctgctgttaatagcaccatattgtcatttttaccattgctcaaaaatgtagaatgagatttgactatttttgtgtcttgtatcctaccacttaatgaattctgcttattcctcctttattctgtttcccaaataaatcttacagtttccaattttatgtgttcttattttagttctagtctttcatacctcatacctgtactcttgcataatcctaactcaactccctactttcctcttaccctcttcacacacattatgcctaggcagaggcagaaatagggtttgtaaaacctgaagattatatgacttgagatctttttgaaaagaaaagtaatacacaattatgagcaaaaaattaggtagaaaaaatgaatgtgtatttgcagtttaaaaatatcctacacaaaagaaatttagaaaccactgaaatcttgaagattaaaacgcttttcttctaacatctcgttagacaattttcagacacacttacatataaatgcttccagattttaaagtggctttcccttcctacctagaatgcttacaacatccaggaactccagcacttaagaggctcatccaattgaggcatcctatgcctcacttttattgactttatgataaatctgcctttgctcctagagtagtcttcctcaattttggctttgataatgtgaaactctgtcatgttagaacattttgtttttttgagacggagtttcactcttgttgcccaggctggagtgcaatggcatgacctcagctcaccgcaacctccacctcccggtttcaagccattctcctgcctcagcctcctgagtagctgggataacaggcatgcaccaaaacacctggctacttttgtatttttagtagagatggggtttctccatgttggtcaggctggtcttgaactcccgatctcaggtgatccacccgccttggcctcccaaagtgctgggattacaggcgtgagccaccacacctggcagaacaaatttcatatttctttctataatgttttagcgtatgaccttttgaaactgagagacctagcttcaatgccttgcttagttcaattcctgtacaagtgtggtgtttctgagtctcttctaaaggatagggctattggggtactatatgtgatcatgtatgtatatgtatagcatataatatggtacctttctatcccttcttctggtatgttcaaattatattctttcaaaccttagttcatcatatgagactgctgctccttctttcaatgggttgtctcttggttcactaattttttatgacacaggaattatgggtacctttgctcattgtttactaaatgcattaaaattgaagaataactaagttgtaaagaatatagccaatatatttttcagagctacttatcactgcatcttttactttaagcaaggtgttgacctgagcctcatggggtatgttctcttcacattcacacaccccacccagcttcccaccacaaacacatacaaatcctgaatataatataacaatttaaaaaatattcagctaagctcaaaagaaagaaaaggaaatttccaggtacctgaaatgagtaggaaactcttagccaaaattgtaagccctttggattgggtaacaacttagaaagatagaaaaagtaaatgtagaaccagacagattagggctggggtatgaatgtccacccaagttcaggatacatgcattttagtttgtaactagataggcatataaactgagaaatgtatataaagctgggcccaagaaaggctcattctctattttcctctctatgaaagtggaattaagaaataacctaatacgactttcaggaataaaaatgacagacattataagcattgaaattaaaaccttactaaatgggttaagtagaatataatattcaggcaaggagaaagtaaactggaacacagaagtatgtaagttacccacaggaagaaaagagaagttaaatatgaaaaagaaatgaagatggataagagaatgataaagatagatttaacaggcattccagaggagaaattacaataaaaaggcaaattgaaaaagataatgatgaagaatttttcagaattgattggacctcaatcctaataacagataagtagattagtcctaaacagtatacatttttttaaaaaaaactcatacctagggatattatagtaaaaccacagaagagcaaataaattcttaaatgtaccagaaagaaataacacattatctacaaccgaaaaccagcctgaacaatttcttcaaagtactaagaaaaaaagtcttcaagagaaactacttttaattcacaaatcaatgcccagctcagctctactttcagagtgagggggaaagaaatacttcagataatttctgaggctactactcatacagcctgactgattccagaggaatgcttctataatctaagaagaaggaaactgaatccaaaaggaaataataaaaaattagcagcattggtgagcatctgaagaaaagcacctggatttgatagtcagtgagccttggttcttgtctgtgcttttccagttgctacttgttgattttctatctctgagctttggtctcaccctggaaaagaaaaatggaaataatagctcttatcctaaaaatgaaaaccaaaagcacttgaaataacaaatgtaaaaactcctaggacagtacctggtacacctagtatggtacctggtgtgtgtgagaaatgtgataaaatgcaatttaatctgaaattgaatttcacagttccctttcctgggaaacctgcactgtcaatctgttgagctacttgaaggactaagtcaactaggtctttgtctatttaatcctcactgctagctaacagcagcctcaaatctctctttcttctgtgtgcaaattgtactttgtggtacatcttttgtagttttattttatcctgtcttatattgctgttatccatatatgggccttagctcttcaagaagaaattatgttccttgagtactatgcttcttaacttgttcatctctgtatcacccacaatgtcttatataatacaagtagctgctcatgaaagttgctcaattcatgttgaattcaactgaattaaaattgctgaatgaaagattgagtgactggatggatatttactaatgtgcttctttgtggtagaaattagttgagagataagataatttttattgtgtgacatgagtttcatagcatcttgcaactggtattttaattttaaaagctactactaactgaaaatatagcctaatatattttaaatgtttagcgagtttttttttcacaaaagaaaacagttatataacatttaattttaactctttttaaactattaaagtgttaaaaaaaaattacacttgatcttaaccaaaaggccaagaattgatacattaaaaaaatttaaatctatttaacaattagtgggaataggtagtgatattaattatatgaatggaattggtatacacttttattttcacaaataaataattaggaaatctacatcataatgtacaataattgtaagtttatataacactcaactttcagaatatatacagtgtatatagtatatacaaaatatattttatatatttaacataaaggatcatgtagttaaaattaaagcatgttatttcagttgttaatttagttgatcctgtgtcttgatcagaggcgttgtcagctgttattaactaaactgtgtttctaaatcttcaactagaagacttattaattccccatgtagtcataaaagatcattattaatgaccaataatattctaaaaataaggccaagacatagatcattaattcataaatgaaatatttctaatcaaagcctagacaaaggttaactggcttatattccacttctgttaaaacacactttcaaactccttttagtcaagagaattttctcaaaacaactagaaagttcaagaattcacacatagtagatccacgggctccaatttcaggggtttgctgctctcctttttcttaattatgcttctcttgtgtattgatttacatcttagacaacttcttgctacctgtttggaaatgttgccaccagcagttccaggcctccattcttaaaactcacaacccaagatcaatcctccaactccaggtctcagttcccaggaaagaactttgcttggccctatttggattatatgtccaccttcttggatcagtcattggaaacaaagtattgagttcccatgattgcccaggacgaactcaggtggccagggttaattgaggaaggaactttctttatgacttccatcaaaaccatgtggaatgaaataaggacagttgaactactattttagtttgcattcaccagtttgtctgaaatcttggcttatctatggtttggaatttagaacttttcagttttgggacatgatagagtgcatactaggtttgttgcataacacccatagtggggcctagaaaaacatcacaaataaaaatatatcagtatttctgcagcaaaacatatgcatattcacagaaattaggaaaaagtaaaaccttaggtattcatttatcagtttttttctgccagctgagtttatcccaagtttctgaaaaatcttttaggtttatacaatattagagcttcagaattgattacaaaaggttgtgagtctactaaacacactcttaataatgcacttccgtgtatattataaagttataacctatgtgctaggcattgtaccaacttgtcaagtaaactctatgatggcagagaccatattggtatcttcaaatctctaaacttggcacagttcctatcatatataaaagtgcttataaaatatgctagtgactttatgcacatttctcatggacttctaaaaactactccataatgtggagattattttccttatttataattttctgactgaacctcagttttgtcatttttaagaataaaaatagtgatacctagcaggatgactgagactcagattaagttgcaaaaatggtcacatggcaagtagctggttatagaataatattcagttcagtatgacttagttgcagactatctctattccactgctgtataagaatgaaaccacctgcttaatagaaggaatctcttagaacatgaaactttatatatgtatataacctggacaattatgcctttaggtatagatatgccacttgggggagatagtgtgtgcgtaccatccaaattacagaattcttaataatgtgttttataaagtaacaagtttaggaggaataatcttaattcatcacactacctaaactcttgactactgaattattatcttcaaagtgctcattctacttacaaccttgggtggatgtcacagttgctcccaatctggccttaactaatacttgattaagcttcacattaactgtggagtctgaagagcatcaccacattaacccatgaccataacctgacattcttaaatttctttgtacttttttgtaattgcaaaaatcctgtggcatcctaaatgtacagctgaagttcagaggactctaaagttatttcatgtatagttttagacccacaaaaatggaagtttgttggtgtgacggtacattttatcaacatatataagaagagacacatttacatcatgccaacagcaattacatcttaagtccccaattaaaatgtgactttttaaactccaaaagctccatgtgatggtttagccatctgtttaatgacacaactgccactgatttgagcagtgataattattacaataagaacagtgctggagaaagatcaactcagatcccagttagaatgtcagttaattatgaagagataattaatgagggtaggtaccattatcttatatacagagaaataaatatgtaataaatattcccaatccaggtgtagatcatttgaagtgtataattaaatccattgtaaactaatattttaaatattctaagatatagatagagaaagagagagatagatatcaaatagtatatgtatttactgagttatcttcagccacaggaggtgttattttcataagttatctattgaatttattgcatttggtttttgcatcaaaatattcctatctccaattattacatggaagctttgtgttttatggccactcttacaaatgtaagagggaattttcagcctcattcctggtgaaatctatgaccatattccctaacacactctgctaattatgttttagaaagaccatactgtggtgacattagaataagccctcaactgtcaaatgtaatgatgaaaaggagagttcagaaggagatgattctcagagcacgtactaaacactagttttaaatttctctgtaatattacttttataatgagaaaaatttattaatttccttctcactctctcgatattagtacttttgagttgttaagtgatagaagccaaattatagagaaatttttttaaacttttgtctttgctatcttataaccaaatgctgcacacttgagccctgtgtgtattggagagtattggcatttattattggctcattaatattagaagcaaagagatttttagcatgattgcctcacaggagggaaagaacttttctgcctggctcctgtattctcattttgggcatgaaattaagctttattatggttcgtgtatagtaatttattgacacttctggctgtataaactttaaaatcttatgaattcagattacatcagttaagaatttgtggcataacttagctaagttacatttttgtctttgtgcttttaatgaagatcataaatttcataatttatagaatttataggaaaatatattaaaggacttcaaccatttaactgaaggatgctagggagatcttgatatattctttgctaaatgcaatgtgtggttagctgtgattgaatttcctcacaggaatgtgtagtatttaagaattctagatttatttaaactcagtggggactttgttgtaaaatgtgaataatagttcactagggattataactcccaattcatcatcagacttgaatttgaattcaggtatttccacatacatcgctgcataattgtgagcaagttgcataatctctcagaacttgaatgtaggttatctaaaatatgagtaatataagtacttttctcaaagattgttaaggagattaaatttgataataaatctaagcttttggtattaatacctgaatgtcctaagcactcaataagagttagatattattaacatttatctaaaaattaaattaggatggtactggatttctatttggaggtacacattattgagatatagtacattctctgcaaaaatacatttaaaatataattttttgattgtaacacagattttatgatttattctgcctttttctccaatgagcttgagttaatgatgattataacacattcatgtacatgtctacctttgttctgcttatttttttagttgaaaacaatggtttgtatatacagattttttaaagaattttttgttttattaatgacaaagtatgtaaaagtactaaatatacaacagaatttaggaaagtgagagttgaaaattgggagacacgaaacctgagttctggatctagttcaatttgtccttttgcaattacttaatctacctaggtttcagttcttcaaagttgagagaagaaacttgtactggatgacttctatggccattgagagttgtcaacttatgatcctacaataaactcagtacaaatctattttcaaaattatactgtttatctacgggaagtattgaatcatgcatctttgattctacttattttttccactcaataggatagtgtgcatggttgctttatcttgaagttaatttttaaatattaggttatcacatgaccttaaaatatatctagttctaattagccaggacattactctagtttatgagaagactaatttcacacatctaggaaagatccaactctccctttcatcttttctgaaaaggaaattacataaattattatgcataacaacttttactgctttagtagaagttgagtagtaaaagttgtttttaaaaattaataagaatttgaaagaaaatgccatgaaataatattaattgaaggggtattttacttacgttctccatgttaaacgaacttttatgtatttaagttacttgtgtgcctattgatacaatgtaatcatttagtaaaattctatagctttatatattcctaatttttaatggtgatagctgaaaaaaagagagaaaaatcgaggtaacgaagaactgaatatgtctctctgaatcccatgtggctctcaataattggattaagaaaaggatggttgctgatattttatttagattctcttaatttcatccctggaaacaaaagatctaataatgtactttataaagatataaactctcactcctatttgaataatgctaactacaatcaaataatttgttttattttttgataatgtaatgttcttattcccatttttcctataacatctttgcctcaaaaattagctcaatcaagaaagatatcaatgagtatctaattcccatgtagttggactacatttttgagccaggcagtgatcatcggttaatgagactgattttatagcttaatttatttggctttggactacaatattttctttatacttagtgaagtagagaatgaaatgaagaagcaatatgagttttgaaattatgcttacatctttatggcaatttattttagatttgcctcatttgaccctcttttctattacaaatacccagtcctggctttctaatttccttctcaaaatgcttatattgcatttttttcctgccacccatggacctcttttcttcttttttgcaaaaatgacattccaaatatccaactgctttattgtcaaagtagtgtaaccatcatttgagatgtcccatggggttagcagaagagtatgtaccctatacctttcctaccttttgcctccagaggctactttggagggggagtagtgaggaagtctgctaaggcagctgcagaaattgcttcctagttcacccaaggtcagagcctggtctctgtctacactgtacaaatttaactatggagtgtctgttaaaacggtgtggtctgaatttagctgttctagaatattatttgagatgtaagccctgtgttcaatttgctgagacacactctacatgccagagttggtaaaatgagtcatgtataaaaaaggtttgtttcaattcctttagaaaaaaattcaaaaggtctcaattagttcaggcttctaataaatagcattcacacatattttcgtttgaggctttgaaaaccctaaggtggcatatactgtatatgctatattcccaaaagatacatttatttcataatttcacattattttactacctcatttggtttaattttgttatttctcatctatcatttgcttatcttaatttaaaaaaaacttctatattattaagtatttcatctttcagttggatgactttgcatgtaattatggaaaaaagaatgaaaatcataatttttgttatggttatcatgaatgatattgagagctgcaaacaatttacagttaatcatgagcttagttggagaattaattctttctatgtgggctacatagaagatggatttcaacacgtccctataaaatatcagctcatattttataagtaaaacaaaacaggcatgtacacataggcaaacatatctcacatctaaagcactaaacctttaatatataaaaatcattgtaggactgactttttagtttttaattatttatatttaaaaccattgtaatcacatcaattgggtcataatttagagtgtaaatattcataatatttcatattaagactgtttgacatggtctgagtgtctattaggttttttaaactctattttagccctgtcacttgtttttgttttggttttttttgtgcatgtcatatgttgtagtagaattaaagaccttgttttatttgcaaaatccagtcagcagttttgccactgcctgttcaaactccagcttcatgacccaggctagatacttgtgacaatggatctatgggaatgaatgatggatctgtgtagcaacgatagctttaacctctaactagctttcatttttcatctttacaatttccatttcctctttctattgaaacaagttcagttgaaataaatggatattcctgcacatgttgatgatcctgagagctcttctgagaatagcattggcctgttaatgatactgttaataatttttttcatacttttctctttttttttttagtctcgacctattccttcccaccttacttcagcagttgcagagagtatcttggcttcagcttgtgagagtgagagtagaaatgccgccaagaggatgcgtctggagagacagcaggtactgaggcatcttgaagtctggtgaacaccagctatagcaaatgtagttcatttaatttgatttatgttgaagagtaaaagctcttgaatggatttaaagtacacagagatatagtttttgtgtccttatgatatgaatttaaacttgaaaatgtgtgttcatgtgatcaatgaaggtcaaagaacaaaatgtttctgtggcgaaaatgaacagtagcaaaactaacgagttatgattctgtttagtatccaatttaaaggtcaattacttattaagaggttctagctgatcatttccaacagctttgtaaatttacctcatgacttatgagagtgacctgatcatgttcatttcgaatgaaatgaaccaacctctccttaatttcctctggcctactaccgcatgccaatacatgatgctgagggtggtgacagtacaacacaactttgaaagactagaaagtcacaaaatgaggatatacataatgaaaattcatgtcttagacttaatctctcattaattaatcatttattgtatgccaattgcatgtcatgtttcaatatcttttttctaaggcatctgtgtattggcgatgtttcttttttttgtactttgctcactggtgtttccctcagtctttcccttgggttatctgtatatttctgtttctccttctcatcccagaaatgtctttctctttgttgtatgtaccccctttctcaagtatccatagtaaaaatctaaattatcacatgatatactaaatattctgcataaaactttgccacattttcacttgtaaagtatttttacaacaaatggattatatgctttatattgctaattgaggatgagatgagtcaagactaaagtaagttagttcaattttgattctacagtgagccaatggacttcgaggaaaaaagcaaaaacgttttttcatttcaggcttagaatactttaacatgtttcagaattacatcagcattgatttgatgtgtttattattaaaatgtcatgtgctaataattctaaatgccacaaaagatgaagccttcagttaaatgaaaaatacagtattagtctcagataaaaaccatgtgaaaatgtcaatttagaatgtgctaatcgtgccaccagtgttgattcacatatatgtgccctctgttaggagttttatcattgttatatctataaaatgtatctatacaatgagttataacactatgtataataccatctggcatagtgattaggggagcacattctggaactaaatagacctggttttgaatctcatctctaccttttctaattgtgcaaacttcaccaagctattccagttctgtgtgctttgattactccatatgaaagacagcaatagtaacagtactcatcctgtggagtcgttatgagaactttaaatgacagattcatgttatgtacttagcattttgcctggtgcatagtaagcatcaataaattcagtctagaaaagactgatgctagctgttttgtcattgtattgatatcagttaactagaagcaggcattaataacactacctcagatactgaagtttcaaaggcaaagtccatttgagaacagatgctagttctagaaattgagattgtagaattctgggattaaaagggctctcctggttgttgtctagctatacatcccacctaatgtacattctagaatatccctatatagttttaatcatgtggagttgttataaaaattaaatgacttattcatattatatactacctataatatcactctacaatattccccaaagctggtcatcagctgatatttgatccagtcacttaaatactgttggcctaatctgtaaaatgggacatacagatatcagattcatagagctgttgtgaggattttataagtcaattcatataaaagcattatgtatttcatacgtttatatgttgttaaagatatatttgttatttgctttaatatctcaaatctcacactggtactaaagatctgctatttactgacacactttcctactgtcagagatttatcattgtttttgaaggtctttacattgagctcaaatttacttcatagactttctacccactgaagaaaaacttctaaaaataattaaaaatgggacttcttactcctgcaccaggagtagggactagaatgaatgaggaccagtggtccttggccctactctccatattctctcctttttatatgtcctcatatatttattgcaaggctctgtttctaggaatggaggatatccaataatatctccacacaaaaaaatactgttttctttttttcccccgtttttgttttgttttgttttgttttgttttttgtactttaagttctgggatacatgtgcagaacgtgcaggttacataggtatacatgtgccatggtggtttgcttcacccatcaacccatcatctacattaggtatttctcctgatgctatccctcccctagcctcctactccccgacaggccccggtgtgtgatgttccctccctgtgtccatgtgttatcattgttcaactcccacttatgagtgagaacatgcgtgtttggtttgctgttcttgtgttagttggctgagaatgatggtttccagtttcatccatgtccctgcaaaggacatgaactcatccttttatatggctgcatagtattccatggtgtatatgtgccacattttctttatccagtctataattgatgggcatttgttggctccaagtctttgctattgtgaatagtgctgcaataaatatacatgtgcatgtgtctttatagcagaatgatttataatcctttgggtatatacccaataatgggattgctgggtcaaatggtatttctggttctagatccttgaagaatcgccacattgtcttccacaatggttgaactaatttacacttccaccaacagtgtgaaagcgttcctattcctccacatcctctccagcatccgttgtttcctgactgcttaatgatcaccattctaactggcgtgagatgatatctcattgtggttttgatttgcatttatctaatgatcagtgatgatgagctttttttcatatgtttgttggctgcatgaatgtcttcttctgagaagtgtctgttcatatccttctgaatgggcaaaaactggaagcattccttttgaaaaccagcacaagacaaggatgccctctcttaccactcctattcaacacagtattggaagttctggcaagggcaatcaggcaagagaaagaaagaaagggtatttaaataggaagagaggaagtcaaattgtctctttgcagatgacattattgtatatttagaaaatcccattgtctcagcccaaaatctccttaagctgataagcaacttcagcaaagtctcaggatataaaatcaatgtgcaaaaaatcacaagcattcctatacaccaataacagacaaacatatccaaatcatgagtgaactcccattcacaattgctataaagacaataaaatacctaggaatacaacttacaagggatgtgaaggacctcttcaaggagaactataaaccactgctcaaggaaataggagaggacacaaaaaaatggaaaaacattccttgctcatggatcgaaagaatcaatatgaaaatggccatactgcccaaagtaatttatagattcattgttatccccatcaagctaccattgactttcttcacagaattagagaaagctatgttaaatttcatatggaaccaaaaaagagcccatatagctaagacaatcctaagcaaaaaggacaaagctagaggcatcacactacctgacttcaaactatactacaaggctacagtaaccaaaagagcatggtactgataccaaaacagatgtatagaccattggaacagagcagaggcctcagaaataacaccacacatctacaaccatctcatctttgataaacctgacaaaaacaagcaatgaggaaaggattccctatttaataaacggtgttgggaaaactggatagccatactcagaaagctgaaactggaccttttccttacaccttatacaaaaattagctcaagatggactagagacttaaacgtaagacctaaaaccataaaaaccctagaagaaaatctaggaaataccatttgggacataggcatggacaaagacttcatgactaaaacaccaaaagcaatggcaacaagagccaaaattgacaaatggcatctaattaaactaaagagcttctgcacagccaaagaaactatcatcagagtgaacaagcaacctacagaatgagagaacatttttgcaatctatccatctgacaaagggctaatatccagaatctacaaggaacttaaacaaatttacgagaaaaaacaacctcatcaaaaagtgggcaaaggatatgaacagacgcttctcaaaagaagacatttatgcggccaagaaacatatgaaaagagctcattgtcactgctcattagagaaatgcaaatcaaaaccacaatgagataccatctcacacctgttagaatggcgatcattaaaaagtcaggaaacaacagatgctggagaggatgtggagaaatagcaatgcttttacacggttggtgggaaaaatattattttcaaacccagaagggttcaaaaagctttggaattgtggggaataatgaagaaataatttttttaaattaaactcttttaagatttactaaaaacttgttgggcaatttctagatacagtttcatttaccattctcaacaaccccatgagaaaggatattattattctcatttacatgtaagaaaactgcggcccagagaggtggaatgatttgtgcaaggccaccagctgcacgagaaagccagaatatgagtttatattagataaaactaatgcctgacatcttttcacaatcctataatgtattttcatgtattatgttcatggagggaaacccatagcctagaacaaacatttaggacttgtatcatttgtgcctctgcttacaaggttttggcagtgcagttttcttgtggaaaatgatttactttatttacaaaaattttgtactttactataactagcaatctagagtttgcctggatatcagcctaaaaaaggctacaaacttcccaaagtgcttcacttcatctggagagctgtttatgcactgtaaacactagtttactgtttataattagtatcttaaaagtgtataaactacttttttcttgctgtaaattctatagatttccttagctgtgtcacacagaaacttctaccaagtgattctacttcctaccaaagcatgtaattggcagggatccctctattagttgaatcaaacccctctttgcccaactagagagagccagagttcttttgcatgttagcaagaagatcactcttcctgtgtgcattcttaacctgactcaaaatttttagaattttccagtgactaagagattcttcattatgcccccaattttctgtaggcacacaaaagttcaaaacatgaacactcaaaattggctttctgttaagccactcatctgactgcttgctgccagtggttagccacatgtagagatgtaattatgtatgtctttcagagtttatgaagcttgatgaattaattggattttataaagctctttgagctatgaacatgagaggtggtatggatgtgttaaatactttattccatatgtccattttgtaccaaaatccagaggaagcttgttattatgcagcctcagccctgaagcaagccagtggcaaggacaggagcctactgctccttcatcaggaatcagatttcacagaagtccattcgcaatgcagtttggaatatatatagcatttttctagatttaacataaaatttgtattttttacgttatctaggaaattcttcttcactttgacaattcaaaaggggcagccagatttcgcatttagagttctatgacatagctcaaaatttgtgggttcttttctctatatatttattatttagtaattatttctttttccttaaaccaaaaagatcttatagttattggttacatttcatttgaagacaaagaggcaaaaagtaagagggattagaaccagttacttgttggtgatttatctcctatcagtgtattatttttgctggttttgagggatgacatacattttattaacaggcttgatgactgattaaggtagaaagtttctggagaatgtgagggtttccttgttatgttttctgctcttagtgctttcagttaaattagttcgtagttctgtagacaagatcatataaaaccaccagttaagggcttccccagcaggagcccagcagttactgccctagaaggacaaagcgggaatgctgggtgacagattttgcagtagctaagacacacgggaaaccaatggttgactgtgatgtgacaccattgactctattgaaaagaacacagtggagggaaggggaaatggcacgttacttacctgtggtgtaataaaaagtcaggaagaagaaaaataaagtactgaaaacttatacatcactaagttaccaaaaaaaaaaaaaaaaaactcactgctaattaaccagcatgaacccaatggcccaggacctaaaaatatttagtaactgtataattccttgcaactgttttttcccttagtagtggtgaattcactgtcatctgtgtctcttcatgatttttctttgttttattaggatactaataagttggaatattattaaagaaatgtaattgcaggtgcaaaggttgaaaatgtagccacgtaagcgtgggggcaattttaatatgacttttttttaaaactatctaacataccatgattaagacatggtttatgagaggcagcttttctttcacatttaattctgcagttttgtgtcctttttataacatttataaactttaacaaatacctaactgaaagcaacaccattcaatagggttttattcttaaatttagacattgtgatattaacaagatatggcttgaaacttatttctatggcctgccagtccacacttattctcagtcatcctcagctttttactttactcctggcatttttctctcttacatacatatgttagggggaaaaccctgtatctttgagtttctcaatgtgcttcaacatgacactttcattcacagaagaaaatatactatataggaaaaatgaagcacaagcattcctcattttattgaacttcactttgttgtgcttcacagatattgcagtttttacaaattgaaggtttgtgacaatcttgtgagcaagtctgtcagcaccatttttccaacagcatgtggtcactgtgtgtctctatgtcacatattggtaactctccacaatatttcaaatttttcatcatgattatatctgctatagtgatctgtgatcagtaatctttggtgttgctatagtacttattttgggacaccgtgaaccatgccaaattaagacaaagaacttaataaatgtgtgtattttgaccaccccacccaccagccatcaccctgtctctctctttcttcagcctttctgattccctgaaacacagtaatattgaaattaggccaattgataatgctatgatggcttctaagtattcaagtgaaaggaagagtctcatgtatctgactttaaatcaaaagctagaatgattaaacttagtgaggaacacatgttgaaaagccgagatgggcctaaagctctgcctcttgcaccaaacagccaagttgtaagtgtgaaggagatttaatattcttggagaatattagaatgctactcagctggctgtgatggctcacacatgtaatcccagcagtttgggaagccaaggtggaaggactgcttgagcccagaagttccagaccagcctggcgaacatagtgagacccccatctctacaaaaatgttttttaaaagattagcaaggcatggcgcagtgcatctgtagttctagctacttgggaggctgaggtgagaggattgctttagcccaggaggttgaggctgcagtgagccatgattgtgccaccgcctccaggcaacagagtgagaccctgtatcaaaaaaaaaaaaaaaaaaaacgtgctactccagtgaacacaagaatgataaaaaagcaaaacggccttattactgttatggagaaagttttcatggtcttatagaagatcaaaccagccacattcccttacaccaaatcctaatccagagcaagatcctaactctcttcaattctatgaagagtaagagaggtgaggaagctgcaggagaaaagtcagaagctattacagcagagattagttcatgagatttaaggaaagtggccattgccagaacataaacatggaaagggaggcagcaagtgctgaggtagaaaatgcagcaagttgtccagaagatccagctaagataattgaagaaagtgggtacactaaaacaataaagatttataatgtagatgaaatcactacatcatcgtagtgaatcattgggaaaaggtgccacctagtattttatagctagagagaagaaattaatgcctggcttcacagttcaaaggacaggctgctctactgttaggggctaatgcagctgatgactttaagttaaagtcagttttcatttaccattctgaagatcctagggcccttaagaatttcatgaaaatctactctgcctgtgttccataaatgaaacaacaaggcctggatgattgcacatctgtttagagcatggttaactgaatattttaagcccactgttgaggcctactgctcaggaaataaaaaaaaaagattcctttcaaaatattgctgctcattgacaatgcacttagtcacccaagagctctgatggagatgtgcaaggagattaatgttgtttttatgcctgctaaccaacacccattctgcaacctatggatgaaggagtaatcatactttcaggtcttatatttcagaaatacatttcccaaggctatggctgccatcgctagtgattcctctgatggattaggaaaaggaaattgaaaaccttttgaaaaggattcaccattctagatgccattaagaatattcacgattcatgggaggaggtcaaaatagcaaacctaacaggagtttggaagaagttgattccgaccctcgtgggtgactttgaggggttcaagactttactagtggaggtaactttagatgtggtggatagcaagagaagtagaattaaataaagcctgaagatgtgactgaattgctgcaatctcacgataaatcttcagtggatgaaaagttgctttttatagctgagcgtaaaagtggtttcttgagatagaatccactgctggtcaaaatgctgtgaattctgttgaataaaaacaaagctttaaaaacattatataaactaaggtgattaaacagtgtcaggaattgactcccattttgaaagaagctctactatgggcaaaatactatcaaacagttttgtatactttagagaaatatttcatgataaagagcatctgtcagtgtggcaagcctcattcttgtctttatttaagaaattgtcacaaccacactagccttcaacaaccatcaccttaatcattcaacagccatcaatatcgagtcaagactctccatcagcaaaaagattttgactcaagaagactcagatgattgttaacatttttaagcaataacggttttatgttgttgtttaaggtaagcgcattggttttgttttagacaaatgatattgcacacttaatagactacaatatagggtaaacataaattttatatgcagtagaaaaacaaaaagttcatgttacttgcttaaatgcaatatttgttttattgcagtggtctagaacggaactttcagtatctctgaggtatgtctggaccatcggggtagttcttggactatgttctatctcctatgtaacatgtatactttatctgggatagaacgtattttgcaagtcatttcattctaatgggtcttgacatcctctttaataataatgtcaataacagcacagcagaaacatatatgaatgtgggactatgtgaagtgttttgcaagcctttcttttataattgccatactttttataagagtatagaaattggggctcagaaaagttgaaaaaatttctccaggtcacagaattgctcaggatggggccccattttgatccaatcctcatgactttagaatcatactttaaaaatattttcatttttaatactcttctcaatcacataggattttttataattaggaaataatgaaatacataaataagaaattttactagtaattccaccacctcattttttaaatattaagtgctaattttactttttttctatcataatttgcatatgaaaatgatgccttgctattttttaggataaattatgagaagtagaattactgggtcacacagcagcaaggtttttaaaggttttaataaacaggtagtgtgttcttattttctattttattcctataaaagatgaattttagtttattttataggtatatgcctattaaaagcttgtcttaactttaagaaatctttgacgcaaagccagtaattcctaatcctaaaaaacatggcattattttttacaagaattaccttgaaatgccctaccttaagacctgaagtgcaatttataattaatgttatatatggctgcaattaaaaaatatatataaaatgtcctgatattaatgtaaataatacattaaagaaagtaatatgtaataaaataatatgtatttcaatgtggaaatgtggggatactatggcactaaaagagataatgaaatcatcaggtactatttgcacctataccacaaatcaacatgaatgcaagagctaaagtgtcctctgacatgtatatgttgtgacaactcacagtgatcagtgacatgaactttccagatggtaagaaactgctggtaaacttctaaacaaagcatagtacaatattttcttgatttgcatgatagtggtattccttaaataattcattatatatttaaaagcagttttaaatatatatatttaaaaacataaaaactttgcatttataccaaactaagattatgttttaggctcagaaaattctaaaaaggcttttaactgatatctgcaaaactttcatttttattaattttctttttaattttattaagaaacagattcttgctctgtcacccaggctggagtacagtggcatgatcagagctcactgtagcctcatactcttgggcacaagcaatcctcctgaatcagccgcccaagtaactgggactacaaacacatgtcatcacacctggctaattaaaaaacaaaaaaatttagagacaggatcttgctgtgttgcccaggttggtctcaaactcctgggctcaagtgattctccaacttcggcctcccaaagtactaggatgacaggcatgagccactgtgctcagacactactttaaaaaattcccaggggaacagatacaattcttggtcacatgagactgcctggaaaatgtcggggcttgtagtaaacttttccccatcaccccacctacttaatgtcagtagcacctgctatagagttccccaatgttcccaagagggtagtatcactgactttgaaaagcactgctatggaccgaatagtctaagatttgaaaagaggactaagaatcctaaattgtcagattaattctttgatagtgaatccttatgcctctgttatttccacttttaagagactgaacttgaggctcaaagtcctcacattttcagtaggctttgcatttgttatgtcaaataaatttttcctccatccttcctttcttcctttcctgtgtttttttaatttgccagagcctagaagtaacaatgatgtggcataagataaaaattacttaatgtagtacttttggtttaagggaattattagcaaggataaggcaattaagtatcaatggcaatatcatcatgccccactaaaaaactgagtcacatatgatttctaattccagttttattcttgaaggacaattccattttttatttttcattcaactattttaagttgtctcctgatatacatttatattctttttaatttcaaaagctatcataaattaaatttctgtttgatattcacaacacagataccacaaaatccaatattttgctgcaaacagaatgcacaaaaatgtcaggctagagagtcctaaaaaatgtgtgcttttatcagttttaataacctataaatatactttttgtttactcagcattggagaatgtgtacttacttgctctttggtttcagtgatggatttacactcaaccatctatctactcacatggtctctaaagttcctggtactgtgtagtaaggtgtaatcttccaaaacaacatgactttttccctatgtaggaaatagctagcacaagtggatatcaaaatataaccttaaattcatgatcgcaaagtggtgaacaaattagaaaatcaatacagagaaatgtgattacaaaaattatcacttctgaaaacttaccatcttacctttattagtccagaacagattctgggaatggttataataacatttataaacaattagctattgaaataatagatgttccattatatttttataaacatagaaattttataaacataaaaatgaaggaaacacaaatatatacatattaaattaaaatgttttacagatagatatcaccagtaaatatctacaatggacttttaccattctaatttaaaaacttgaattcattgtgcacataatatcatatttagtaacatggttaaaataattttgctggaattttgtacttgctgtacatgaaagaatattagacctgaattctgttggtacatgtaagcaaaataattgccttactaacttgtattctttcagtactagcttaccagtgtggctggattttaaatatgaatgaattctaatttgagttcttgaaagataagtttttaatgacagaagttataaacttctaaattttccatggtttttgaactgttctagttattttcttaagtatttaatatatctgtatcaacaaggaatatgattagtaggataaaaatacttctaaataggtcctaaaatagcttgtttatttagcaaatatatattaagcagtcatcatatggcagatattttactcagtaaagaagctacaaaacaagtgaggaagaataacttttactgagaatttttactaagtgccagatttacttgtatgtacttagcactttatagtatcatattcttaattctgacaatatcaccactgagcaggtgtttgtatactgcagatgaatatgaataagacataatggctttcctcaatcaactcacattctgttaaagataagtgaaattagcatggtaaatgaaattataagtctgtaatcagattgctgtgagagccaggggagcattgctaactgcctgaggaatccaggagggcttcctagaggaggaactgttaaggcagaccttttgattaatgaagatattgacagaaaagctagaggagggtattccatacaaatgaggtgtttccaaatgagagaggctcttgactatcaaaaacagcagtttcttatggaggaaacttgagattgttgtgaagaaatcaaagaagagatgactgggcatagaggtgcaggggtcttctatgtccttatgtcctgtgaagttacgtagactgtaagtacatgctagagaggagtggtaaagaagactatgcccaatttgtaggaagtttcagaagcaaacagacaatggggtgtagatgagactatgggaaaagtgagatcccgatactgtgggaatcactttcccattcacctctcatttcaggttttctatttaaatgcaatgatatttaaatctgagcatatgccaaaaagcaataatgaatattaactgctacaaaataatcttatggttacagggtatttctgaactaaacatgagtgatttgggaatgtctattcttccatgccacattagctcagctaattaagaattcaagtttaacgaactataattttagcttatgtaagtacataccaagatttctattcttcctatcttaaagactgctttttagtggtgcctccttaaacagacattattgttttcatcaaacaatgcattttttaaaaaaaactttagaataagagtacttctgtttaaatttcttccttagtgcacatatttatgtaatgatatatcaatatatatctgagtggtgaagtataaatgtcattgtattggtccctcagtagtactgtgagacatgtagatggcttccctcgtcatggatggagaatctgaagctgagaaactttatttcttctgagtgacctctggtttttttcaagaagttggaaatgagccacaatttctgatgtttttctttccattactcattctactttactgtttggttttctggtttcattaagcattctcccacatttatatggaaaatttgatgttttaaatttttgagatacatctttggtttaggctgttgttaatttcaaggaaataatcagcaggatacaagtaggtggtttaaattacgacagaaatatttaacctacgatgttgatacacttttggtgccaaagacagggaaacatatggtttactgggatctccatgaagacaacatctttgttaatgttatttttaaaccaattatttttaggcttagtggataaacgaagacctgacatatttggtttatgccacgtggattcatttttataatttatttctcataatttgttcattccttgccctgtcctttctcctcaatctgtccactttaaaacccattagttactgtgaaacaacaatatatgtgtattagagaaactgaactagagtcacaaattcattatggagttagataatataatagctggggaaattgggctatgcttcctaaaggaagcggtgtgtcatgtgtgacatgtctcgtgtggtccatatggtgagacttgtggcctcgaggaacacatacttgttacctcagttatttagcactttggggcattagtgtttctacataactgggatttctaaagagctggagattactgatttaaatttattttacttttttttacttgtatttttagttaaaatctttccaaaatataatcaatgtatcttcatttcatgacaaaagatcaactttcctgaaatggataaatccttatacatttttcaaatttccaccctcaggaagaaccccaatctttgctgtgttatcagtgtcgtcttcctttgtcaataatgtatttttaaacctgggagagtgtcaacagtccacacactgactcttagatgactgcaggacaggctgtacttgttcctatttacaccctgttaaggagatacagtgaggaaagaggacaccctctcattgctttaggagttttccaaagctattttctatgagcccttacctatagcttcatcaggagaaaaatgataggaatatggaccaaaacccaagttacatttatttttaagttccttttaatgttttgcctttaatacaccatcaaaatagcattttacatgatacagtttaattgaaagtcctacaataagatcaaaccacttctccagttacattccaggtgcttattgtagattttcttggttttattacttaagaaaacagagtagtacactctggcactcaggaaactcccagaacatggcaggatcaatcacgtttttcatcatgtttctggttagtctcttgttcccaactcctctatgaaaatgtaagtgacatttaataaaactcatggttctaacttctggaaaaaggacagagagccaaagtacataaaaagattatagctgtaactataaacttaattaataaaatactatagttcaatgtgaatgaaaagtttctagaggaaaaaattcttggccaggcccggtggctcacacctgtaatcccagcactttgggaggccaaggagggcggaccacgaggtcaagagattgagaccatcctggccaacatggtgaaaccccgtctctactaaaatacaaaaattagctgggcgtggtggtgggcgcctctaatcccagctactcgggaagctgaggcaggagaattgcttgaacctgggagtgagaggttgcagtgagccgagatcacaccactggcctccagcctggtgacagagcgagactccgtctcaaacaaacaaacaaacaaacaaaaatcttatttccatctaaaaacccagcaactaaagcaaagccttttactctaccaatgtctttcttgttggttatttctttatctttgctacatatgtagcatggaagagattgttttcagaagacatctaagaaggcagaggaaaaaggtagccttgatttaggactttaaataacaaatacagtagagaattgaaagtagtgagatgtccttttttttttttttttttttttttttgagatggagtcttcctctgtcgccattttggagggcagtggcatgatctcggctcactacaacctctgcctcccaggttcaagcgattctcctgcctcagcctcccaagtagctgggactacaggtgcgtgtcaccgcacccagctaatttttgtatttttagtagagacagggtttcaccatgttggccaggatggtctcgatctcttgaccttgtgatctgcccacctcgggctcccagagtgctgggattacaggcataagccaccacaccgggcctaagatgtcttaaatccatatgtaggcatgtacacaaagttgctatacttgagaattgatagtatacaacttttcaaaagaggatcctttattttcaaattattcaaattataaaattatttattacacgacatattagactcattaaaaaagttatagctacagggaactttacaggccacttagctcaacaaatttattttataaaacaaatgggcctggaaaagttaattctcctttcagcatagattttccttcctttcttgtttccttccttccttccttttttcaaagcattttacatatgccactggaaacagaatttccctttaaaaaggagaaaaaagaccaacacagcacaaaatatttagctccctttggatttcagggtaatgttctgaaaaatgaaaatcagaatgcttcataaatttcaactgttaatgtcatcatacattcatagcatgcaagaatttgaatactacgttggttgcagaactcagaaagtcacattagtttaatttaattgcatttttatatcattaattattgcctatcaagcaaatttgagaagtccaatgaatctgtcaggattttttgagtctctgtatgtgtgaggaaaatttctttctagggaactgtccaattaacaatgggtttctttaaatctttttacagaatcctgcatttgagctagtttttttaaaatacaagatgctttctataggtctttacattaaattaatttgtcaactatcatttatttgataatttatattctagctacaaaatttgttgaaactatttcaaaaaccagatccaggtttcaattccaagttcttcactattcagttatcaaagtatcattttgactacatttgtaaaataagtcaggacatgtatgcagagcacatcatacataatcatactaatatttgtgtgttattgtatattttaaatttgtattaacatattttctcatttatttttttcaaaaactcaggtatacattatcactattattatttatgactgaaatttacacaagtaagaaatgtgtttcctccttgttgctcctgttttctttctgcataaatgatacttgggggattgagatatatttgagagtggcacagctgtcctagctctttccaccagggtgtctttatccaggcagtttctcagttcaatttcactcctatgtttatttgtagacccatctcaaagtgcacctgctttaagaacaacaccctagatcaaatattagtccacaaaattaagtcccttttctagttctctatgtagcaacaactatcagcactacatattttagtaattaattatattccccgctaacattgtaatggcctccagatgtcttttgcactcaacaattgtttgactcgacaattttatatcactttgtaggaataaaacagcattgcctttttatcacagtgagccctaaatatgtgtatttacatactgggatgagggtaggtacgtaataaatatccatatgtaacttcttgcatagcatcacaaaaagtttacttttagggaggggaagaggctttgagtgagaagcccaccacacgataggaatgctggtgcctgagaatggtaatagatggcccaatagagaggtactcactgggattaatgccgtagtttaaaatattgtccaacagcatattaaacacagttttagcaccaaatagggaaaatcacaagtacaatatggtcagaaccaagggtgtaggcagtggagcagataaagaatgtcccagcatttagttctttggctactgttgcctttcactgttctgagaaaaagaaggcagctattagttttgacaaagcaattataccaagacgcagctgcagggagctgacctgatatttgcccccgatagttgtcatagcagcaggctgaatagagcagcttgatacaagtgctactgcagacactggaggaagttctgccctaaatgcaacacgtttgaacattaatatacaagtgtgtgtatgatttcttagtagtggccatctttctcctttattggattcttatctaatttttaagtactcatttcttaggaaatccctgcttaaaggtaacaataatgatgtgccccttaagtactagtggcaccatccaccagagtagatactatgtatctagggtaatgctgcagggggagaagatattttaaacagtatagctgacaaaagaaaggtttagatgctgtaaactggttgttgctttttaaaaaactatatgtactttgtctatacttagtaaataatttttgttcttatttactttttgcttatatgcatatacctctatacatcttatacacaaaagataacgatttgaagtgatgtataaaaagatgtaaacatatacaatacattatgtacacataaggaagacggtatttgtcaatatggtaaataatactttgggtacattgttgaggtaattatttgatgtttttaaatattacctctattttagtagcctaaacttagcataaatgtggaagtgctttgtcaaaactgaagttttaatgacaacattaagatatatatcattatgaaataatcttttataatgagttacaattcttaataatacataatatctaaacactcagataaactgttaatatgtataaaatagcaaaaaaaattctatttcaatgatgactaaggtgtgtgataatctatgataattctgcttaaaacacaaaaaggataaaagttttaataatatgtatgatcaacagagaatctatgtattcaaagtaatgactttatagaatttctaaatcagtttctaaatcatgaccttatgacattatgaaatagacatcaagaaaggaagacaaaaaattggtatatccaaatccatgagggtattctttgttttattctttctttctcaatcaatatatacttccacctataggagaaattttaaaattgtattttgtcattcagttgtttgaatgtatgaaaattgtgcagctgacaggtaaaatatatatacagtatgaatagtatggcttttatgcctaaagcttgtggaaaatgaatatgttgactctatagtttttaaacagaatttcaataattacaaaaggatgtatatatgataaattgcactggatacataataaattaaattcgatatttagaatcaaaagtacatttggtttatgttatgaatcaaatcagaaattaggaaaattttctaaaagatttggaagcacagttttgatgcaggaatgtgtaaacattaaaaaattagcttgttaatatataaactaaactttaagaatgtatttcaaaacataaactatattagtttcagtagcacaaaattgagggtatattcaatctaatctaaatccatatgtaatatgaagagatgctcttgtatatttttcccccaggaaaaaattaaagacaatttgtctgctctttcaggccattgagatgcaactgactaaaggtctctgtaatacagcctgcagactgcaagactaagtgctagaaatgaaagcagctatgaagtacacatttagaaatgggaaatctggttaacatttttcctaaaaaataactttatgtagataataatcaaattatttcattgatgaagttatcagtgaaacacctgaacaaaggcttcactttatttttaagtctagaagtaaaccaggagaaaacaatctggtatcagtgatggctgaaagcaactgaaggagggcaatgttaagaactggcagatttaacacatatgaatctcttgaaactgttacaaaatttagtcaaaaatggtgtaagcagaagggaatttattatcttgggtgactcaaaattgtaacagtagggctaagtttacatatggttgattgagtgtctcataattatgggtcttctctcagagatctcttggtcctgctccatttttgttatttctattctcagacaggttatcctctcatagtagcaacatagctgcagcagctccagccttccatcttccccatatgattgggttacatatttatccctgaagcaattgctgaggccagagaaatggaaagtgtataggccacatatttagttttggagccattggtggagtaaattctgtaaaacacatgaaacaagagtagggtaggaggatcagatacagttactaaaaggggaagggggatgaatgctggaaagccgatgaaaaacagtgttcactacagtggacattactggctttctagggctgccaacacaaagtaccacaaactcagtgatttaaaatagcagaattttattctctcacaattctggaggttaaaagtccaaaatcaaagtattagaagggccctgctccctcaaaaacctctaggggaggatccttctttgctgcttctagtagcccagacattccttggtttttggcagcaaaattccaattcctgtttctgtctgtgtctcttctcctcttcctaaaagaatacaagttattttgaagtagggtccaccctaattcagtattgcctcatcttaactagatttacttgcaaagtcccttttttcaattcagatcacattgataggtatcagggattaggacttcaacatactttttgtggggacacaattcaacccatagcaatatattctttgcaccctccacaattcatgtccttctaacttgaaaaatctatccacctatcccaacatccccagaaatcttaattcatccagcatcaactctaagtccaatctcctctaaaaatattcaactcaagaagtcccaaatattgtctttaaatcatctcaatccagtgtgagtaagactctggatatggtccatcctggggcaaaatttcactccatctatagacctgtgaaacctagaaaacatgttacctgcttctaaaagacaatggtgggacagacataggatggacatttccatcccaaagggaaaaaatggatcagagttcccaagcaagtttaaaagtcagcagggtcaattccattagtttactaggactgagaataatcatctgtagccccatgctctgtcttcctgtcccacctggccgactgcaccttcctcttggccagcctgggcagtggccgcgacctcttcgccaatgatgtccagctggctggcctcaacctctgggctcattgctttgcccttggaatcattcttgtttcattcaatcccatctctgtcccttttcagtctgggctgacagtttttctgctggtataaaattttcaaaaactttgtcagtctcctgtgcatgtcaaggtaatccacactattagacatgagtattctttacacattcttcctgaataatctcatctctcttcctggagtctactaaaatggttgattggacccataaatcacatacctaatctctttagtgtatagttgtccagccacacctgttttcagagcatgctatctgaaacattttccaaatcatcaagtgctggttcttcatgtaggcaaattcaatccataacataagctaactccagtttttacattgcactttttgaagaatgcatgtatggctttatgctcattagctatacctaataagaatttaccagcagaaatattgaaggcacataatttaaagtgtatttacagatgcaaaatatataactaccaccaactctctttaagtgagggaaaactacttacacattattttagagttttatttatttaaagatttggggtacaaccaatatattcattttttttgtatttttaagttgcacaaattttaacatcaggagactgtaatagacctctctctccttctgtctcgtctctctctcatcttccctctctccttccctctctctatgtccctcatacatactatataaaaactcttatacaatatgaaattttgtatcaaaatatgaagaaattacagtaatctaaaatcaatgatagatatgcagagcataagtattggagttgtcatttaaaaagaataaggtgaaacatgaaccaataggtacatgattgctctttcatgaatgtagaaaatatacgtagtctattatgttgttattgttaaaaaggtaaaatgtttcacacatacacacacagccccccatctatttttaaatgctcttaatcatttttcctaaatgttttgcttagttgtaatcatagttattcagtttaagatgcaaattcaatatagatttaaaagggcattgtctagagacaaagctgttacccagtgattcacatatgcataccctgtacacatcctctaattggagcccactgtaattacactgcaaataagcacttcttaatgatgatgaagaagccagttactaaggagctgcttcttgaaaagtactgtcattcatagctgtaaagggctaaacaagccttaaattatatcttccgttctaaagtcaaactaaaaataatctatacatgtcttttgtttatgtgccccattgttttcctctaaatatgaaagctcttaaaatattcagcagtgacttatgcattatggaagtgaccactgaaggcagcgtttctgaaaagttatatgcaagttagcatcaatgcaagcccaacagcagcccaggtctagccctgttcaaggctcagggggtaaacaccagggctgcctgggttcaaattccttccctcaatttttacctgagctctccactcacaaggaggaaagggcatgcctccttgtttttgtgacacatcagggtcccttgttcttagaagctcagatgtgtaaaaaatgctgtggatgcttttagatcaacttaagagtgccgggagctgtgctatagcaatggcaacagggtccaacccaaagatgacacgctcattaggtcttacaagtatttccagaaataattcaatctacccttgatttgagacaaatgatttacttcaacaagtcctaaaaaacactgctccagtattctgcaaaaataaaatacataaaatacataaaaataaaaggtattttatttaatcatttatttattagtaatctctatatatagattactaatagatactaatctatctatattattaacctatctatctatagggtagtaagtggcaaaagtgttttatttggcctgaacgttgttgcaaaatgttacatttgaatgctcttgaatttagcactgtcttcataacttcctattgttcaatagtcagacctctttagtttcgcttggtccctagaggaagttgagtttgacaggatttttgattcacctagtttttggcaagtgtcttatcacccaaacatatatgccaaaatttttgcattaaaaattaaagccttgctgattcttcaaaaaataatttgaatgaaaagtaagtttagtctttagatgttttacttcttccaaatggcacaaatgcacagacactgcctcctttacacgtttctttagtagacagaaaattatgttaaaagaataggaataagaatgctgtttaaatttgatacttcccttttctagatcttagcatgggtgaagatgtggttttgcccttgagaggatacttgctatattataaataacatatatatcagtaagaatatattaataacatacgaataaatatatgaatacacatcagtgagtgtatgaatgtaagttcaactcatgctgaattatgaacctcatctttaaccaaccactgaattaaggtacttcctttttaaaatttcaacattttgtgtgattcctgtgagctgctttgaaaccagcagccttgctcagtgcagaacatgaaaggggaacaattgagcagatttttccccctcttggcatgaatctatcagtactcattttgaactgagctgtctgtcattcctgacaagtcctgaggggaaataagcctttgggtcccaaaatattaataggtaaacacgttattcatgtttggccatagcaaagatacgtttaattttaaaatgaggccagagtccctaaactagaataagatgtttgtacaatgacaacaataaaataaaatcatttaaaatgaagaatgcctgggattaagtgttctgaaaacccacagttcataaaatgtgtttaaagcagttgaggcaggagtgagaaaacccagtaaggaaaagacagcttcaattagcaatccccaaaaggtgtatatttcagaacaaggttcttatttaaaaattagccttctggctggatgcagtggctcacacctataatcctggcaccttgtgaggctgaggaggaaggattgcagaaacctaggagtttgaggccagcctgggcaaaatagcgagacctcatctctactaagcattaaaataaaaaaaaaattaactaggtgtagtagcacccacctgtagtcccagctactggggaggctgaggagggaggattagtaagcccaggaattcgagcttgcagtgagctatgattacaccactgcactccaacaagggcaacagtgagaccctgttgtaaaaacattaattaattaattaaaattagccttctatagagtttaagacgatcatgttggattttgttttatataccctatctgtatagcattttacactactcaaaaagctttatagaaattaatattacctaatttatgtggattcctgagatcagacagaactgtaccccttcatccatccaaacacagcaggataaaaggagggggtagtactgggctcaaaattttactgaaactctggacaagctgctgaacagtagttcagcatacttgcccacagttcacagatctacacacacaactgtgcccgtcatttcttttgcaagacctcacaaaaggcaaaggaggaggaaagaaagttatagttcatttgcataatctaggctcctggtaattaaaaattattaattaccttgctgatagttgtaataaaatgaaaaaaaagctgcttatcagcaaatccagccttctgcatagtgcctgggttgaaacaaacagaacaaatcccatcaaagagaggttttcaagtaaagataatgctgaattcatggagaaatagtctatgtagttccattgtttttcactttgattgcttttattttaatgactattttagaataaaaacaccctatcctttctaattgaatgttttacttgaagctatactttaggacaaatagctaagtttagaagattaaaaaacaagtttgaatgtttgcctataaacatctgaagttatacctaaacatagatacatttagtactaggcatgtctaaataatatttatatttagcaattattatacaacgttttgtttactagcaaaacagatatgaaaatagtacatttttaatttgaatattggcacagattttacattaaagtaaataagcattggatattaaaactatgtaatcagacttctctttttatttttgccatttgctttcttaattgcctaacaaaattaatttatacttgtggttcactgagtgggtaagagttgctttggataccattttccttcaacctatcctagccacctataaaagagttcccagatgactttgacagagtacgcctgataaagattgttctctgatgagccgccggtccctaatggagaaaggccagaattgcagcccgagaggctgaagagttacctgcttgtcatcttcaattcaatttaataaatattaagtgcttcctatacacaggccattatctggaatatgcaagatgaatttaatcatttatttagaactcatgaaacatagagagtcattctagagcttggaataagatgggaaactgagactaactttccccaatcagaaaatagaagcatagcactccaaaaaattgaaaaatgtttactctatcactcttacactctccctgaaaatagttaaacttgctctactgcatccttaaccttcagtcacttagtgttgttagaccatagctttgggagtcacttagacacctcccccactgctgtgctactctgtactcgataatgttggaactcaatccatgtgactttgattcctcctttgcaatttgggaataaattttatcttgtagaagtgtgaaaactaaatgaaatcatgtatacattgcatacaacctagtgcgtgactcagagtaagcaccaaagaggaattgactttgttacctggttcccaggagagagaccttactacttttcaaggagagccctactagttccaaatatcatttattgaaatttctttatttctgttgttctgtaatattcacccttttgctatattctacgctatttcatgacacaaaataagtatctcctctttcataagacagttcttcatatatttaaataaattattagaagccatatatctcgccttctccactcttatttaggatgagcatttcatgcctctagcagagcagtccgtctccttatttactgcatcccatcgcctctcgcctattccagcaattctccctgctctctctcctccaggatcactttcccctttacactggattcttcccatcagcatgtgtaaatactattctcctaccacaaccaaaagaaagcaaacaaaccgaaaagcaaaaaaaataaaatattatctacaccttccctcagtttccacatttctctttccctttacaacagtagtccttaaaaatgttgtcttaaatgactattgccaaattctctcctttgatttcatcctgaaccaagtcaggtttttgctaccaccccgtcaccaaagttattcccttaaaagtccactgatgacttccacatttctagagccaatggtctatttcttagttctcgtcttacttgcactatcaggggcatttgtcacggttgattactttgttttccttgagaatttgtgctgcaatttacttttaaaacaacatacgaattcttttcctgcttccttgcagttccatctcacttgcctatgctggtttctccttgtcctctaattctaaaatttagagtgctcctggctttagacctcttctcttttctcctgtagtcccaccactttcaataccatctgtaatgtgatgactcacaaattgatatgcccagccaggactcctccctgaactccagatccatatatccaaccacttcctcagcatgtactcttggatggatgttaaatggagtaaacataatgtgtacaaaacagacctcacaatatcaaccccaacccagttaatgtccttcattcttacagttggcctgaccagaatccttggggttaccattgagttcccccttcttttcacattacacatcaatcctttggcactaccttcaaaatatgtccaaaagtcaatctgcccacactgttcttaccttttgtccttttccaactcaccatcatgactcatctgaattattacaatgacttcctagccagtcatcctcttcctcttgctcttatccctcatttagtctgttgtttatatgttgccagagtaatcttgttaaaaaatttcagtttatgtcattattatttgactgaaaacttccagtggctttccatcttattaagagagagcaccaaagtctttactaggctctaaaaggctgcacttagactttgtgtcccttctctcacctcctctcctataatttcctaccacacagacttccttgtagtgttttgacacagtggctatgatcctgtctcagggtctttgcacttattccttctacttagaatgctatccccaccccagcattcacgtggcttgctcctttgcttccttctttactcaaaaaccaccttttcagtgtggtctttcctggccatcccatttaaaattccaaagcattatccctcaaattttatatcctcctttcatgctttttatttctttttggtgctatttactgtcctataaaatgcatattttaaatatttactttgtaaataaatgtttgttcatttctgcattagaagacaaacctctgagagaaggcacttcgtgctatgtttattctctacactgggtcattaccaagcacacagtgggcattacataaatatatgtagaataaatgagtgactattaccctttgtcttctctgcactaattaaaaacctcctattcatgtgggttcatttttaagttttgagatcttccaggaacctgcttttttcacacacataggtttagtttattgtgtgtctcatagtgtggcacccaaggagcctttgacttgctcagtatggcagagtagtgaattcttccaactctggagtggaagttcacaggtttagatttcagtttctgtgcttatagttgtgtgaccctggatatgtctaaaatatgcaaacagaaagactgcattttttctaccataatggcaacataagtcgttaaaccttttaaaatgggttaaaagtgttgagaaacaacacatactaaactcacctcattttctttgtgatggaactattaaaaaggtggaccattgtggttttctagaagtagaacaaatcatttgacaaaataaagtagtgtgtactgaaatatagtatcgttaggatggttcacatctaatggaatgacgacatccaaacactgatgattggattaatctaactagaaaaaaggttttgcattgcatgtcatgggcctaagccctatcccctttgttactcaatatttaaattaatgagacagataatgtattggtagggtactgaacaattgtgtgataagaagaaacagggatatgaagagggaaggggaagactaaacaacatgcaatgttaatggaaagataatttgaacaatttcatgcaatgttgatggaaagataatttgaacaatttcattacaggctggtatttcacaagatgaatttaataggcctaaaaatatagcctaacacttaagtatacaagtttacctatacatacaaagtgaagaataaatgtcctaactttggcacccgtaaaaaatagagatataatgagataaaacgtttattaaatacttactgaacacatatactgatcaagacactgtagttttggtgaatagtagagaaagaatatctgcttccagtgagctttcatgttagcagggaaaacaggtaacacttttgcaattaattataattgattttagtctaacaaaagagttatggttgcatacaatggggacctaatgcatagatgaattaggcaaaatatttataatgtcatcttaggtcacatgaataaaagtatattatacctagtagaagagagtaatatttattgagcatttgctctgtgtcagaaactatgctgattgtcatattaccttaatccacacaacatccctatgaatcagacattattaaactctgatttcacagattgaagaacaaaggaacaaaaggcttatgttgccattatggtagaaaaaatgcagtctttctgtttgcatattttagattatctttttctatcaaagttttcagatggagtttaccatctcacattttaaagcctttcaaatgtcaagaagctgaaattaaaagatacaaataaaaacttaatgtacctatcctgattctaactatattatattagaaaatttgtcctatctataatttcatacatatattaaggttttaaagtgtgcatgccttttgatatggaaaattgaatccttgcattttatttgtacttccttccaaaatgctactataatgactataagtgaatatataaagtttagatttacaaaaagattgagaatgaggaaggactcaggaaaggatgagacatttcaactcaattttggaaaatgaaaatctgccccctaactgactatagggtgacatcaattagaagccactcagtctctgtcgactctggaaagtctaagaactgaagacactacatattatagagaattgacttatacaaatatgaaaataagagaattgactaaagtgtatctaacaagttgttagacccaggtcccatccccaattctgtattgccaggagacattattttcctacccaagtaggaaatggagggttcattatgtagtgaaataaaggcaaaaaggtctaaactcaggataccagaaacaataatagtggaaaaatatgctaaaaatgggcagaataaattaaattattcaagctgaaagctatacatctctgctgcaggccttttttcagtttttagccacaagtatggagacagtctgattatatcctccactgaaaagactagaattgttccccagaaacgaagaagccagaggggggaaattatagtcctggcacttaaatatcagaagcaagacatagtatagaaggaaattttaaagcaaaatataatttatatcctcagaaagataaagcaaaatcatatttcatccttgaagtaaatagcaaatgcatgaaaaagaacagcaagcaaaaaagaactcctgggatacaaaaacatatactgtgtatgatagaacttttttaaataagtggaagatcatttgttaaatcactcagagttttctttttaaatagacaaaaaatagaaaataaagtagaaaggtaaaaaatatattgtagagggtcaatttaggagggtgagcatctggctaatgagagttagagaaagagaaaaagcagagggaaagaaattatccaaacaaaaagagagagagaacatttctcagaaatgaaggatatgcattaccagactgaaagagcacataaaattaccaggatagtaaatgcaaaagaaaagaccatggcagtcatattatcatgaaagttctggaacacatgaaataaaggcaaaatcttaaacattccagagggtggggtgggggggaggagcacatataaagaatcggaaagccaaatatgtcaaccaacaaaaactgtcccaaacactaaaaatcatgggtgcaaagcctgtaaaattctgaataaaattcctgctcacccaaattatagccgagaagagagagactgaagggaaaggaggttaaagaatgatgctgtgtggcaggcctggagaacagtctttccagattggaataagaagtctccaggagataggtgtaccgggaaatattaagtgatgcaacacctaatatatttgacaacatggaaaatattccaagagggttgtatacttttgttagagaatttgggaagaactagtagtaatggctcagaatactagccaaaccacaccaaaacccccaaaatgagttttaatactgaaggaacaaacatttggagaggtatactcattgctcaccagttggctcaatagtgaacaacaccgtcatcctgggtctcagcaggagagagatattaataatatattcaaaataaataattgaagagtatctaataaatgggctatttacataggcgtggggtgggttagggaaatcaagatgagatggtgaaggactagcaagagagaggaaccctcaccactgagagctaggaggagcaatgggagggaactgaggccctgggagagggaatgtctgtcaggatccaggttctgccatggggaaacacagcatctgcccaaccatgacatggcaggaaaggataccgggaaataaataggccacgcactgttatctttcaaacactagactcttgtcggtgtgtttcactgatttgaaaccctagagtccagagagcaagtaagcccagcttacttaagttcacagtgggtatacccccaggaaacagtgttagagagtgcatttggggccataaattaagaatgttcattgtgccagaaaaaaatagtgttgtaatttcatgttgttaaaagaagttctaaactatgtgaatactacgtggcacaattaaacaaaatcctcaagagcatagtcagaaatctttggatacaaagaaagttttatagcaaatgtaggatgtatttctgtgtagtgtggacacacacatatgtacacgcacacatgcacttagcctatgtcttcacatgactgcctttttaaaatcattcttttgatggcttatcggtttacatgtttttctcagaaagaccttccctcttgaacacccatccccaatcattagtttacatcacccatttttttcattattaatggttatcactgcatgaaataatttttttttttatatattttatccttcctcttgcctatccttccttcgcagccctggaaatcccatgagggcagggatcatgtttattttttctgttgatatattcccagcacccagatgaccgtctagcctagtagatagaaggcatccaacagattattaagtttttattcataaacaaaattagactgtataagacttggtcctgggttatagacatgagataataaaaaggggacggttgattatgattctcctgagtctctaactcaggaaactggataaatgaaagcatcattaattaagatcaggatttcaggaaacagcaaattatggctggagaagtgattgcatgggaagttaaagtgcacagtttcggatataatgcctaggaagtaatcgtgggatatgtaggttgttatgtccagtagccacttggaaatgtggacttaggaaaaggttttaattgcaattttagatttagaagtcattggtaaagaagtggtagataaagtcataaacaacagatgagatcttgcagggaaattatgcagataaagtaaaagactcctagagaataaaaatggaaggaaaatagaagcttagatatacttttctaccaaaacttaacatgaggtggagtaatatatttcaatatcttaaggaagataaaaccactactttccaaatccaagtagtgttaaataacattgataggtgcatatgtgcatatttttgagaagttacagtagagaacacctaaaaattaacaacttaaataacaagttgttcttaatggaaataaaattataaattttatatttaatgtctgaagaaatatgccaacagtgatatttgtcttcctattgtatgcgctacacccatagtcaatatgataaatcagaacactttatagggctaaactgaaagtaatgtaagcagtactattaaacaagggaatattaacaaagagcatagtattttcctcatgtatacaccatataacacccacacatattctggcttatgcaacttgttttaaatccatcactagattatttttgtctttagataatttcatgttatctatgcgtgttcctcttaaaatttaacttcacattaatataaaagcattatcactcaggcatcaccatattgatggcttatctaattaccttagtttgactatttcataattgatatgcttgaaataccaaaacagatgggcaatctttacactaagtttaaattaaattataataacctataaactttaatctcaacacataggaattaagatcacaattttatgactccttcaagatatataatccagatggaattatgtttactatatgattgaacataatgctcatcaaaagttgctacaaagaaatccattatgtagtgatattaggaagggatagttcttcattctgctcagccaaccatgttggcacacctgtttctaatttcaaaaccatctatgattatatcctaatgtcagtgttgaaatcacatcatcagtccaagtttttctacttgctcgaaaagaaatatgaaaagatgaaaatttactgtgatggctagttttctgtaagacattaattgtatttttcaaagttttgtttcttagttgagcctaattttcttaagtcagtagtgagaacaccaatgttgggtaactgactcctgtgaaaaatgcatagtatctgagagggcacttttgaagtatcaggcctgaattttcttgacatgcccgtagaaccatttgtgacaatcaatctaaccataattttaacataaattgtaggtcctgtcttatactctgggaaagttgataacaaatgaaaagaaagtcaagttgtttccttaatttgtcttttaaagtggcatatattgtttttatttgatttgaaataaaatgttacagtcaaaacagcattaacacctatgagtttattttagccttgaccaataatgtatacatattattatatatagacaaaataaatatgtagccttattaccaaaagagaattgttaagtaccagacatgaattaaatccctttataaagctcctttatgtgtcacaaatttgattaaattgcagataaaataatgcagctcttcaccctgcccaacatcatgctctagacagctattatgcagatgctagccttgatcttccaacatcaccacattaataggattgtgtagtagctaacggttaactcctataaaaaaatgtacctccattgtgcttctaaaagtttaacaacaaaggtatttgttctgaatttttattacagctgtaatatttttatagataatagactgtaacataaatattatccttagattattgctttgggagaaaatgcttattgttaaaacacaactgtgttgatgatctttttagattttgtttatcttcaagggaagataaacattggtaaagattatcttctttaatgtttattattatttctttcaaggtcttttttttttttttttttttgaaatggagtctcgctctgtcgcccaggctggagtgcagtggaggcgatctcagctcactgcaagctccacctcccaggttcatgccattctcctgcctcaccctcctgagcagctgggactacaggtgccaaccaccacgtctagctaattttttgtatttttagtagagacggggtttcaccgtgttagccaggatggtctcgatctcctgacctcatgatccacctgcctcggcctcccaaagtgctgggattacaggcgtgagccaccgtgccttgcctctttcaaggtcttttgtagcaatctgaaaactaagtaactaatttatatacaatgaaagtctttattttctcttaaaatatattttactatttgctgttattgcatttttcataaagataattatataacagaacagaccctgctttttgtgtgtgaaagtgtctgggggatagattagagaattaaaaagaacagtatattctgttcatttggaacactaagggtgtggaaaaggaaaatatcatcttttttctcctttacttttgatgaaagccatatctaagcctgctttatctacataacacttttcaatttcacacaacaatgttttaaaagttctaaaatactacaaagaaaaaaattaatttgttattcaacagatacatatattaaagatttgcaaattacattaaaaattaaatgacaaattatccgaagatacaacacccattaattatgagaaacttcctatatattggtcattttacatggcctagttatgacactagtaggaattgtttggttttaaagtcttgtatctgattccaaactctttcagctcaccgcacaacagccagtaagttgagagacaaggatttggaacaaggtcagtgaccttatttagagagctagcaaactaagaacatggtggactaatgtcttaaccatcttaagtcagtaaacatttcaggttggttttatgttaagggaaggggaaaaaagaaagggttggagtccagaggtgactcatgaccacagatatctgggtgccagcatgggtctggtctgaggaggccatgaaatgcctccatccttggtcgggtcatgactctccgacaaatactcaacactacattgttacgtgtgggtacactatttttatcttctgggttagttttcataaggaactgttatttgctttcaactatacaccaaattcctctcgtagttagcttggcctacatgcagaaataagcaaaagcagttaccctaaaagatatcaccacaaaaggagtgatgagtttaggagcaaaatggagttagtcatgctaggcctccttttcactgctacaatttccccactctcaaaggttcattccaaaatcttgtggaattgaggacaatgggatgttgtctcccatctgggtactactggttggatggggttgatgagggatgactgtggaataaaaccatttgacctggctaaggaaatattccccttgtaggcttgtgggttcccactatcactttgcatgtagtgtctaatgagaagaagttgagtaagaaagaagcatggaacttctgggtgcatgcttcctgatatacagcatatagttgtactctatataccctatatacagcaacaactatatgatcagagttgtcatgtactgaacaaggtgtaggatggcaaattcagcagtgggggataggttagtggaagtggcaatagactgagaaatcctaactacttgggttgccaaacatatgaaaatctccaaaagacaagcaagacacatagggttttcatttttatttcatttatccttttgtgaatgagtaactttaggtccttcaagagctcatatgcccactgttttcctggtttctggaatggtggggtgacctgacccaagtatgatatacccatggctttaatccatcaagtttaactgatgaatgggtattcagcagcacctctaacagtcccattcacttggcaacaaattggtgttcaggtcctttttctttccaagtctttaagaagacccctcctggtcaaaaaggatgtgagaccacatctgtgggatgagtgatcctgctagaagaaaagtcatgaacagaagttagtacagtgcctacagttaacatatttggcaattgctaaatctcttaaaatatcagttcgttctccagctgaaacttgcaatgacctatcatataatgtttcaaagagattcaatttgagcatacttgagggagctactctaatctatggcagggcaactggcaatgccttattccaagttaaattagttctttgaaaattttgatgcttctttttagactgtggtttatcttttcaatttttctgtcagttatcgtctccaagctgacaattcaaaggtttcaggaaggaatgagttacagcttcccttgacattcatgtaaccatcatagtcttcttcaaatcagggatagatgggtgttaactacagaatctgtggcccctgcatcaataagaaagtcagtaagtttcttccccactatcaattgtactgggactcctatggggatatgatatcaggttggctaaacatacatatttaacaggttataggagaatctatgagtatttataaaggcagtcctaacacaggcatatttacaaaacatacaggtaacatatggttaccttcaggtgaagacttaacacttgcctgtcatggccttatgtcctgtttatgatttggtatcttattgccacaaagagtttgttctgttagtctaatggtcattaagtctgctgagttattttctctaaaccataaaagggaggagggataacatgacatatctgacctcccatcccttagttcatggctgggaactaagtttttaaggtttttttctggggctcccttggccaagggaggtccatttaattagtgagggacataggattctacttttttcgtttatataccctctttttggtcaaaatatgccagagacagcatcaatgaccaagcttttatttttttccatatcattgctggggtagtgtggctacctgccctaggtccatactatccctcgatgggacccctatggcaaagagagttagacccaaatgacttaaagctagttaataattctaggcatctgtgggaatggagttgggcagatactcattaaccattataactttttcaagtaacataagagccaaaaaccaaaagccaaaaagcaagattataaaatcaatttatctataagttttatgtgttgaaccatcagccatttaggcatctgtgaatccatctttgatttggagagtttgaactagttttagctctcgaaacagaccctttaaaatttcatgtgcccatctcttctgcaatagtccctgggcatagagggagggtggttgattttgtataactttaacagcagtatgtttgcagtgcaaaatggattggcctagtgggattgaattgtttttaaattctgaagagaaacaagacataaagtattagcaaggtttcaagcaaaaaggtcataagccttgtctagttatgggaatgactgaaaaaggaagctcacaggtagctaaacattcaaactatctagcatcaaggatatagatagaggcacaattataaaatgaatccaaatctctttgaatagtggcctatccctgtgtctcatgaaagcagtttactttgattgtcatcttttcccagatctaaagatgaggctttggttaacttgagtttggtgtcagataatggcaggagtgagtgccttctttagatgagatatgtgtacccaggagtcaaaaccctgtaacttaacagcacaaggattgcttaatagtacctgataagtattgatatggtttggttctctgtccccactcaaatttcatcttgaattgtaatccccatatgtcaagggaaggacctggtgggaggtgattggattatggatgcagtttcccccatgctgttctcatcatagtgaaggagttcttacaagatcggatggtttaaaaagtggaagtttccccctgtgcactctcttctgctaccatgtaagacgtgccttgctttccatttgcctttcaccatgattgtaagtttcctgaggcctccccagccatacagaattgtgagtcaattaactctcttttgtttatcacctggctggaagttataaaaagattctgaaacctttaagtgattaactttatagctttgacaagtctccagtaatctgagacttagttttaaaattttattttgaggatgtttatcaaagatgttaaagggctcaaaatatttgaacaaaacagaataatagttattcatttaaccaaatgtgataatcaaaaactttaaaagcaatacagaaaattacatacatgtagaaattttaagccttttaaatttcagtttgcccaagtaattaaaaacctataaatataacatagggattattttgataaaatgtaaaaactttgttttttaggccagttacgaaaaaggcaaagaaaaacctgcaatgtgattgcttctccttatgggaaactcatttagataacctggaagtcaaacttgatgaaaaaaggactcaaagtcaaacttgatgaaaaaagaactcacattccatcaaacacaggaaaagtgtgtcccaggttattagtatgtcatggaaatgcatgactcttagtgactgcatgggaagttcttgggttacatggaaaaattcagacatatcaagaaaagctgagtacaatatcaagttgtattcaaggaaaacattgcttttctatataaaacatttccgcatcagtctacaacaacagttaaaactggaggaaaaaagttatggaattggatgaagaagttgaaggagagcattatcatcttaggccttctcaacagaagaaaaagctgaaagcagtgagatacaacaaaagttgaacttctgagatatgaatctgaaaagttttcaaaaagaaacaggttatagaattaaaaatcaaaattctagtaattttattaggagcaaaccaatgccttaagaaaacctcatttaacatagaggaccaatcatagaagaactattataaataattcccttttaaaaaaaaaactaactgaatcacatcaaaattgtttttataaattctctttcacaaaccttattacaactttcaaaaccatctacagcatacttggactttctgatttgttctgtacttccctcttttctcaataactagccattttactttaggaccaaaatttaccatataagatcctttcttacacacaattattctctttttaagctttcctactaaaaatacatcttcatattcatagccttcttcatacttctgtcttctacttactggttcctttctaccttatttcagaaacaacttttaaataatctccatatcacctaaatttattttttctcaatagtaacacagctttacatgtcttataatttattctctcatcaaagcccacatcttaccttgacactttatatagagaattattatgtcaactagaattcttacttttagtaaccttaaattttagtgaaaacctaggaggcaagaaatcctgaataatctatcagatattaatatgttatggatgaaaacactccaaaatttttataaacgtgtttccccatatcaaaatcctttcttaattgaaaatgactcagatatccaatcagcacctatttatcaattgaaactaattttaagattttaaattacacaaagtaaatagaatcatttattctatttacatgtactcaattctttcacttatgacactttacctaaattacatcttaactcaggtattaaacaaagccagtcatcatttaaatttatttccctgttaaccatttttaaagcctgtgaacatcagggttcatctaagtaagaaccttaaagttaactcatgagcattttgccaataactcagatgattcagctgttttcattgaacaaacgatcttgtattcgtcttatttgtcaaaaaaatcacataaacaaagactattgtgtttttggttgggtttatagtcttatgatctgatgccaaaccctgatatcttaaaatatctatcaaaggcaaatataaaataatcagtaaacccaaaaatgtgtggtgaaaattccaaagacatttctattgtattttagtaataattttgaaaccatttttatttaccaaagatacctaaattcacatgaacttgcaaagcatttgagcttatttaatgtacaagtactcatttacttataaaccaatttgtagcatgctagacataacaaataatgcatctacatacacataaacacatctaaacagatatatacacacacaagccaagatccaattgtttttaccttaaaattctagccataagatggcatcacaaactcactggcctgtaaatgccacccctgtggtctactggctaacatttggtactttcgctggcctctaaaagatagctggatccaaattatgtctgaaaacatatgccaaaactttattttccccagtagataatctggtgaaggatgtagaccaaaattatgggtaaaacagttttcatggcagtttaatttttttaaaaacctgttttatctttttttccttccgtttcaaatgaattttcaatgtttacattttagctagaacttgctgaactctataaggaaacagaatttccaagtaacttcagattagttggtgctatataaaaagtgagttttatctcaacgccagtagcttaataatgggaaattcaaagcaggcagaaaggaaagagagcaatagaaagtgatatggtttggatatttgtccactccatatctcatgttgaattgtcatccccagtgttggagctggggcctagtgggaggtgtttgggtcatgggggcggacccctcatgaattgcttagtgctgtcctcacagtaatgagtgattctcagtctattagttcacccaagagctggttgtttaagagccttgtacctcctcctgtctctctcaccatgtgacacacctgcttcctcttcttcctcgatgaatgaaagctttctgagacctcaccagaagctttccagaagccagcaccatgcaaaaccattagccaaataaacctcttttctttataaattacccagacttaggcatttctttatagcagtgcaaaatggactaataaagagttttagaagacactacttaactctgtagttgcaggttaacaatttgatctctgatttttcttgctataatttgcctatcagtttaaaatgtacacagaaatgggccataatatgtaacagctgtaatcccagaaaacctagcatgcatttgaactttctcatattttaaaacatatagcccagggcccacaaaaacaaagacaaatgcaaatgaactgcttctcaaatcagatacaagtccaacactattccccctctccaacaggataccccagggtaaaacaaaatggctggttcaaggaatgaacccaaacagagggaaaagggagttcccggctgtaaacaccagagcaacttgtcctgcttctgaatcgagtccattcactcatagagatttttcaataccttgtttcagcagtatgcatagagacagccagtactgccaagggaactagcaggggtccctggaggaaaaagtctccagcagctgatagggacatagccaggaattccttagctggggccagctggccaggagcaacttctcctggctgcaggcttccccaaattgtgagtccaaactatttctgcttgctgcatgacagccaatgcattgagagacaaagagttggaggaaggtagacaactttatttcagggagccagcaaacagaaaagatgggggactaacatcctaaaaaaccatcttaagtcagtacaaatttcaggctcctattatgttaagatcagggtgaaaagaaaggagttgggattaagaggtgaccaatgactgcagacatgtgggcaccagtgaggggcttaggaggccatgaaacgtctccatttttggtcagatcacaatacccccacaaattctcaacacaacattgttacttgtgtattcaccctctttatctcctcaggggttagttttaggaagggagtattatcatctttttttcaaacaataaatgaaattcttcccctagttagcttggcctaaattcacagataagcaaaagtatttaacctaaaagatagcaccccagtggagtggggatgggtgttgtgaggttacaggcaaaattgagttaataatgttaggcctgcttttcactgtcatagtctgactagagtgtagagtgccataagggcaggtgacagaaaatgtggctggcaagattgttttcaaactctgaagagctctgcatgcaaggaactttgggttttgttctccaggaaaaaaagaagtctcaaaagtttttaaagatcaatcaacataagtgaataaaaattaacttaagaagatgtgaatatgaaaaaagaaacaggattggtatgttatcacaataattcaaatgagagatgatgagctttgaagttacgcattgacaataagtgcttctcagatgacaagaattgtcattttcaacatgtcactgacaggacttggaaattatttgactgaaggaagtggtactaagagaagaaaaaatggcatggtgcattaactagaacaaggaacactggtgatataacgggtgttgtttcttcataattaaaaatttttcaagggctatgtggaaggaagaggaaataaatttaataccaaaatttaaactgaaaaatagacaatttgggcataggcctcagaggggaaaactgagactaggggtaagaatttgagagtgactattacatataggtagtaactgaaaccatatctgccatgtgatcaccagctaaagcaatgcaactattttaccaaaagagaatgttgtgtcaaaaggggttaagaaaaaaataatttaggaaatatttttggttgggcacagtggctcacatctataatcctagcactttgggaggccaaggcagaaggattgcttgagctcaggagtttgagaccagcctggccaacatagggaggccttgtctctacaaaaattaaaaaatatatattgtctgggtatggtgatgcccacctgtgatcccatctattcaggaggctgaggtgcgaggattgcccaggaagtcaaggctgcagtgagttgtgatgacaccactgcactccaggctgaatgatggagtgagatcctgtctcaaaaagttattttaaaaaggagattttttaaaataaatggagcccaattataaacaatggaatggtttcaaaaatggttagagttgtcctaaatgtagttttttttaatgaaagaaaagaaaaagaaacatacaatgatgatattattagaagaaattattttttaacttttattttaggtttggaggtacatgtgaaggtttgttacgtagtcaaacatgtgtcatgggagtttgttgtacgtattattttgtcactcagatattaagcccagtacccaatagttatcttttctgctcctcttcctcctcccaccttcctcaagtagaacccagtgtctgtttccttctttgtgttcctaagttcttaacatttaattcctgcttataagtgagaacatgtggtatttggctttctgttcttgtgctagtttgctaaagataatagtctccagctgcctccatgtcccacaaaagacatgatctcattctatttttatggctacataatattccatagtgtatatataccacattttcttaatccaacctgccattgatgggcatttaagttgattccatgtctttgctatcatgaatagtgttgcaatgaacattcacatgcatgatctttatggtagatgattgctattcctcttggtatatacccagtaatgggattgctgggtcaaatggtagttctgcttttagctctttgaggaatcaccatactgctttccacaatggttgaactgatttacacccccaccaacaaggtgtaagtgttcccttttctccataacctcaccagcatctgttactttttgactttttagtaatagccattctgactggtgtgaggtggtatctcactgtggttttgatttgcatttctctaatgatcagtgatactgagcttttttttcgtatgcttactggccgcatgtatgtcttcttttgagaagtgtctgtgcatgtcttttgcccactttttaatggggttgttttgctgttgtaaattttaagttccttatagatgctggatattagacttttgtcagatgcatggttggcaaatattttctcccattctgtaggttgtctgtttactctgttgatagtttcttttgcagtggagaagctcttaagtttaattagatcccatatgtcaatttttgcttttgttgtgattgcttttggtgtctttgtcatgaaatctttgtctattcatatgtccaggattatattgcctaagttgtcttccaaggcttggataattttgggttttacatttaaatcttcaatccatcttgagttgatttttgtggaaatgatccagcttcaatcttctgcatatgactagccaattatcccagcatcatttattgaataggaaatcttttcctcattgcttgtttttgtcagctttgttgaagatcagatggtcatagatgtgctgccttattttggggccctctattttgctccaatggtctatgtgcctgtttttgtacctgtatcatgatttggttactgtagccttgtagtatagtttgaagttgagtaatctgatgcctccagctttgttcttttttcttaggactgccttggtttcatatgaatttttaaataatttcttttctagttatgtgaagaatgtcattggtaattagataggaatagcattgaatctgtaaattgctttgggcagtagagccattttaatgatattgattcttcctattcatgagcatgagaagtttttccatttgtttgtgccttctctgatttctgtgagaagtgttttgtaattctcattgtagagatttttcacctccctcgttagctgtattcctaggtattttattctttttgagtccattgtaaatggaattgcctttctgatttggttcttggtttggctattggtggtgtataagaatgctagtgttttgtacattgattctgtatcctgaaactttgctaagttgtttatcagctgtaggagctttagggctgagactatgaggttttctagatatagaattatgttatctgcaaacagagttagtttgaatctctcttcataatcggatgtgctttatttttttctcttgcctaattgttctggttaagacttccaatactatgttgaatagaagtggtaacagaggccattcttgtcttatactggttttcaaaagaaatgcttccagcgttttcccatttagtataatattggctgtgggtttaccatagatggctattttttttcttattccaaaaatgtaatatgatttaatgttaaagacaccatttttttctttgttaaaattaaaagatgtttctgaggtgaaaaatactatgatacacatataaaaccaatggccaaataacttatatctgtaatcacatttttgaacctccagaaaatatttctttaaaaattttgatttggtgataataacaaactccaaattaaatgttaccaacctataaaaaatacatttactttttaaatatggagttttttggttaataactaaatggaaagtgttacatttaaacctgtaatttaaaaaatgttgagtctccatttttacttttaataactaagctttatgttgatcggggaagttttaagagtagatgactttgcattgcatctagttacttcttgctagtcatgtatacatataaaattagttgaggattatcactactgtatttattttgtatttttctttaagcctatcattctcaaatttgtatttttcacagtaatgcatttttaaggaatttattcatattatcttgattgacatattgtaccataattttaaaatgtatagggtacaatgtgatgttttgatatatgtacacagtgtagaatgattaaatcaagctaattgacatatctatcacttcatttacctatcattttttatggtgagacatttgaaattcactctctgagttattacgaagtatatatcattattgactacagtcatcctgctgtgcaatagagcacaaaacctgttcttcgtgtctgtctgaaactttgcaccctttgatcaacaaccctccattccatgtctccccacactggctcagaggctgggtaaccataattctactctctacttctctgatttcaactttagtatactccacatataagtgagatcaaacctttattgttaataaaatcatgtagtgtgtgtatgtgcatgtaaatattgctacaaagagaatttgttaaaataataacctgttatttgaagagtttgataaaattctggtaacaggtatcctgcggtgactttggcttctcaagtcagaaacaaatttaatctggtttccttgtcatttcaaagcttgtcattggttgtctggatttagtcaaaacatgaatttacttattatctgtcttagtgggtttgggagcatctttgtaaagaacaaagttctgtgttgggtacttaatcatttgtatggccagcaaggacagcacattatacagaatgctcctaactacatgaaagaaattatttcctgtgtgttgttgtatatgtgagggtatgcgtatctgtatctgagtgtgttttgttgatgccatcaaaaatcacttctcaacatcctaaataataatcacattccctttaactgcagacagtttttcttagcagaaaagcattttaaataggagcactggatctcgcagaatttctatgaattttcctggaaactcagcaatttacttagttctggaacacttgctatcaaatgcaagaagagaagcttttagaaggtagagctgttttccagtagtttatatatgaaacaaattgcactcccttgccccatctgtactaatggagcaaaggagacatttagagcagtaacttcaacaaaaatactttttcatatagattacaaagagcatgtaagggcaggagaagtccagtagaaaatcttagaggtagcaaaggcaaactgaggccttcattatccacttgtttactattttacagtggtaatattcttagaagttcagtttaaggctctttaccttaaaacagtggatcactaataccctgccctgaccacatcacatgatattctcaaaatgtaattcaatcctaatgcaaaaatgccttgtacacttcaaagtgctataaaaatatcaggtaaaatgcaaacagaaacaaggtatatgtattactgaatatagcagtaattttattgaagttttctgatctttaaaggcagagaaagttactgaaaacataaaaacattcattcgatggtagagaatataaagtctaaacagtggaattcttggaagatttagaaaagttaatgaaacattttatatgcaatttttattaaaacctattgtcaaaaagttgaatcgaatcaatgaaacttcattttataaataacatgtctatcaaaggtactgcaataaaggtaaagcatttcttaggcatctagagtaagttaggaattcagtgtgttggctcagggtccaaatcagtttaacaaactcaaattttgtatgtgtccagtttctaaggacaagagtacaaaggagtacaaacctgttttctcaaacagtgtgccaatggcaggccatctgtactcttctaaaccactctcaatcttgcccttaatctgtaaatatcacccatcctcttataaatccctttttttggatatatgaaatgcatattgatacatatcaagaatatatttattgataagcccagagccttgttatgtaagtcagcataagtgtttctttaatctcttatagatttttaatcaaataaatctaatcaaaacaactccgtgcattatctagtgtattgtatgtggtcattcactgattcaattttattttcatgatattataaaaaatttgaaatatgtctaatgaaagctaggatataaaattattttctggatgggtgcagtggctcattcctataattccagcactttgggaggctgaggtgggaagatagcttgaggtcaagagttcgagaccaaccggggcaacatagtgagacagtctctacaaaaactaaaaaaagaaaaaaattagccaggaaggcagtgtgcacctgtggtcccagctactcacaaggctgaggcaagaggatcacttgagcctgggagtttgagactgcagagagctatggtggtgccactgcactccagcctgggtgacagagcaagaccccatctcaaaggaaagaaaaaaagaagaagaaggagaaggagaagaagaagaaaagaaaattacttcatggtgaataaaatgtatttcattgccttgtaatgatgtgaagccttgtagcattttaatattatcttcttgtgaaaacaatcttcatggtaacccaggaggcaagctgtcagctgtgagaactttgggaactcataatgatgattatttcatttatttatttatttattatttatttacatttagagagatggtctcactctgtcacccaagctagaatgcagtagcacaatcacagctcactatagtctcagactcttggacccaagtgatcctcccatctcagcctcctgagtagctaggactacaggcacattccaccattaccagccagctttttaaatttttttgtagagacagggtcttgctttgttgcccagggtggtttcaaactcctgacttcaagtgatcttccacctcagcctcccaagcattgggattacaggcatgagcgactgcaactggccctggaactaatgattgttaaaatttgcttccagtggaaaatatggctccagggatatttaatttttatgtcattaaaaacctttctttaaaaacagtaataataatcattcaagatgaaaacatgaattaactttatattaaacttttgcccaaaagtcactatggaccagattttattggaagtttcatttattgtatttctcaacatattgtggactgccaaaaacattaataatgcaaatccatgtctgaatacaaatgaatccctacaaggccagtgttgattattaatggaataaattatctggctacttagtgcagttactgtggtttggaataccagttaataatgaaagaagggaatttttaaaaaatgtatctcatagtttgaattgattctaccatacaagagatcaaagagaaaatactgtggcaacaatgccttctccctttttcctttttctcatcaataagaaactcttctgcaagcgcatttcattgttattttccaaatacgaagaagtagacttgtatttttcagaagagccaccatttttccaaaaccagaaactcaagttttatgttgcccaagttatttctgctacaggaatgttgggactgtttgaggctaccttttcccaaggaccccaaaattgccttgaagtatagaacattgtgtcttctttcagagtttccatagctacaagtatttgcagaaagaatactttgcaccttggtagttttcataatgctttatttgtggtgattttataagtgtaaaatagaagaaagcagagctgctagtctggttaaagaggacatgaaagcatatttatatgccttcacccataaactcaggaagacactgagccatttcccccagaagccttacaggtctatggacatcagcttgaaatcaactacttacaggaaattgttgtatgcatgagaaaaattaatccatgtgagcatcacaggttcatctcttaatcttttggcaagatttactcatttaataagcttaacctgaatatgacatgcctattatagtatggaagaatatatgtgtaatcatataatatatatattatattatataaatttctttctccagacagaaaggtttgctctccaagatgggagatttttcactgtacctttatgaaagtttgatggatagtgtgtgaggtgtcgtaatttttggtttgaccactttccagccacccactctgtcattgtaacatgccatctggttccagaccctaatgatacctatatttctctaccactatttctttattgataattcttgtttgcagtagcactataataatgtgattatttacctctgacctgcgtattagcacacacacttccagaaacaacagatttgttgaaatatcatttttaatgtctaataagttaaactcccttactatctataatataaaagttcatcataagtacaaaaggaaacatatattgtttgcctacatatcaaatagaaatatgtattttaaaaagttctcattatcagctgtaaatttgatgctggcccaatatcattttttatagagaaccacagtataaaactcaccctgtttttggttccatatgaattttaaagttttttccaattctgtgaagaaagtcattggtagcttgatggggataacattgaatctataaattacctcgggcagtatggccattttcacgatattgattcttcgtatccatgagcatggaatgttattccatttgtttgtgtcctcttttatttcgttgagtagtggtttgcagttctccttgaagaggtccttcacatcccttgtaagttggattcctaggtattttattctctttgtagtaattgtgaatgagagttcactcatgatttggctattactggtgtataggaatgcttgtgatttttgcacattggttttgtatctgagactttgctgaagttgcttatcagcttaaggagattttgggctgagacgatggggttttctaaatatacaatcatgtcatctgcaaacagagacaatttgacttcctattttcctaactgaatatgctttatttctttctcttgcctgactgccctagccagaacttccaaaactatgttgaataggagtggtgagagagggcatccttgtcttgtgccggttttcaaagggaatgctttcagtttttgcccattcagtatgatattggctgtgggtcatcataaatatctcttattattttgagatatgttccatcaatacctagtttattgagagtttttagcatgaaggactgttgaattttgtcaaaggccttttctgcatctattgatataatcatgtgatttatgtcattggatttgtttatgtgatgtattacgtttattgatttgtgtatgttgaaccagccttgcatcccagggatgaagccaacttgattgtggtggataaactttttgatgtgctgttggattcggtttgccagtattttattgaggattttcacatcgatgttcattagggatattggcctaaaattctctttttttgatgtgtctctaccaggctttggtattaggatgatgctagcctcataaaatgagttagggaggtttccctctttttctattgattgaaatagtttcagaagaaatggtagcagctcctctttgtacctctggtagaattcctaccagaatccgtctggtcctggaatctgtctggtccaggactttttttggttggtaggctattaattattgcctcaatttcagaacctgttattgctgtattcagagattcaacttcttcctggtttagtcttgggaggctgtatgtgtcctggaatttatccatttcttctagattttcaagtttatttgcatagagatgtgtatagtattctctgatgatagtttctatttctgtgggatcagtggtgatatcccctttatcattttctgttgcatctatttgattcttccctcttttcttctttattagtcttgctagcagtctatcaattttgttgatcttttcaaaaaaccagctgctggtttgattgatttttttgaaggattctttgtgtctctatctccttcatttctgctctgatcttagttatttcttgccttctgctagcttttgatttgtttgctcttgcttctctagttcttttaatagtgatgttaggatgtcgattttagatctttcctactttgtcttgtgggcatttagcaaagacaatcccaagcaaaaagaacaaagctggaggcaaaatgctacctgacttcacattatactacaaggctacagcaaccgaaacagcatggtattagtaccaaaacagatatatggacaaaggaaacagagcagaggcctcagaaataacaccacacatctacaaccatctgatctttgataaacctgacaaaaacaagcaatagggaaggaattccctatttaataaatggtgctgggaaaactgtctagccacctgtagaaagctgaaactggatcccttccttacacagtatacaataattaactcaaggaaaattaaagacttaaatgtaagacctaacactgtaaaaaccctagaagaaaacctaggcactaccactcaggacataggcatgggcaaggacttcatgtctaaaataccaaaagcaatggcaacaaaagacaaaattgacaaatgggatctaattaaactaaagagcttctgcacagcaaaagaaactataatcagagtgaacaggcaacctacagaatgggagaaaatctttgcaatctacccatctgacaaagggctattatccagaatctacaatgaactccaacaaatttacaagaaaaaagcaaccccatcaaaaagtgggtgaaggatatgaacagacacttctcaaaagaagacattcatgcagccaacaaacatgaaaaaatgctcatcatccatcactggtcatcagagaaatgcaaatcaaaaccacaatgagataccatctcacaccagttagaatggtgatcattaaaaagtcaggaaacaaaaggtgctggagaggatgtggagaaataggaacacttttaagctgttcgtgggactgtaaactagttcaaccattgtggaagacagtgtggcgattcctcagggatctagaactagaaataccatttgacccagccatcccattactggggatatacccaaaggatgataaatcatgctgctataaagacacatgcacacgtatgtttattgcggcactattcacaatagcaaagaattggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactatcacaaggacagaaaaccaaataccgcatgttctcactcataggtaggagctgaacaatgagaatacatggacacaaggcagggaacatcacacactggcgcctgtcagggggtgggggctgggggagggatagcattaggagaaatacctaatgtaaatgaggagttgataggtgcagcaaaccaacatggcccatgtattcctatggaacaaacctgcacattgtgcacatgtaccctagaacttaaagtataattaaaaaaaaaaaaaactcaccttctttggtactttctaacagcaaagaataactttcagaattaaaatataataataatctgcaatttgctgactaccaaatctaaagtaataccaacaaaatgtgattcagggttccttccttaagacattttcatttaggattatgctattctaaagtagtttacttttccagggatttctgtgatttattttttaaatcttttttatttctaatttttgtgggtatataatagatacatctatatatatatacacatatatctagatatagatatatctagatataatatatatagatacagagatatatatatctatatctaatatatatagatatatatattatatatagatatatattagatctagatataatatatctagatatatagatatatatgtatatagatatatctagatatatagatatatatgtatatagatatatctagatataatatatctagatatatagatatatagatatatatgtatatagatatatctagatataatatatctagatatatagatatatatgtatatagatatatgtagatatatctagatatatagatatatatgtatatagatatatctatatacgtatatagatatatctatagatatatatatatagatatatctatatatgaggtacatgagatgttttgatacaggcatacaatgtgcaatgagcatatcatggagaatgggctagccatcacctcaagcatttatcctttgagtcacaaacaattcagttacactctctgagttattttaatatgtgaaactaagttattattgactatagtcaccctgttgcactatcaaataatagttaatagttcattatttcttttttcttttttttttttttgagatggagtctcactctgttgcccaggctggagtgcagtggcatgatcttggctcactgcaacctctgcctcctaggttcaagtgattctcctgcctcagcctcctgagtagctgggattacaggggcccaccaccacgcccagctaatttttgtatttttagtagagacggggttttcccatgttggccaggatggtctcgaactcctgacctcaggtgatccacccggctcagcctcccaaagtgccaggattacaggcatgagccactgcactcagccatttattctttcaatttttgtttttacccattaaccatccacacctcccacttcaccatcccctcactccccttcctagcctctggtaatcatccttctactctctatgtccataagttcaactgttttgatttttaggttccacaaataagtgagaatatgcaatgtttgtcttacttggcctggtttatgacttaagataattatctccagtttcatccatgttgttgcaaatgactgaatctcattcttttttatggccaaatagcactccattgtgtatatgtaccacattttctgtattcattcatcctttgatggacagaggttgcttccaaatcttagctattgtaaacagtgttgcaacaaacataggaatgcagctacatctttgataaattgattttctttcttttggatagataacccacagtcggattgctggatcagatggtagtgcaatttttagatttttgaggaacctccaaactgttctccatattggttgtactaatttacattcccaccaacagtgtacaagggttcccttttccccacaccctcaccagcattgattatttcctgtctttttgatataagtcattttaactggggcgagatgatacctcactgtagttttgatttatagttctctgatcatcaatgatgttgagcaccttttcataagcctgttttccatctgtatgttgtcttttcagaaatgtctattcaactcttttgctcattttttaattagattattagatttcttccctagttgtttgagctctttatatattctggttattaaaccctggtcagatgggtagtttgcagacattttctcccattctgtgggttgtctcttcactttgttgattgtatcctttgctgtgcagaaggttttcacttgatgtgatcctgtttgtccatttttgccttcgttgcctgtgcttgtggggtattgggatttctatgatttaaatagcgagagtttaaattacaattagacattctagttcatacaccaatttcagtcaattaatgtttgcattaaatatatctcagaggaatgattttttttaaaaaaagtaatgcttggaaaataaatttatatcaacattcaagtttttaaaatattgtcccatgttttcctttcaatttttttcttatttttacttcaatttgctttgagatattttgctgtttattttatagtcttactataaatgaaaatatttgaaagcctataaattatgtgtctcatgtgtacagctgagtataatggtcagagttgaatgggtcagttagatttgattcagtttgatgaacaagagcaaagccataactgtgttatgctgatagtcacggcaataatttcacaatatagatggtcatagtattctcaatacaacagtactactgtttcaatagagcaaactaatttcatatttcctcgttttcacccctttggggccacaaaaaatgtatttgaaatttacttgttccattaaccacatactcaacatttaaaagctgcaaaatacttctgattgtgacaaaaaactctcctaagaattccctagaaatctctttataattctttcctattaacaaaaagtaaaaaaaaaaaaagatgaagaatgcagaaggaaagtgaattcatatatgtatatattttaagtcttataaattcacagctgaaggggaattcaatctgtattgctattgaaaatatatacagtttattgcaatttaaacgttttatttcctcacagtttgacatgattagaatgattgaagaaaattttttaaacactagcgtagcttaaaaatgagcaaacaaataaaaaactgaaaggtttggatgtattcacatccttgtcagtctgttataacgcatgtaatggaatcagcttggagtcggcactcaaattttgttataaacaaaataataaaaagagaaagacacacacacacatacacagaggaagagagagacaacagagaaggagagaaaggaagataaaaggatgcaaaatggatttcaagaacccaacttttattaaatatttattttccattgtaatatctcttcatttaatttttaaagcctagcaagttattttaagcaattctaacataaaaattacccttccaacattttccaagtgtgcagtacaatattgtcagccacatccacatggttgtgcagtagtgctcagaaccaacccacctccaccctttcatgacggaaaccctatacctttagaagactccccagtagctcctccccaagtgctgaaaaccctcattctactttatgtttctttgtctttgattacttttgataccttataagtggcatcacacaatatttgtttttttgtggttggcttatatcactttgcacaatgtccttaagttcatccatgctgtagtatgacagggtttctttcattttgaagctgtatagtattctattttatgtatgtaccatattttctttattcatttatctgtcaagagatgtttaggcttcttccaccacttggttattgtgagtaactttcttcatgtcattttatattcaattgaaaactgtcaattgttccatctccaatctgcccacattgttattttgatttcctaattttagtttttagcaaagatgttgaaaatgtgcatctgtgcttacttaacattcactatatattttttcttattcaatgcaggtatttagataacaataaggtagtcctgttcaaggtgaaatagcactgtgaggtgataaataatggaatgctgtctgtccttgcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggtgagtatttatcatagattgtgttttttttttaattattatactttaagttttagggtacatgtgcacattgcgcaggttagttacatatgtatacatgtgccatgctggtgcgctgcacccactaactcatcatctagcattagggatatctcccaatgctatcgctcccccctccctccaccccacaacagtccccagagtgtgatattccccttcctgtgtccatgtgttctcattgttcaattcccacctatgaatgagaatatgcggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaattctttgctattgtgaacagtgccgcaataaacatacgtgtgcatgtgtctttatagcagcatgatttatagtcctttgggtatatacccagtaatgggattgctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttggctgcataaatgtcttcttttgagaagtgtctgttcatgtccttcacccactttttggtggggttgtttgtttttttcttgtaaatttgtttgagttcattgtagattctggatattagccctttgtcagatgagtaggttgcaaaaattttctcccattttgtaggctgcctgttcactctgatggtagtttcttttgctgtgcagaagctctttagtttaattagatcccatttgtcaactttggcttttgttgccattgcttttggtgttttagacatgaagtccttgtccatgcctatgtcctgaatggtaatgcctaggttttcttctagggtttttatggttttaggtctaacgtttaagtctttaatccatcttgaatttatttttgtgtaaggtgtaaggaagagatccagtttcagctttctacatatggctagccagttttcccagcaacatttattaaatagggaatcctttccccattgcttgtttttctcaggtttgtcaaagatcagatagttgtagatatgcggctttatttctgagggctctgttctgttccattgatctatatctctgttttggtaccagtaccatgctgttttggttactgtagccttgtagtatagtttgaagtcaggtagcatgatgcctccagctttgttcttttggcttaggattgacctggcaatgcgggctcgtttttggttccatatgaactttaaagtagtttgttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgata

SEQ ID NO: 13499 - DNA, 54245 bp, Human
caattttgtaacagtagttactaacccttttcacacattgaatggatggttctccatttctgtcaggatgaaattaaattcctcagcatggtttgtcatgaaccatctttctaaccgaattcccagccattgcatgtaaccattctgaaccaacccctttctgctttcttaccctggggcactctcacaaggctctccagagcttctcatgtcctgttgatgttgtgttatcttgaagcattctcctaccctttcccttttctttgctgggcttatcgcaacattttgcttcttcaaagctttcttcagctaagttagatcctctcctctaaaatgccttaacacctcaacccttcactctaacagtgaattcaaagtggtgagggagggagattggtgctagccatctcctttactcatctaagttcaagaaaaccattctacttgagtttctgagggctggggggctggaagtgactttgagaagctttctctgaggtcatgctggaggcacgtggaggatgggaggtgaaaacgctggagtggagagaagtttggagaactttctctgagactggaagagctcttacatacagagacctccactgacgggtgcctgggagattcacactgggaagctcaacttagagtgtctgagcccttaaagctgagcctcatgagtttcagggaagccccagacttcagggaatacatggcttagacgacgaggagtctattagacttgagccagagtgagatgaatgaaggtcataacaccctttcatgattaattggctgtctgaaattcccgaccttgcaacttttgaatggacttcgaggagtagcatctcatgtctgagagggatttcctcctgaatccagtagatgggaactcggggaacttaaaattcagtttagggagaaataagaggatgtccccctggtgttacaaacgacatctctattaaaaagtgtagcctactgggctaggaatgattgtctttcgtccctttctgactttgaattatttccgacaggaactagattttctgcatttcctttcttccatgccctcacacaaagcttggccgacttcgggccctgataaatagtcgttgcatgatgtagaatctgtaagcctcgttttagaaggttttgtgtggtagatattcctttgaccacctgaaaaatttcattttggtaccagtaagtagtaaaccaataattcacatctaagaacaaagtcgtttttagaaggttcatatgagtcccccaaactgacagttaatagagcgctgagtgtaatcactcatattttgggtgcgtaaaaatggttagattagaatttcttaaatttggttttaatttctgacatgccaaaaactgtttatcatgccatctgggataaattccttctgtcgtgtattttgtcatgttagtcaaatccggagagaatacagtacatgtattttgctttaatctgaaaacattggcagaatttgttcagacgtcgaaggggagatccgctgatccaatgacaagggtgttcctggcatccagcagagcccgtgtcgaggcagggatccctgcgggcggattggggttctgcattgagatgcaccgcgcagcgccggcgatggggccgccctgggacgatctgggctgccagggcctctctgcgggccgggcggggcggcagcgccgcggggcagccgaggggcgtgggagaactggcagagggtgcgccagagaccgctttcccgagcgcgaacgcccgggtggctgctggggagcagaggggcaggctcgggcagctcctcagccgcgccggcgatgataaaacttgagaaataacaaggagtggcctctccgcgtcctctgggtccaatccggtttcagaagtgaagttgctcccgggcaggcaagcctgagagaggccaaatacacttaaaaacaagcagcggcgagaaaagcacctcccgcgccctgcacctcggcaggtctcgctctcggcaccctcccggcgcccgcgttctcctggccctgcccggcatcccgatggccgccgctgggccccggcgctccgtgcgcggagccgtctgcctgcatctgctgctgaccctcgtggtaagccagatctcgccggatagggctggggtggggacgggggtggatccgccctggacgctgcacggagctggggacaaagcgggccgaaacgtgacaaccgcggctcagatcaatgctgcgggtctggtagcagccccaagttcgggcctgcaggagtgaggagagaaaacgtgtgtttgcgggtcgactctggactgagctttttgttttgagacaaggtgttcgattgttggaattctgagtcgcgctcaggcttcgctgcgctctggcgggcgccgtcgcgggttgggcagggggttgggattcacgcttctccccaggtggtggagctggtggtgatggtggttggagggcgcctttgggtggagaggatccctgagagctcaaagcacagacttgaaaagggatttaggggctgccccctccccagctctgggtcgcagttgacccggattggttcgttagtgagtggagccggggctgtgtccctgggtcccttggtggggctgcccctgagaagtgggtttctcggtatctcccctaaagggtattcagaagctcacccaagcggtccacccccgccagccacccagctgggggcgggatgtgccgggggcgcgaaagtgtgggaagaccgggccagaatgggggttggggtcgtgttgtgttttggggatgctgccgaggtgtggaggcgggtagagggtgacagtggtgggggatgatggatgcggtggggttgcgtcgtacttactccggctccggggaggactgcgcggccggagcacagcctggggtttcgagtctacggaaacctgccgcccaggacgaaatcctctaggagaggaagttagagacgatgctctgagaacacgggagacttgaagtgttcggaactctggcggcgcggttacacgcgaagcttcaggcttcaacagagtttcattccgcacgcccagaaaggagccgcggacccgcgacttacccgcatccatggatgcgcatggggtccgatgggagcgaggtctatacccgcgtcggcagtgagccgagtctggtctcgcggattcttactgcttcctggccctccaccctggcaagtgggagtgggtccaagggttgtcctcccttaaggtcagcgaggtatgaatatgggattggtagttatgatctacgatatgtttatggagaaggaattggacaaataagcgcatccatttgcccgggaactgttccaacaaagtatctgagcttatgaagtgactacaaatggaaacggcttagagaatgtgttcttttgtaatatatttaaaagcattttcagcttttcagtttacaagcatgcatttggggttttgtgtttcctttgcgaagggattgaggatggggaacgaaactacgggtgctgctctcagaatttctcgcattcgctcgaggctcccagaggccatggaagaccaggagctttcccggcaaggcatgggtgggggtgtcgagctgtggcaaggaagaaggtgcgcgtaaatctaaacggaggaagcttcagctttgatctagcacatactcgtttaagattttttttttttaaaataattccgttgagtttaggttaaatgctgtatctggagacttaaataccggaaagtgcacagaaaatgactatttcatctgcaattgtcagtttacaaacacttgcaatttcggaccggatgggtaaattaacacttctcttgaccatctcatgtatgtatttccttccttttgactcatacgactctcaacttttcaatataatattaatgacacggcattttagaaacatttttcattttatagagactttaatggatatctttaaaccattacttatctttaaaacattgtttgttctaaggagacagcttttcaaagcaagtctttaacaagaatctgagacttgttaaattttagtcttcccagtaagcagcccaacaggttgagggaattttcccattctgcatttttcctgtatctccttcccaccgtgtgccccaccacactctgaagtgtaaatacagtttctaataatcacacgcacaaagaaaaaaatgacagggagatactaaaaaaagaagtatatcagagcatctcactcactattgtaagtttttgattgcctcaaaaagtgttttttcctcttaatgtaaccagaattgttagggatggtggaaactaatttacatgagatcagttgtcttctgcctgttacaaataataagattcttttaaaaatatgtgttaatactgttatcaaatccactttaagattatgttatctagtatacattataaatggcacatacttggacacggctaatccatcattttgttaaaagggctcctcttctaaaggaactaaaatagttgaaacgtttgcaataactcccctcaaatctgtacttttcctctttggagtatatgaactctgcctgcaacctatgttgataaataggcatccaaatttttatatttgttagggttaatgtgaataatgtgagtccttaccagaaaaacttgtgatgtttttgctcttggtaatatttgatatattcatcattttaaattaaaagggagtatagtaatttctaaaggcttttacatttgtgacaagaagattaaggcaaataaaggaagtagatgaaaactagttttaaaactgcaagcttaaaaaagtcaaaattatagtatacgtatatttagattgatgcattatcagctaccttattaaaaggagattgttgatgttcctgttgagatacagctagatacggaagcacgttctgaataaataaatgtaagctcatgcacatttttggatcctgttgtaattcccatggcagtcctgtaccatatatggtatctgtggtgacctgtagttaatcatactttccgctgaaagtatgatagctggaattcccatcttacaatgagtttgggtggaaacaaatttattagactcatttaagtactgagaatgtagagcagtaaatcttgcaatttacctttgaagtggtaagaatttgaaaggtaatatttccattctgcagaagacttatggccacaggagaaatgaagagtttaaaattctgtaattattgtgtttaatccagaagatcctcttcacatttaagacattccataaatttccattctttttcttctctactgaagtagggtgtcattttagaaagcctactttgtgtatttactataaaattaaacaacagcatgaaagtgaaacaactgcagataacacctttaattttcgttctctctttggcattaaatttttccatcaggatttaatgattcgtctgataaggtttctatcatgcaattaatacaatttgcttagtactataaaatgcaacaaaactattttgcttaggctgcagtaggtaatactttatattatcatctttaaagtttgttatattttaatttaaaatatgggcattcttgtatacagaagttatttttattataaaatatctttaaaggtcattagttcatcattaatatactagtgtctttacattttttactttattttgttttcaataaggcatccaaacctcacaaaaacatagtatcaaatgacttcatagtttcaagaaacatactataactgaagtctattgaatattatccctttcaaaagttgtattaatgaattaactgtacattctttctaataatatcctatgcagcaaagaaaatgaatgagctactgctatatagttaggaactttgaaaatattagtaatgttccatttcttaaccttgaacgtgaataccctaatgttcattttattatttattaaaacacacacatgctatatgtaatctttggtatttataatatattttatgaagaacattttttaaaaaggaaagaaatgagcaatagagggtatcaactaaactaaacctcttgagtatagacaaaccctactctgagcaagtcaaaaatagaaaaggcatacataaaacaatattaggaatgaaaaggaagtatagttttggagagaacagatgttaaaaagtaaaataacatgaatagataattccaattaacttgaaaatacagacaaaacagacaacttcttacaaaatacacataaccaacattgacttgaggaggtatacaaaatctaaatagacctgtaaccattaaataaattgaattagaagttagagagctccacacacacttctttagatccaccaggcccaggtttgtgataagttatttctttcagaattatatggaacaatgtactttatgtaaattgtttcaaagaacaaaaaaatacagaactcttcttaactcattttatgaggatcgtatgaagttgaaaaatagtagcctgatctcacttacagacaaatatgtgaaatgagataaattgaaaacaaaccaatatatttgtaagatataaatattttatgttcttgtaaggcttatcaggaaaggaaacatgggttcacataagaacatctattattgtattttaacatagtatcaacagagaaaatgtatcaacagagaaaaactgattatttcaagaaagtggaaacatttcatttcaaaagaattcatagaattcatagcacactaagaatgtagagaatgaactttttttttttttgagatggagttttgctctgttccccaggctggagtgcaggctggaggttggctcactgcaacctccgcctcccagattcaagtgattctcctgcctcagcttcctgagtagctgggattacaggcttgtgccaccacagccggctaatttttgtatttttagtagagacgaggtttcaccatgttggtccggcatgtctcgaactcctgacctcatgatccgcctgcctcggcctcccagagtgctgggattacaggcatgagccactgcgcctggccaagaatgaactttcttaatgtaatgaaacatatctaacaaaaatgaatgaatgaatgaatgttacaaggaaaaaagaaaaagactcataattaatggcaaaactgtaaaaatattctctttaagttagaaacaaatccataatggtcagtacaggtgtttctgttcagcattccagaagaggtcctaacaagcatatcagataaaaattagcaataatgaaagacttgtaggattaaaagaaaagaaacctagttgtcattttgccagcgacaggattaactacatagaaaatccaacactatctattaacagatactagaactaataaaagtaagcaagtttcatggatataagcttaatatttttaaatgatttctatatattatcaagggacaactcaaaaatatgttaagaagaatcccattcattacagcaacaaatcaatgtatctaagataaatgtaacaaaaaatgtgaaagacctttttagcaaaaattgcaaagctttattgaaaaacaaacataattcggccgagtgcggtggctcacgcctgtaatcccagcactttgggaggctgaggcagacagatcacgaggtcaggagttcaagaccagcctgtccaacatggtgaaaccccatctctactaaaaatacaaaaattagctgggggtggtggcaggcgcctgtaatcccagctactcaggaggctgaggcaggagaattgcttgaacctaggaggcagatgtttcagtgagctgagatcgcaccactgcactccagcctgggccacagagcaagattccatctcaaaaaaaaaaaaggaagaaagaaagcaaaaaggaaatataattcataagtaagtgagaatgaatcatgttcatggatggaaagtctcaagagccctaaatgtcaaatcctctttaaattaatatttaaaggaaatggaatttcatcaacatcctaaaataaatttttacagaacttggggaactgatcataaaattgttttgagagtcaaagtctaaaaagagcaaaaatactactttaaaaaaaaagattgagcaatggggaactttgaggtttttgagtatctggtatacagaaaattttaataaagatgtgtcaaatgaaaaaaacaaaattgaagcactctgtttatcagaagatttcataataaaagttaaaaagcaaactaagtaaacctacaagaaaaaaatttaacaagcacaaacaatagataagtgattaaaggaggaagaatagatgatttacagaagataaatggcaaataaacacaagaaaatacagtcaatctcacaacaaataaataaaatgcaaattaaaacagccattaggttggcaacatggaaaaagtcataaaattatttgtaagggaggatatgggaaatagagagatttaatatgctaggggcattaatagaaattgatattagtactttgtagagcaacttggcaatagctaataaaattgaagttgttcatgtatggcacagtaatttccgctttaggcacagctgttcatatagtgtcatttgtaatagaagaaatgaaaagcaatctaaataaccatcaataggagaatgactaaaaataaactgtggtacatttatggaaaaatctcaaacatactgttggatgaaaaaagcaaactgcaaaaggatgcatataaacagatactacccaaaaccagcttatattttatgggcacaagcatatactatataatgaaagtataaaatcctactgaggaagtataaattctaacttctgaaaactctattccctggagaagagttggaaatataatagagcataagactttagctacgtgtgtaaattttaattaaaaaatagaacaaaaattgcaaaatgttcattttttttaaagatctagatgggcactgagcatttatgatttaattgatttaaatatttcacagttaactgagatattttgaaaagagatgtgagtaaatatatattgggcatagcttttttttggggattcaaaaataacaactacagagttatgatatatttcaaccaatgggtggtttgttgaaggaaaccatttttcatcccaaggtgacaactatatacttaaggaaaatattaaattaagcatatgtatgatatgttttttttaaagggcaaatgacttattacttcattgtcccagtttgcaatctggttattattttctgaaaatgatttcttggcttattatatctaaattaaacagcattgttacatgttggccctatttgtccatatttttgtgatatttttgtttattctgactaatttaagtgagggtaaggtggatctttgagaagtacgataattttagatcacatattagaataattgtgataatgtatatatttgtatatacatatatttacagttatgttaccgtgagttaaagtattttaattttgtgcagaaatctgtttcatatttgattatatcagaaataaaatacttctttgtggttattatgccactttattgtgctgaaattacttctgtgaatttataaatttgacaaggcctttcactgccaatttctagaagtgattgtggaaagtcatttttttgatcaatgacagtgtccttttttgttttaaactgcattattgagatataatttacattccataaaattcacctttgttaagtgcacaattcagtgaattgtagtaaatttgaagaatgtgcaataatctaattttagaagtttttcatcaccttaaaaataagcctcatacccatttacaaccacttcccatggaaatttactttgttcctgtatatttacctattgtggacattttatgtaaacgaaatcgtacagtatgtgttgttttgtatctagtttctttcaccgagtatgttttataggtttatccttgttgtagcatgcatagaacttaataaagtactttttagagctgaataacatttcgttgtatggattgttttcactttttgcctattgtgaataatggtatgtactgtgaatattcatgacaagtttttgtgtggacttaggtttttatgtcttttaggaagagtggacttgctggatcatataggtttacgtttaactttttgagaaactgcaaaactgttttccaaagtatctgcaccactttacatttcctccagcaaagtgtaggggtttcagtttctcgacatcctcaccaatacttgttattttctgtcttatttattttagttatcctagcaaataggtattgcattgtggtttagattaccatttccctaaaacctaatgatgttgggcatcttttcatctactttttggccattttaatatctttttttgggataatacctattctgatcctctgcccgtttttctgtgttatttatctttttattattgagttgcaggaattctttaaatattttcgatacaagtcctttattcgtttgaattttcttcaggccgggcgcggtggctcacgcctgtaatcccagcactttgggaggccgaggcgggcggatcacgaggtcaggagatcgagacaatcctggcgaacacggtgaaacctcgtctccactacaaaatacaaaaaaattagccgatcgtggtagcgggcacctgtagtcccagctactccggaggctgaggcaggagaatggcgtgaacctgggaggcggagcttgcagggagcctagatcgtgccactgcactccagactgggcgacagagcgagactctgtctcaaaacaaaacaaaacaaaactattctatgagttgttgtatttttcacttttgtaaagaaagtggcatttttgtggagagcagaagtttttactttgaataagcattatttaagaacttttctttatcactgtatttttggtgttgtacataataaatcatttcctaacccaacatcataaagatttgctctcaagtttacctctaaataatttatttcttacatttatgtctgtggttcattttgagttaatttttgtgtatggtttgaggtaggcgttcaaattcacttttttttcaggaagatatcaaattatcccaacaccatttgttgaaaagactatttatttctcttgaaatgtctggaagctaatcataaatgtaaggccttatttctgggatttaagttctactccattcatctatatatttattctattgccagcaccactctgttttgattattgtagctttgtagtaagttttgaaattggtaaataggtctttcagttttttttcattttcaattttatttgggtaacttgtatttctagaaagattaattttcaatttcttcaaaaaaagttatctgggatttttatacagattgtattgaatctgtaaattaatttggggaatagccatgaagatgggctatctctctatttatctaggtctttaaaaatttccttcagcaatgttttatggttttcagtgtataatattatacttatttgattacatttattcctaagtattttattcttctttatatgctacaaatcaatttttttgcttagttttcaaatttttcaatgctagtgtacagaaatgcagtcacatgttcatcttgtatcctgtagccttactgaactcatttatttagacagttttttagtggattcctaggattttctgtctacaaatttatgtcatctgtgtatagaaacaattttaccttttcctttccaatttggatgcctttgattttattttcttgtgtaattttcctggctagaagctccagtataatgttaaatagaagcatggtgaaaccccatccctactaaaaatataaaaattagctgatcatggtggcgggcgcctgtaatcccagctacttgggaggctgaggcaggagaattgcttgaagctgggaggtggagggtgcagtgagccaagatcacgccattgcactccagcctgggccatagagtgagactcagtcacacacgcacacgcacacgcacaccacacacacacacacacacacacacacacacatacacacagaagcagttagagcagagcagacatcattgtcttgttcctgatgttagaagaaatgattctgtttttctcctttaaatatgaagttagttgttgtttttcataaatgaactttaccatattgagcaaattcctttctattcctagtttgctggggtttattgtaaatgggtgttggactttgtcagttgcttgttttacatctattgatatgattatgttttttttaatctttattttctactgtattaatgtgaccttttaaattctagatcttcagtcgtgctggtgaagcctgcaaaaaggtgatacttaatgtaccttctaaactagaggcagacaaaataattggcagaggtgagaaattttaaaagtctttttaaagcagaaatttagtttacataggctggaaagagcatgatataatacctttgccttttggagttagcctgaatctactaaaaagggatgttcctccagggagtaaaccagaagttatcattctgttaaaaatgtgaagagagaaatatgtcatcagccctgaagatgtttatttatttatttatttttgctaaatatttccacctgggacagatttgaattaaagtgaaaacacgactcatggacagcaaatgaaccctttgagaggtcttttcttaactgagtagtaatttatccatttgccttatgttaagacaaatagttgaagaatggcatggatgacaggtacattttgatatttatatgcattttattacctgttactagaggccagaaatcccagggaagaaagactccatgtagagtttcagtgtgcggccttggaaagcttggaacacacagagtattttgggcctccagggaaaattgtgtacagaaaagtgccagtgggaagaaaatttcggagattggatttttctaacatgactctttaccaaactcatacactccattgctctttggctcatggcttctcactgaatataggtgtatcttaaacactcagattgtattgttagggaaactcttctatatgtttattcaggtgtgttgggggcatgttgctcagttttgtcatgattataacatgcccacatctttaattggaaggtcattttcataagtctattagaagcatataaaggtttaaaacaccttatttaatagaaatatacactcaataattatttgttaactgaaagaaaatgatcattttttaagtaatgtaaaaaacaggttaagatatctggtaaatgcaaagtgattggcttatttcatcccacttcatggtttttaagaatattatataaattattttaacacgtttttttttctcatgtgtttttaccttacaacttggaaatttttacttgcagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatttaaagtacattaaatattttcagtcatttttttcattaaaatactctcattaaaaattgcaaagagaaacaaggataaatagggtattttccccttttgttttcattttgtttcctttcctttcacttcgtttccattttcttacccttttccttcccctccattttcttaccctgtccttttcattccttcccttttccttctcctttccttccccttccttttccccttccttttcttccctccctgtcaccttccctctctccctttttctatccttctctctacctctcactctatttttgtctctccctctctctctttcttaacacttgttgaactctggttttggttttactttattaaatctgaattatttctcctctgtgagggcttcttccacctctacattctaactattgtcttttgtgcactggtgtcagtttggttatccctctattatagaactcagaatttttttactgcaaaacctttacagtgaggaatgccattatgaaagtagtcacaaaatgatgaaaggtttagactggattacatctaatctgtgttaactgtatcaataataaagctaatttaagttacagcttagcactttgctaaatgtttaatgcaattattaattaattcttatgaaataaaatgtctcccttgctgcatcatgaaatgagatggacatcactaaaaagtctaatagaactttttcccatgatagagatggcactatctgcactgtttgatatgacagctcaatattaatggctactctgcacttggcatgtggctagtgcaaccaaaggatagagcttcttatgttatttagtgtcagttaatttaaatttaaataatcacatgacttatggtggccaagggctaccatatcagactgtgtaaatagagcactatggcagtgaaggacatacattttctttctctgacctaagggcatgagcttttaactaaaagaacaagtaagtgctatctggagattgttgtagacagaatatgttctatgtctccatttgggacaaagcaagaagaactaagaatatagtggtgattttcctaacatgaaagtatagtcagtgttagaatggtatacaaaaagaaattctctgtttcttgaaacctttaaaatctggatatgttctttcttacccttctaatgcagaaagactttattaactggtttagctccagcatggaaatgcctgacactgaaactccaaagaaggattaggtttatgagctgtccactattttacacaaagtagactgtgatgcttttgtttattcatgtatttgtttttctctaaattcaggtatcgaagacaagacacactagagaaactgttctcaggcgtgccaagaggagatgggcacctattccttgctctatgcaagagaattccttgggccctttcccattgtttcttcaacaagtaggtttacaccttttctggtcagggttgctttaattctaagagtctgtttcattgagatttaatacctctttaaacatataaaaataaacagatctgattaaagatgttcatgaggtgtaacaaaagtaaaatgagaaagaaaattactaaaaacctaataatatgagaaaggccctaaagccattgaatgatctttatttgtttattcatttatttagcagggagttactgagcacttaactatatcctgcaggaggtactgctctaggtactaaagatataagtaaatttagtcatggcccttgctctcatgtgggttattggcctcgtgaaggagacagaagtaggataataattacaattttcagtgatgagtgctatgattctagtatagagatgttgggtgatttggtaacaaatgagatgaacattaaaccctgaggtaaggtggtaaaaagcaagagaaggcttagagaaggagacatctgagtagagtcctgaagaatggaaaatttttctgcaggtaaataattgcagaagaagaggaaagtacagaagtgagagctccttagaggagctctgggtggcttagtcttccaaggtttgatggaatggagcagggagatgaggctgaagagggaggtaggggtcaaaccactatggactatgtgcattctgctagtaagtttaactttatcttaataataaggagaaattcttaagcagattactgacatgatcaggtttagttttctcattaaggtaatagaacatgcacaattgaaaccattactgaagtagggctatggccttttgcttgcctttttccccttaaatttctaatagtgtgcttgatatttaatactaatggtgtaacctgtgtactaattgtttcagtttttaactatccttccacagtcattcacatttattttttattctaccctagtgctagacatttgtttattctccatgaatattataactttatttgtttattctccatgaatattataacttgaacactgatgaagcatattaagaaatgatttctaattgccaaagctgtaccaatcatagctagttttagcctttgctttgcaaaaccagtcaccatcttagtcctcatttccttgacatatttacatttgacatagctcacctttccctcctttttgaagtatttgttcatttggctcctaggacaccattcgtctagttttccacttacttcattgatcactccttcgtatgtttggctggatcttcctcatccatccccctagcctcctgtcccagtctctaaacttcggagagctccagggctcagtcaatgaatcttacctcttgtttcttgatatttactctctcagtgatctcatcagatctcataactctaaatactatttttttcatgaatacttaaaactttgtatttccagcccaaactatctaattgatattaacacttggaagtttaatagggtttcaaactaaacttatggaaataaaatgcttgttatttctcttaaaaacagcctcccatctcaattagcagggattagagttcaatcattctgactctctgggcattggagtgtgtttcataaggtttaagctgcagaaaacatagttctctctaagttcttaacagataaggatttattaccatttattaaagagttttcagaattgtccgtagggctgaagaaacaaattttaggttgaactttcagaaacaaatcctcaagctagctataccacagtatctacaaccaagggacatattgctttctccataatagagaagacattattctgagaaccaaagtgccactggcacagtcaggaaaacaccatagccatgttcctcctcatgaaacttcagaacagtctctgaactgcaccaaccagcatcagagaaaagattgatctgtatcttattttgtaacacaaagttggcgaatatctagtagtacatatgctattgcagaaaaggaaggaaagaaggaaggaaggaaggaaggaaggaaggaaggaaaccaatgcatctgaactgagctgtcagaaaaaatagcagaagtagcaaaaatgagacacctgcctacctcaaagaaagaaagaaacataaactgtgatgccagcaaaaataacagaagcagcaaaaatgagacacctgcctacctcacttttggcattccaatcttgttcaagcacgtctgaccgtccatgtttaaatccagaactctggtttcaagagattctgcaaaatttggaggttttggtttattttcgtttgaatatttctatcatctacattatgagaggacactgtagaaggaaaatgaaacagatattgagcttcaatttagcctatatgtctattcttctcatagttaaacttttgatttctgtattattatacattattggaataggtgcattttattgagatcccaattactagtggcttaaacaagacagaggtttattcctttcttgtaaaagtgtgatctggtaaaaaggttctaatctgaaaaaacaccaaggacccaggtttctttattttttagcatggctgtctctgcaggttccagatggctcacctctgtgtccaacagggagaagacactctctcaccttctagagcacaactggattttgcacatatcatttttgttcacattcccttgtcctgaccttagcatgtggctctaactaattgcaagggtgactgagaaatcctttcttctggacaaccttgtgatcactacaaattctaatactaaggaagatgggcagaatagatattaagagatactagcaccctctgacatagtgtccttgacttccatctttataccacacatccaactcatcagcaaattctgatggctgtacctttaaattatatccagaatctaaccacttctcaccacccctatggctatcatgttagcctaactaactacagtctcttctctgggtttttgcagtgacttcctcagtggtctacctgcttttttccttacccatccaaccacctctagtcatgcttgacaaaacagcaagtattacctttaaggatataaatcagatgatgttacccttgtctaaattctccagtggttttccattagactccaaggaaaagccagcatcctcgaattctccaatgtggcccctattacctcattacctcttcatctcctacttcttttttccatgctttttctactccaatcacagtggctttcttgctactccttgaacatgctaggtaaaacaccagcctgttcccttgcacttcctattttctctgccagaaagatccttccctgtttatcctcatagcttattcatttaatttttgtcagttttcttcctagggtacattccaattgggattcccttcttcctgtgagaatccctgtttgccttactcttgccaacaatggttattattgttcttttctaccttttcttttgaaattatctctttaaaataaaaagatacatcagctgcatttaaaaaatattgtaactgaatttagttttaatttttttgcatattttttttctacttttaggttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatgtaggacttttattgatatgcctgactttaaattattaaactatgtttcttctgatgcttactccagctactctttcctctctccttgcattctcttcttagagggtatcttagagtcaatgggaaatagaatgtgcaacattttggaatacttggtcagctctttgtctcaactgctgttaggtaagcctgaaatgaagcaaagaggttcaatatttgaacataaatttcaaagtatttcgatgtaaatgtcagtaaatttccaaaaagttggttttgcttatgagataatctctctctctttcttactggttgctggcaccttttcctcatttcaagacatgtctacagttgattggaagaatcctgtatctatactgttcttacttccatttttgtcttccttccacacagatgattatttgatcacatctgagaactacataagaaagtgaaagtgggagaccaaactcaaataagggctaataagccagtattctgatatagatgagcttatagtcaatagcaaataactcagataattttcagtgtaatatggtaaatgctgtgaggtcatgtgtcattcccatgattctgatggaatgattttcggaaagagagattctgttcctacaaaaaagaaggaagagatgctgtgtaaacaaacataactgatgtaccccatgtgacatgctttgcatttgcttagaaaattttcagttcagtgttgtaatcacatgttcagtaaaatatattctatttgacattacattgcctttactcagcaatggggaaactagtacatgtattttgtcagaaaaattcttacaaatatgtggtctattaggtaaaataataacagggtttgatagtgacaaattgggaattgctgctttatttagataatgtagtaggaatttttcctattgcagtgagtttaattgttctctccagcataattttctgattatagagagaatttatattcacatttaattcctcagtctagtggacagagtcagccccgacttcactgtactctgacctaggttttatttgcgatagccatttccatcacatactggatgctctttgcagtaaagtgtttctccatttggtgctttgataattaaaaacacagtggataaaaaaacttcaaagtagtttattattgaaaagatttgcaaggcaggtagtagataaagcatcttattctgtcttgccgggatctgatattaatggaactttctttttgctattttgcagttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtaagtctgcttttaagaataaaaagaatcattttaaatatgtctgtgtacattttaaaagacatagagctttttatactcaaggccagatcagcctgagataacgctgaactagaatctacttaccagaaaacacttaatcccatcactttcaatcaacatgtgccttgcccagatagtacagaagtttctgtcattgtcaatatgatactaattaactgtaaagggagctaacagttattcaagctttgtgtaatattcagtttatatattttatttcatttcctcgtgggtttttcattattctcaactccaagagaggacatgcagggtggaatgaacaataaaactaaaatcggtatagtttttttctttgagcttttatttaggaaggtgttaaatgacatccactaagggtacagttttttttatgctcctatttatattatcttcttttaaaactactacctcactacttccaatttagaatgaataccggaataacttcagagaaacttacatcaaatgttctctattctaaacacttgctcttacatgtggaaaactgaagtattttagtttacctggcccttaaaatgtggcacttacgatggcttctgagacttgtaatatggagaataacccctcacaataaagttaaaagaaggaggattcagtcataaaggatgactttcctaatttgctttttaaagtttccagtagttgcttagatcttcactgcaatattatatctgctttttccctttatgttttcctttgttaatctgatgtcatagatgttaacctctttattactcacgtggtacaattttaaaaatttaaaaaaattattggtttggagtttaggaaacctagttttgtttctttttaaataaattttattgtgtgtagtgaaggtttacaacatgatgttatggaatacacacagataataaaatggccactaaagcatagaaaacatcgtttttgatgtagggtgtgttactaactcactgtggaaactcatggaagtccctctgagttttcttacttgtaaaaggagttcattacattacatgacctacaatgtttttagcctcacaattctatgacattacattgacattatattgcctttaattaattagcaatggggtatgctttccctttttcaaaaaggggtaattagtttcaggctttcttgaggagtctgttctcttttacagtaacagagaaaaaaaaaggacaaacacttcgatgcccagcttaacccaaggtactttaagcacattttatcagtaggttcagaccagttaaggctgtgatactaaaccggtttattaaaacaaatcaaatcaggaagtagcaaaaagattatagaaaggagaggctggactactaaaggtcaacttgatcatctatattattactgcatacccctaatcagtcttgatttagctattaatcaaaagtccaatttttaaaaaatctgattattaaggagacatggtttattcctccatctaggtttgttattgaaatatgtgcacatatgtattccaattaattttgattgccatttaactaatttatttagtgatttatgatcaaatgtgttaaactgtgagcaaaagtataccttaattttcagcatcaaagtgttatgtgtgataaatttgaagttatcctcttcagtcctatctaaagatgaaataatactctggtaataaatacattttagattaggtttctatcatcactgttaacattttaagattgtagatacttttgaaagtatatttaacaattctgtaaattaaaggctgttttattttttaatgtgtaggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggtagctcacacactccatagaatttcatttcgctgaggattaagcttccctcccccatttattataacttgctatcctgtggattaatagtttaattttattttaggcataagacaataagaattcctaacaattttttctgttttttatattatttctatttccttatgttagagtagccataaggactagaaacgcagatcaattggcatttagaagggatgagaaaagaaaaaatttcattataaatttttttttcttatgtgtggctagttggttccagttcagcaaaggtttcaattttcatgtaggacaattaattttgcttgttctatgagtgtggatcatgccctgatttctactttaattattatagatatatatacttttagtgaggaaaggattagttgaaataaaattgatggattattaaaaatatgaaacacttttttggatgatagtaatagcatattgtcatgtatctagtgctttatattgaacttcttaatgcataattttatttgccctttagaatatttttgtttgactagacacgtgttatatcctatctataaatgagaaatgtgacagaaacattgattgacttgctcaggtcaaattactgcactgaatcttatctttagtttttattgttctattttgtcagcaatcatgcattattgactaaggcagatgaatcaattttatatggacaaaatagctttattggaatagttcaatgtttcccactacaactagaataccttatatagaagagtcaatatgactagaaaatatattataaggaagaaatcaatgggatttgatgccaaagaaacagggagagatggtgggaatctataaaaagtactgagaagtagtacaaacgttttaattgtcgttatttttattttttatggggccggagcattttatgttatagataaaatacataaggataatagtaagtgggaaagttttaaggggaaagtctgaatgtgcttttgtatctgtggagtttgtagggatgatgtagtaatcaagtgagtaattgaaactttgcaagttaacaggttttagtcatcaaattttttaaaatgaggtttagaaaaattaaatttaggggtccacaacttgtaagatacagttttaggatcaaacccaggtctgctactttcctgatgaagaaaaaaatctaccagattttgtgggcaacaaccatggagcgttgaggggaacaacatgagaagtaaaaatgatgggagataaaaaaaaaaaacagtgaatttagaggaagataaaaagaatatcagggattcttaaagcatacgggaagagcattttaaggtgggaatattggtttactttctctgtttgtatttttttctttttttgagagagggtctcgctctcttgcccaggctgaagtgcaatggcacagacatggtgcactgcaacctgtacctcctgggctcaaacaatcctcccacctccgcctcctgtgtagctgggattacaggacacaccaccatgcttggctgatttttttattgtttgtggagacaggattttgccatgctgcctaggctggtctcgactcctgcactcaagcaataagcctgcctcagcctcccaaagtgttggaatttacaggcatgagccatggcgcctgactagaatattgactttcagtatggaagggagatcaagtaaaataaagactgagggaagagatagagggaaacaaaaaaaatgaagaaaaataaaagaatgaaagcgtgactaacgaacagtaaaataaaagaggaaggccacaaagatgattgtaccacaaattaatgacttcaattcaccatcaccacaccatctgcaaaatttcattttttgcaaatctaacagcaaccttaagtccttgtctattgctggcacttgttaaaactctctcttcccttagacttctggtcttcctcctgcttctctgatctttcctttttagtgtcctttgtatagtcttcttattccctccatgctacaaatactgtaggtccttacatccgaggctcttctcatcctgcagcctctcctgaattgaataatctgattcctgccataatttcaaccaccatctagatactgatgatttctgggtagacatttctagtcatgatctcttctgtacatatgaggccatatatccaggtgccttttggactttactccttagatttccttcaggcacataagattcaacatatgcaaagcaaaactcagtatttctacccctttgccaacctcaatagtgtttacttcctccgagaattgttctcctgcatttcttgtattgtttgatgatgcacctgtcttcctatctctccaagtgggacacctgaaaatcattctctcttaacttgtatatagaatttactgttaagtcctactccattctaactcccaagtaaatttcctgccatcctttctctttgtcctcattgctactgcctcagatttgggacacttgccctatttatttatttgtttgttgtttagagaagagatctagctctgtcgctcaggctgcatgctgtggcatgatcataactcactgttacctcaaactcccactcaagggtccatccgcctcagcacctcaagtagcttgggagtacggacacataccaccatgcccagctaaatttttatttttttgtagagatgaggtcttgctatattgcccatgtctgtctcaaactcctggccttgagcgatccttctatgttggcctcccaaagtgctgggattacaggcgtgagccactgcgctggcctaagccacctgttttagatgattgctgcaggggagtttcaactaactgctttgattttttggctttctccaaattatgccaaaacttccttaaggatatatttttttaaaactcaaatgttctggctgggtgtgctgccttatgcctgtaatcctagcactttgggagcccgaggcgggtgaatcacgagatcgggagtttgagaccagcctggccaacatggtgaaaccccgtctctacaaaaatacaaaaaattagctgggcatgggcacctgtaatcccagctactagggaggctgaggcaagagaatcatttgaactcaggaggcggaggttgcagtgagccaagatcgtgccactgcacaccagcctgggtgacggtatgagactccgtctcaagacaaaacaaaacaaaactcaaatattcttattttgtgctgcccctatgacttccaaaaaccttttcgctattacctgttacttaaagcataatttctgagtacgggtctttgtaatttaatctctgcctgcctcttcagctttatccttgtctaccaaattcctagagtctgtgcaaatatggaaatcaggtaaaagcacggaaacacacagatgtgtgtgtatgtgagtgagtgagtgtgcaattgaggtttcatttataaatctaccaaaaatttttcaagactagttaaatatttgctttgtttccaggttgtagacaagtactcattgataatgaaagtacaagacatggatggccagttttttggattgataggcacatcaacttgtatcataacagtaacagattcaaatgataatgcacccactttcagacaaaatgctgtaagtatataatatcaaaatctgcctctgtcttatctgctatcattttttatttaaactgaattaataaaattaatacttcatgaagtatcatactttgacgtatacgtattttatgaataaaattaaagtttaaacaagtgatatgtaaatttattttatttattcatattagtgtttctattatctcccttctgtcaaaggccagtaccatgagtcttcatttgtaatgaaacttttcttttatttaaaagataacccttaatgaaacaatagtgtttacgattcatagttttaaaataatctatataaaattataatggtaagtatttttggaatggaagaaacttttttttaaagttgtctataaaataaaatttcaattttcaatgacttctttctgtttcagtatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaaggtacagtaatgtataattgacaacttagcaaattaacaggttttagttacctaataatttaatcaactaaatagtttcagaccatagactctacaagttggaagaaaatttaaaatctatttaaaccactattccaatctcatgcctgtgtgtcttctgtaattttattgctgattgctagtcacctagcttctgcttgaacattctcatttataaggatctccatagctccattggccacttatcccacatttgaaatgctttggttctcagaagttcttacttctactgtgtccaggttattttttctataactcatatgtttggttctgattcttcctctaatgctattcagaacagctataattcttttgaaaaggctgctatgttcatttgagacttactttctgtaagataaatattctcaatttcttaattcttacatgatgtgacatacaaacccatattcttctcattttctctataatatatgcctggttgtatctgatccttttaaaggtgatattcacaatgaaatttagtattatctcaaacagcaatgaatgaacttattttttgttcagtatgttgtatatttggtggtgctggtacattctaggatccaggttatgagggtaggaagggatctgtttgaaaaggatcattggttttatacttctagcccagaacaaaacaaaaattaatattgtcctgtggacaagaatagaggtcattcattgagtgaaagaggcttatctgccaaaaacagtaaagtggcatctttggtacacaaacacctctatttgcaattatttcctctgtaaaaatttccaaggctcctatactaagacttggcaagttctgtccagatgtgaagagtcaaatatagactcttgacatcaagcctccctattttatttttctataatatgatctgctcaaattgaatactaaaaccaagtacttaaaaaaacccattatgctttatagttgagagtaataggaaaggaaataagaaaataccactgactgcttttgttttttattagtccaaatcaatctagtctttatttggactctccagaaagtagaatgcaagacaaagacctgaacatgggaatgtatttaggaagtgggtcccaggaagccaatgttaaaatgggaaaataagatagggaaggaggaaaagccaatctagtctgcattattgagctagtcatctttggtgttcatccatacaagaaaccatgtagaacttgcctcataattatcccctcaaaaatggatacttggggtatttacccctcacatcccttctcagtacccaggccccactggttgaaggtttcacccagggatccttaaattcaccacacttctggattgggctgtgcctgctgtctgctgagggagccctctggttttagagggaaccctgaatctgaagagccaaatctttgagtcttgagatgtgaatctacagcacacatgggaactggctgaggggctgtggtgtataattgttctgaaaagggctaccgtatatctcatacagtttccaaggctgaacacttaggtagtacaggcatatgtttcgaattgatgtgattgcaacagatgttctgttaaatgttctcctggacacccttctcccctcttcctcctgatgcaggcaaatcccaaaattggggctcagcccagagggttcctggcttcacctggaaaagaattcaagagcaagacagtagagtaaagtgaaagcaaagcaagcttattagagcaacagacaaaggaaaatggtggcttcacagacagagcagggctgctcactaggcagagtagcaattgtggattgctggctagctgtatttataactactccttaattatatgctaaataaggggtgggttattcatgcattttctggaaaactggcaggagttcctggaactgagggtttctccccttttagatcatatcaggtaacttctgggcattaccgtggcatttgtaaaccatcatggcgctggtgggaatgtcttttagcatgctaatgcattataattagcatataatgagcattgaggtcaactagaggtctctgtcctcatcttcttggtttaactgattgtggctggtttcttgactgcatactgtttcgatgagattctgttttaatcagcagggtcatgactgatgctcagaaaacaagtcctgctgatctcctacctcacccccaccaagccttggtttctcctgcaaatgagtcaaaggaatagtttaagatttgggaagggcagacaatataactacagtagcttctgtcagagacccaagctcagaccttttggtgtgctgtctatctgctccttggtcagaaggcagcttctccagtctctctcaaggccgttattcaagatccatgtggagaaactctatcattattgttattatttaatatcagaggttttgtcttgcttagaggatataaaatttaaataccactaggaattacatttctatttgtaagtttttttgaccaatacaaaatgatctctagcaaactttttctaaagaatatactctaatttttaaaaaggcctaatcaatgagtatatgtactcaatgttcttttgtatgtttttttgtccaaggagttctgaccatagaggtattaagaaaaacatttccaaaggtgattggaagttataacctatatcatagaatatttctcattccatgtgactgacatgcatttgtttcatttctgagtagcactccaggattctccagaatgggcagcagttagataataatactttactgctttgtttttggttcagattaacttaatttcacatctggagtgtatcaaaaatttccccaatacatttatatacatttatttccattattttaaaacataagatagttacccttatatttgatattacatcctagtttctacatgaaggaaatacttttaatatttttagaattttaaaagtagctaccatgaatcaagttccttttatgtcacagaaaatgctaggcactttacataagttgtacatagttttcatatcccctatatgacaaggtgttattatccctattttacattgatttttttaaaaaggcaaaccccaaaaacacaacaaccacctaaggctgatgaaggtaaataacttcctcaaagtcaagcatatattagcgatccaccccggaacacaaacctggtctattttgttcccaaattaattatctttccattactgcatgccatacctcattaagcccacaaggcagtttgtattcaatatgtcacagaatatattacatctgcagccccttgtcatgaaatctaattatattctcaaattcatacttcatgttaaacacaaattaacaataatggctaacatttattatttactaaatgccagacactttgccaagtgcttaacctatagtatctcatttaattgttttaaatgtcaatagattctttattacatttatttattaataaggccagtaattttcaaattttcagtaagcagtccattagttcaaagttcaaaagaaacaaaaattcaaagttcaaaagaaacaaaaaacatggtgtaaaacgtctcacttttacttggtctgtcagccactcagctctgcttggaagaattaatacatgccacctgtttcctgtgtattattcaaaaggtattttatatatacacaaacatgtttaagtaatcttatcatgtttcttttttaaaaacaaatacattttacttcaattaacatatctcttgagttcattatatatacattggaaatatttcatggtatggtatggacataccatatttttttaaccagttccatatctatggaagtttagaccacacctatggatattctgtattccttattctgtgcttttcttcattcaacaacttttccctgaagtcattacatattagtatgtaaacagttttgccattttttacagctatctattttagacattacagtaaaatatccatcatatgaatgtaaattattatttaactagttcattataaatggaaatttaggccatatcaatggaaattctaatttttttattatttcaaaatatactacaatgaatatactacaatgtaaatgtaggataaatttctagaaatggaattgcttagtcaaggacatggctatttttttctgtggttgctttattgcctgattgtcctccagaaaggttgtgcatgttgacatgctcatcagaaatgtacacacatgcctgttgtaaaataattgccaactatattatcaagttttgatatttatcggttgaatagcaaaaaaatggtgtttcagtgtagctgagcattccttttatatgaagacgccattgaatatattttatatcttcaagctcactagtcctgtcttttagccagctttctatgttttgctcttcttatctattaactatttatttataagagttttacggaaggaaatatttttgcaaatatttttaccaatttttattgttttataagtttgcttgtgttggtttttgacctccaggatttgttttgttggcagggcttgcttggtcacaatttatcagaggcttctgtggttgtgagatttgtgtcattatcatggtattgacattatgaaagcattttatctgaaattcttctacattattattgtttaattatctatctatccagttaaatttttgatctgtatgaaatttatcctagaacaattgtgatatgaatcaaattttagtttttgtatctgttcaatacaattcatgttttgacatattttctttgtcataaaataagatacatgtatatttgagtttgttattgacattctcttttgtaccgttaatttattgtttattaattagcatctatatgctgctgtattattgctagctatttaagaatatcaaatgtataatatgcattttagtatttgcagtgttccatgccactcttacctagtgatcttcctttgtggatttttttcttatgaatatcttccttgtttgttcttccatgtgaactttcaaatcagctcctaagtttaaaaatatctcttttgatgtttttacaattatattaatttcatagaaagagtaggagagaattagcatttttctcctaagtcatagccaagattgtaatttcatttttttcagctgttttgtctaatttctgtctaggatttacatccatatccacaaaaaggatttaccatagtttttccttttctataattgctattaagtttttactatcaattttatgcttgcttcataaaactaatttatttccttctttttttccatctctgaaacagtgtcccacaaaacttcccaaaaaacattgaattaaaagatttatttatctttccaaaacaagcccatgtggttgttattctaattcttctcatttccagatgagtagactgaatcaaagagaaataacatgctgcagtccatacagctaggataggtgatttgtaccccacagtcaggtgttgaatgtccagactatctaggagagataactctgttcatacagccaagatacaaacccagatctctctggtggggagctcttattcataatccctgagctgttctccttctggcttggtatccttgcttctcttatgtcgcctcttttccatacttgagttacttagcttgataaagccattacttcatttgcacaagaggatcttctcttcttgcaaccttaattcatttctacttttgggagtttactttttaaattatatttttcttctgacattactagctcctttgctaatcgtacctcctcttttcctttgagtcattcatagtctgctaacattttgattaataaaatttgcttttgccatgttgtgttatccttttcatattttatccaaacccttagaaaagctgaattattatcacagggctcctttgatagccatgctagtctttgaaagtatcttattcttttccttgggaaagagttgtgattgtgtggttaaatcatgtctttaagtactttttttttttttttttttggagatggagtacttttaagtactttttttttttttttcttttttttggaatttgctgtcgcaattctcctgcctcagcctcccaagcagctgggactacaggcgcatgcctccatgcccggctaattttttgtattttagtagagatggggtttcaccgtgttgcccaggctggtctcgaactcctgagctcaggcaatccgcccgccttggcctcccaaagtgctaggattacagacgtgagccaccgtgcctggcatctttaagtactttttaatctcagtgagtcatcttttatttgaaaatcaaacactgtataatcatggtgttcaaaatccatgtttctgtcatgtaggctatgtacctaatgatgactaaccttttgagtactgattaaagaatgacatcactatgttgttaactctaaaggaatcctcctcttccaatgccctggttcttccttgctagtcagaattatatccagggaaagagtgcatgttattcattcctttatacctcaaagagttaagtaatcagtaggccaaaccaagaattgctctggtatacttttagctgaataaagcttgcaaacattgtcttactagttagcgtctccttttattgcaatatattggctgttaacaaaaacatacagcatttattcccttcattcgcctctgtgacagcttgagagattactcagaatttagtgtaaagccttattttatgctgtagtgttaaatgtcattcttacaacaatttcacagaagagaagagttaaagagactaaataactttcccaatgccacacagctaggatgtagtgtagacagaatttgaacctagctctttgactctaactatacgctgtcaagcactatgttaaattgttttccacagctgtgtgatcttggaaagttggcctctgtgttatctgtaaaatgggaacaatacttctttctgcctccctaatagctcttcaaatataatattgaacgtaacagcacttggtaaactgtgggatattattattttattttaaaaagttatgctatgtccttgagactagtgttataatgttccaaaatagataacttttctgtaaccacaaagcatgagtgatacaggcttttgctgtgttctgggtaaactcattccacctcagtggcttctgtccattggagcagcagcagtgacgcatatgggcttgagtgaggatagtattattcttggtccttctcaacatggagagtcctcagctccatttccacaactatacattttctagggagttgttaacatctcagtgcagatgtgggatatttttaagcactttttttaagtggcgaaacaaaaacgtaccctgaggtggaagagaatttacaggctttcctattaattaatgagattaactaatcccattaatctttaggatttcatctcaccagatttttaattttggagagttttaagctactaaaacaatatccatcttaagcctcgaaaaatgggacaaagaaactccaaggcttcagcgagtgtttctggattgaatagttgcacctcctccagtgcagcagctgttctctaaatttccatccatttctcattgccagcagttgctcttactctctgtgtgatcacaccagcacatgaaatgtgtgaaacagtattcatcagcatcaaacgaacagatattaatatttttttccttgactctccagtttgtgggatatacatacaaaataaaaaaaggttttacatatgttttgtagattctaagattcagaaactttcttgactttttagtggactcgtgatactaatgtcttactctgttaatacctaggtgtggagaaagatttaaaataattttattcaccagttttgattttgttcaatgtttagccagtgattgttttgataagcagaaagagaaattgaagaaaaagtgcttcaactttatagtacagtgtaacataatgttttatgggttttacttgatttgttatctaaaactgaattttagtcaaagattgatttggaaattttttagagatcagtgagccaattaagcagcacacgatagcagagggattatagcgtaggctaaggaaatggactcaggtcagactacctggcttcaaattcaagctcaaatgattatcttttggtcttaaaaaaaaatcagtttatctccttttcccgttttctgctctgtaaaatgaggatgaggtcaataatacttacttcataatgtcatgaggatttagtgagtttattttcactgttagagtagtgccttagattcaatgataattaaaatcaatcacatagtatttcccttactcctctgtgtatccactgtgaatgtttcattggataaattatagacaatgccaaagtataattctcaagttttcaaaaatgtaattttcataaaaacaggtagtgggcatggatggataaaggttttaactcattcatgaaggaaccagcaaaaagacaagttgattcctaagaagaaatgagactctggatggattttgataaaagaaaagcagcaattagatggctcagttagatgccttagagggcaattaaaacacacatttggggccgggcatggtggttcacgcctgtaatcccagcatttagggatgccaagggaggtggatcacctgagttcaggagttcgagaccagcctaagatggcagaaccccatctttactaaagaaaaaaatacaaaaattagctgattatggtggcacgtgcctgtagtcccagctacatgggaggctgaggcaggagaatcgcttgaaccaaagaggcagaggttgcagtaagccaagattgcgccactgctctccagcctgggtgacagaatgaggcaagactctgtctcaaaaataaaataaaagaaaataaaatactggagatatcttttctatgagacagaaaatgaaatcattgcaccttttggttttgtgaaagtcaacatcaaactttacaagagttataaaatgcctgggccatagtcagtagtaactgataagccaaataaaggcaacttcccatactcagatgaccgttagcccagcctgttagacagtgctccaagcaggaccataagaatactgtcatctgtttgcattactttttgaatcagagtaattttccttagtaagagtgaaatatgaaaatatttccggaatttcgtttgtccaactctatgaaactacctgcagaagttgttggaccattcttggtagaggcttagcacgggatccactctctgtttagcaagggataaaagtcagtattaacaacatgtgaacatagaatttatgcagcactggtcaggatgacaaatgttcacttgccatttgaaatgccagatgtattttacactgacactgatatacatggactttattttaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtaaaaataaatctataaccacatactaataatgtatttgtaatcattgagatagtaacttatttgaaaacattttctgatgctaaagactattttttttttattaacaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaaggtaaaaaaaaagttttaatctggtattctataaaggaattagagaataaaatgtaattattcttatgcagatttattttggtggtaagtgtatggaattctttgaaattactttaaagactctttctgtctctcttaattatctaacaaggtgaaactgtttggtgacaagaagccgtgttttatttatctttatatccccaatagggcaggaccttaaattcttatgtatttctatgctagaggacaaaaataaaactgaaatctaaaactagataaaatggtctcatcagactcttccacatccgtttgtgtcactttaaattgagcttttatatagttcagctgcatattaggtcaaaatgatccttttcttgaattctgttccttaaagtaacctagagtttttcaaccttgtcttcacattaaaataaaaatattaatctgtagatactttgttagactaactgaatcagaatatccggttgtggagcctaggaatcttatattttaaaaaaatcttcctagtggtttgaatatatactgggattagaaatcttatctgtaaccactttactgcttactaacatgtggcacctggaacccccaaaaatagagattgaaattcagacatttatttttatttggtagtaattctggtaaaagatttattgacagttgtatctgatattatcagtagcaatagtcatttcaaattagctgcagattctatttatctgtctatgttcttatttatttatcatttcctttaataatcagtttatttaaaaacagatcatgtatagaatataattgactttttattctttaagaaactatgaaagaattttaaaataacactaaaccttattcctgtctccttagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatggtatttaataaaaaataatgatttataaactctgaaataacagaataactggaggatagattgacttgcttacttacacaaagcatgaagtaaaactgagtctcattaatatattttagaaggataaactaaccttttacaaatattatatgggggctctgttatatataaaatgaaggaagatgtaatttttatgaaggcaacatttacatttacaacaaaggaaagctttgttaaaatgttgggcagcttatcattaagacaaactttgtgtgtgtgtgtgcatgtttttaaaaataatgccaatggctgggcatggtgactcatgcctgtaatcccagcactttgggaggcctaggtgggtggatcacttgaggtcaggagttcaagaccagcctggccaacatggtgaaaccccatctctgttaaaaatacataaattagctgggcgtggtggcaggcacctgtaatccaagctactggggaggctgaggcagcagaatcacttaaaccagtaggtggaagttgcagtgagctgagagatggtgccactgcactccagcctgggggacagagggagactccgtctcaaaataataataataataataataccagcgaggtgaggagagagcagaagatgtgtagtttaaattgtattgtaagctgactctggaagtgaggaactcaggtgtatagaccaagcactctagggtatcctggaagtgaacctggcgggatatagcaagggatatgggaaggagtattgaggggctgctgcctattgtagcagtttctgggggctgtcatgttctgtacttcatccatacttcattctgttgttactgccatgttctttcatgcaactgggcttttgtgtatatagccatatctacatagaatacctccttttccatttcttagcttgatatttatgagcatgatatttttttcatgatatttatgaacatctactatctattaagcactcgtccagatcctgaggatttatatagagatgaacaagacagacacaatcccagctgagatgctccacctctgaagtttgtcttgaattggaaggagtggcaccatgacccttcgctacctgcattgcagtgcctttcctgttgtattaacatctgattacttctcccttccaatacatgagtttcctagaatgtttgcaattcatctttgtacttccagcacctagcctaatgcttagtagatactaactgcttcataaatgtttgcttgttcaataattgattaataatgtgcataaaagaagaaacataccaggagaataagtatatccatgtcattagagtttagaaggttttagtaagaatgccaagaggttgggtggaaggaagggtagcatctggtggtgaagggccttgtgtgccaggctgaggggactaaccttggtacagtaggcaacagcaattatgcattgggaatgtgcaaataaggcaatgccattcccagatttacatcttttaaaggtgacactgttgacaggaggacaatatgaagggggcagagttgagtgaagaaaaatcagaggccaatgcactactgtgaataactgagacatgacaatggctccacttgttgtcttgagggagcggagagatttcaaggatcttaccttagacacagtgtggtcttgaagggtcctaagtaaacccaagtggtaattcatattcctctagggagccttcaggtatgaggtgcagccaaaatctttgaaattcttacagctacagcagagcatttaatcaaggcttaggaattccagatgacttccagggtgtgtattatgctactttttcattttacttagtctattataaaagctcagggaggctgtaactgccattgaaattctgtggagcttttggttagttgacaatatggtcattaaaataatagatcaagactattggggaaaattgactatcagagttgataaaagtgaattgttatatagatatttctgttttgtgtaagccttataagtagcctgagtgacattaattagcttctggtactaagattacttccagatgcaaaggtgttaatcgtaaacaatctattgtgctttgaaaaattaccttatccatatgaatagtgcgcaaatactagaaggtcaatggataagaaacgtaaacttcagaaactatttgtgtgtacctgtagatacattggtactaaagaaaaatgcttgaagtgtatgttaacagccaacctaacagtattagtttgtatagataaacattactggaatactactgggctactccaatgccaaattatttctttagggctcccttctaaggaattacaagggacaacacatataagataacagtagagtttgaaagggttgaagacagtcctccatttttatttattttcatctggcaggcagttccttgagaatgacgccttcaaaaacaagcgtgatgaaacaaatgctaagggaagaataaatgatcattaaaaaataaacttcttttattttctttcagatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttgtaagtattttcactttcttgaagttaaaatatataataaaaaatctaggtgtgggaaaagatgtttaaaaaataatctcgtccaagcatccatcagatgtgagtctctttccaagttccttttgtattattacctgagttgtgtttgaatattttctgtgacgggaacatgatccttcttgagataaaagactttatgcttagacagaattgttgaaaattccttagatttcacagaatctgacaaacaaatagtctttatttcttggttccagtgctattccttttagggctaaatagaacaatctaaaatttctgccttaggaaactccaccaaaagccactttcattccatatcttcttaccgtccagccacagagttacgggagatgttctgttctcagcaatgtctcttcttgggtatatcttgccaattttaaattctgttaacctcctccagcctagattagctttgttttgtgataagagtagaagttaagagcaaagaactcaggaatcagactgcctgggtttgtaccccaacttcattgcttgtaagccatgtgacctggggcaaattacttaactgtgcttcatttcctcactgtaaaaggaataactgtagtagcctaccatatggtgtagcactgaggattaaatgaggtaatgcatgtgaagtgcttagaacagtacgtagtaaatttctaatgtgttcattatttttcatcaagtcaaaaaataaacatatatcaaacacctactgtaggcaggaaactgttctaggtgcttaggaaaaatagggaaagacaaacaaacaaacaagcaaaaacaatcattctgccttgtgacagttaatgaataaattaaatgctatggaggaaaaaaaagagaggcaaataattaggatctgtagtgctgtggagtgtgttggtgaggagggtattggtgccagtgattgcaattttcaatagagagttaggtctgagaagattatttttaatgatttttggaagaggtgaaagagccaggcggaacgcctgggggaagaactttcagtcagagagggaagtcaatggaatggccctaatttgtgattatgtctggagaaaccaaggagtggcagggaaaccagtgtggtgagagtggacaaggggaagaggattaggaaatggagccagaaaggtagtgtggggccatgtagggtaggcaagagttggcacactttttctgtaaaggattagatagtatatatgtcaagctttgcaggccatgtgttttccattgtatccaatcaaatctgtccttcaaacagtaacactgctataaaaatatgtgaattatgggctttactgtgttccaatagaacattatatatggactgtaaaatttgaatttcatgtaattttcttttttttttctttctttctttttttttttttttgaggcagagttttgctcttgttgcccaggctggagggcaatggcaagatcttggctcactgcaacctctgcctcccagattcaagtgattctcctgcctcagcctcctgagtagctgggattacaggcatgtgccactgtgcccggctaattttgtatttttagtagagacggggtttctccatgttggtcagtcttgtctcgaactcctgatctcaggtgatccacccgcctcagcctcccaaagtgctgggattacaggcgtgagccactgcacccggctgtaattttcacattataaactcttattcttctgaattttttcaaccattttaaaatacaaagtcttagctcataggccatacaaaaatatgtagtgctctgggtttggggattttgccaatgcactatagggtcttttagactggaagaattgttgttgttcttcttagtttaattatcatgtattttcaatctcccacaattatgatttagaataagaattcttaataggcaagatacaaagtagtttcaataaagataaatcttttctaggaaagcagtctgtttttctcatgtttttatgtacacaattctttttttacatttcatgtaggaaaattatttttaggggaatcagtaaattttttcaaagtctttgtcttaaatgtcagtgattttttttctttatgtactgcttaactcataattctaagtactttattttgatgggcagaattcaattagtgagatataatgaaaaaatacagatgattgcttctgattctaaaacctaagctatctggtgacatgttaacttagaacagccaagataattcatgggaaaccatgcttagtggatttattttccactttgatccttaggtcgtaagaaataaatgatgattattttattctatgtatgctaaagtaagttattttatttttatttttaaattcagctgtattgctaactttagtatgtggagtttttggtgcaactaaagggaaacgttttcctgaagatttagcacagcaaaacttaattatatcaaacacagaagcacctggagacgatagagtggtaagtaatttttaaataaatatgtatttgtatctccgataatttaattcatcctcataaactcatttcaaaatttaggagttaatttatatttttaattgaatcagatttcataggcatagatattgtctgtcaatattcatatgtttatatagtggtaatttattaaacttcttaatccagatgtattattttagttatcttttttccactctagtgtcatagtttaaacttgttctttgatgttgagtatttattataacaatagttttttttgcctgcactctacaatgtatatttccagatataatttgtttatgtaacttgttgaccatttataatggggaaaaaagcttgctaaaagttctcaagatagctaggaaaatatcaatgagatatatctaaaagaaagggagaggggtttggaagattactgccactctctttccttatatatttcttaggacttctgaggtgcttttatgcttcttgttttgtgtaaagtatatatatatatatatatatatacacacacacaaagtatatataaacacaaagtatatatatacacacacatatacacaaagtatatatatatacacacaaagtatatatatatgtacacaaaatatatatatatacacaaaagtacttacaaggcatgttcttacctcaaaaagatgccaacttatttatgagaaatagatcctactttatggaaaagcaaaataggaacatgacaataaaccaatatgataaagcactgtcagagttcaaaaacacctatgatacctaaatgtactcatgtagtttggatcaaccagaaaggctggtgacaagaggtacagcttacttggtaacttaaagaataagaagggtttgaaagtgaagagacggtgagaatagctaaagaagaggaaaacagcatagcctacaagacaggagatgataaagtttaggggctatttagcaaataataaataaattgatttagaatagaagaaatcatgtgttggaaaagaggcttgaaacaagttcggtgttagagaagagaatattaagaaacaagtgggagataggacttctaaatgctgcactaaggatttcggatttattctcatggtaaaggagagccagccaaggcttttctacaggagagaggtataatcaagcagcgtgaagctgagtcagtagggggatcagtgagaataggaagacatcagggttggggaagatgaaagcttagtttaagcatgagttaattctaccaggatgatggtaattgttatattaagatagggatgaataagaaatatttcaaaggtataaaggataagcttgttgactgactgaacttaaggaacaaagtaaaaagcagagtcaaagtggcagaggctatagccagggacaacgactacatatccagccttttctatgtctcggggtgaagatgcctttcttattcactatttctctcttcaactcctccacaccaccatgcaaaatcatagcccatctatgcttgacgtgcctacatgtagaaacctgtgatgatctctccagcgagaaagcaggtttaatcccttgacagtccttgactcatagtaagttcttattttatttttaagaccggcatggatgacttttacttaatatctgttctttgccatttaatgctagagctgatgatattgagtggccatttcacaatatgtacctgttctgtgttaggaacacttctaaaaggggcttggaattattaatttatacaaaaacataaaatttcatcttgaatctataaacttgctttaatacaatgagtaaaagtgatcattttagctttggatctgaatttcacttgaaggcatgcacatgggattaggagttgggtgaataatcaggactggaaaagtaaacctagaaattattgacatggataaagagttgttgataccctgtgagaaggaactttgggaaatgtggatggaggaggacagaaaggagcagagaataaaagtatgaaagctagccctgtaggctcagcattgcttttagtttattttaaattcctcttttattcacttagaaatatgatctttgaacttgtgtttattacaacgaaattataccatcaagaagatttaataattaggagggtttttttttttccttttttgtaattgaattttattgtaatggcaacttaaataaaaaaatgtagggtagcactgccaccaaatggctacttttcaattctttttttctggtatttttttctaaggcaatgcgacagtaagtatgacttttgtagatatatttcaggttcaataaatcatctgtatttgaaaaatctttcaatttagttaaagactgcattttaagtagaaaaaaatttaaattgataggaaggtggcacaaaggaacctgaatgtaatggaggttcttgtcctgaaagtaatgtaactgtttgtaatgaaaactgacatgtcgaggttaccactgtaactaaacttctgtcctatggctcagagggtcggagtgaagttccagtattaagttaatgtttaatgaagactttttcattttaaagcatttccttgactctttgtcatcctctagttccctccacatctctctttttctttcaaactgaactttaggaaagaaaaaattatatttgatttctctataatactccttcctgcttacccagcactccctggaaattcttttggcaaagctcatcaatggctattctttcacttaaatccaatgggcgcttatactttaattgaacccattcttaccttgctgtgatttttctgttgttgttgttaacatcattggctgctcccactccttaccatattctctcttcatggcttcagggtcctgccactttggttttctctgttatctcagtggctattcagatctggcctgtcacagctgtgtttctcttaccctccccttaaaatgtgatttttcttgtggttctatccttagcccttttttattttggttgacaattttctctggataggtcctctattcccatggcctcaactatcacctatttgggagtgtctcccagaattatatctccagctcaaatctctcatctgagttccaaatccgcatattcatatattcatcttggacatcccacatgtttctaatgtttaccatgttcaaactttagttgctcactctcctcttgcccataagcacatctttcctccctgtttcagtgagttgtaccatctacctgtttgccttcatggaacacaaaagaataatttctaactctgtccttgattgcctcatccatctagatacttgtaggctctctgtggagtccatctacttctttcagtcatcactgcttcctccttggcttaggtccttatcatttttacctggaatatcagatcagatcagatgcagtgacccccatctgatctccatgaacttaaatttgtcttcttatttgtcttccacattattgcctagaatgatatttttgaaatgtgtttctctctgtaatgagttaaaattcttcacagtccctgtgatcttcataataaagtctatttttttagcatagcatatagatctttatatcttatggccttttataacctttctaactccccccaaccctaatcttatgtggtagctgttctcaactgattgaagttggggacccctgaaggacattgtttgccttttgcctccagacccttctacagtggttgccttgtttgtcccactcctactagtccctagtctcttagctcagagtttttccagttacctgttctattccacctaccctgtttggatttgaattttaatgctctacttctgtgctcttgtaacattttgtgctcacccacatagtagagtaatcacattctcaaagtatttgtttttctctctccctggaataagatcttcttggagccatcgagagactatgtctatctttatatccctaggcttttgcatttgctatggtgaaatttgtccctaaaagctgatatgttggaaacttaatccccaatgcaacagtgttgagaggtgagacctttagtaggtgattaggtcatgagggctctgctctcatgaatggattactgtccttatcatgagaatgggtttattatcatgaaagcttattgtaaaagcaagttcagccccctgttgctcctctctccctctctccctctccctctcactcgtgctcttttgcccttccaccttctgccatgggatgggccctcgccaaatgtgaactccttgatcttggacttcccagacttcataactgtaagaaataaatctctgttctttaaaaattaaccagtctcaggtattctgttatagcagcacaaaatgaatgaagacagtatctgggcacataattagaaactgataaatgtctgttgaatgaatgaatgaatgaatgaataaaaggttgaacaaatattctctctcctttgccttctcatgacaacttagaatccatttcctctcaacatgaattatttcattttattatttcagtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaagtgagtttccttaggtgttttgagtctaaaatttaaacctccgaatggagaaaaatagacaattcaaattaacatatattttctgtatttttctgtgggctctctcttgcttgctctgttcattttcccgtgctctttgattttgttacattatttaatttaaaagagattttatttcatttttcatatttcatttaatttataaaatcccataaatataggatgtttttaatattcttcactaacgtctcatttttagttgtgtatttacctcatgaacccttttgatatagaagatcgtgaaagtaattctagttcctcacaattacaaacttttcaaatgaaatctgtatttctctgtgaaaacaccaacatttgtatgcagttttaggataaagattaaatagcatgatttatatatatttttatcttattgcaaattgacaaaatttaattgtatatgtttatggggcacaaagtgatattatgatttatgtctgcaatgtagaatgattaaatcacacttaacatatgcatcacctcaaatacttattttttgtggtgagaacatttgaaatgtactttctttgcaattttgaaatataacatatactattattaactatagtcaccattgcaggacatattttaaatatacaaagcaccatgcgaatgtaaagtgcttttattttaaggaaagcaagaatatgaaagaaagaaggaattaaaataaggaattctctgttcataccaaaatcacctatgaagcagaagcttttttctttcttttcctttttttttttttttttttttttttttaaggcagggtcttgctctgtcgctgaggctggagttcagtggtgcaatctccactcactgcagccttgacctcctgggctcaggtgatccttctatgtcagcctcctgagtagcttggactacaggtatacaccaccacacctggataaattttgtattttttgtggagaaggtgttttgccatgttgcccaggttggtctccaattcccaggctcaagtgatccacccaccttggcctcccaaagtgccgggattatacgcatgagccacttggcttggcaaaatcctctatgaagcttttaaaacataactaatggctgtgttctactctaaaagattctaatttaatgaatttggggttttttgtttgttttgtttttgttttacatttccgagatgattcaaatgtgcagctaggtagaaagccactggattagacactcttctggactaaatttttacctcttttatcagaggataccagtgccattgcaggacaaacagtagacctttaatccttgaatggaatgcaaatgggtgatactctggtatagggctgtaggttatgtatccatagcattttggagggtcaaattcaagtgttaattctttttctacttctagacagtcagtatttatgtaatatcaggttgagatggagtgaagcttaagacatagtcttaggagggttcctcagttgcacaccaggtaatgggaggtaaggctaacaatgtcatgaagaaagaacgtaagccatgccaatgaactccacataggcaaggagtgggcacacaggtgaggaaagggaggagacatggcagttgacgagttggcagacaggccagtggcagagagggtagatgtggctgaatgcatggcgtcttcattataaaagcccagtttttgcaatatgggtcatgttcattctttttaatttcattgaacttttcgatgcatgtatatattttgccatgtttgagtatcttggaaacttgcttctgaagttaatgtggtaaatcctacctagtttataactgcatataatagtgattcaagttaacatgtattgtacctttaatatgtgctgggcataataagtgtattatgcgtcattattttgtcattaatttctaaaataatcttgttaggtggtcactgagactaaaggatatttggtcacttgcccaaagtcatatagctagttggtaaagccagagctttgactcacaaccaaggctgtttgacatcctatctcaaactcctaaccagtatgactattgtctctattttttagactagactgacctctgtgtataaaatttagggataagcatttaatgacaacttgaatgtacttaaatataaaacttgtatacataattttttatttatatggagcactagaaatgtaaactatactgactttatggtatggttgtgatatagaccaatcatttgcattttctgtgtgtaggaatccattagaggacacactggttaaaaattaaacataaaaggtaaataaaaataaattttatgttcatatatttaagttgtttaaaactataatgcaattcattttttaaaaaattttacagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccccttttttttttgagacggagtctcgctctgacgcacaggctggagtgcagtggctccgatctctgctcactgaaagctccgcctcccgggttcacgccattctcctgcctcagcctcctgagtagctgggactacaggcacccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaatactcaattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcgatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggtt

SEQ ID NO: 13500 - DNA, 23953 bp, Human
  misc_feature (1)...(23953): n = A,T,C or G
tgggattacaggaccttagataaacttactatcactttatagcagtagagaaagcacggaaattggcactgtatttgttttctattgcttctataacaaattaccacaaacttggtgacataaaacaacacaaatttattgcttaaagttctgtaggtcacaggtctgacaagtgtctcattgggctaaaatcaagttgtcagcagggctgtgttccttctgggggccttatggaagaatctgtttccatgcctttcccagcttctagaagcctccagattcctaggctcctgggccctttcctccatcttcaaagccagcaagggcagattgaggtcttttcaagtcacatcactctgacctcttctgcctccattttccacttttttttttttttttttgagaacgagtctctctctgttgcccaggctggagtgcagtggcgtggtatcagctcactgcaacctccgcttcccgggttccagcaattctcatgcctaagcctccagagtagctgggactacaggcacccaccaccacgccagactaattttttgtattttagtagcgacagggtttcaccttgttggccaggctggtcttgaactcttgacctcaggtgatccacccaccttggcctcccaaagtgctggaattaaggcctgagccaccgtgcccagcccattttctacttttaaggaccttatgacaacactgggcccacccaactaatccaggataatatccctaatttaatgtcagctgataagcaaccttaatttcatctgtaacctcaattcccctttgccatgtaacctaacctattcagtctccaggaattgggaagtggacatcattggcagggggcattattctgcttgttataggcatacttgcccacaagtctaaatcgagagtttgcatataggaggtaggaggtgtgacaataattggataaaggcttttctggaatgacaaaattctcttcaaatacagggaggccctgcgacatgatatctggcaaatcacttgagtcttagtatccaaacttccgctaaaatggaaattaccatcctttgcttggcatgttaaatgaaatacttatgtaaacggacttagattagaggcctacaaataggactcaagttcttgatgaatcttgatgaggagggtgggcgaagtactctaaatgaaaatgagatagattgcgagatttccggagaggagtgagtgacaagcgcctacccgtgcatgaagctggaggtagaaaattccagcaaaaggaattttcaagtttcactgaagcttttgaatcaaggcttgaaagcccagggttaaaaaaaaggcagtgaagaagctcattaagacaaccccccgccaggtagcagatagcacctgaaatgcagtgggaaatttgtgaggtcttcataggcaaggattaaattttacatctccatcttaagatgtgtcatagttgttcaattacttagtgaccaaaaaagtgaattaaagatgttgtcaagattaaaaaaacaaaaaccaatgcaggttccaccgagatttgaactcggatcgctggattcagagtccagagtgctaaccattacaccatggaaccgccacgcatgtgtagctgccttcggctgtctaatcctcagagaaccccgcccccatccacaaacccaccactcacaggcggtcccgcctggttccagcgagccgcttccggcacggtagctcgagaaatgagcaagcggccactaagactatggtagctaggagttccaggactcagtttcccctttgagcctcctttagcgactaaagcttgaagccccacgcatctcgactctcgcgcacaccgcccttgttgggctcaggggcggggcgccgcccccggaagtacttccccttaaaggctggggcctgccggaaatggcgcagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaaggtgaggccatgggctctcgcactctacacagtcctcgttcggggacccgggccactcccggtggaccctcgtgccggccacccctgcactgatataggcctccctcagcccttcctttttgtgcggttccgtctcctacccagctcagcctcttctcccccgctcagacaggggtccccatcacatgccgctctctgagcgacctctccataggccttcgctggcctcagagcccctccctgcgtgtccttcccctggcggactgccttctcccacatcgtcgaattcctttccccgggttctacggccccgccgctcctcccaccatctctcttttcgggtgtagcgccccctccccctcggcgtacacccttcccagctcgcgtcctctcccgaagcccctctgacgggttcttcgcttccctcttggccttgccttcggtgcagactcccattacaggtctttttcttatctgccctctttcccccctcgagcgagcgtctcttctgtatctcccctccacttggacggccgcccctctaagcttctcccatcccgggtccaggaccccgtaaaatctgagcgggccaagggcctccgcccccaccctccgccccgcggttctcgcggtccttaaccttctctgaccgctccctctcccactccccatttggcaactctctctaccttccctccccaaatcgtgtttagagctcccttgtctccgttgcgacctgggtggtgggagggagggtaagagggatcgcccatcacccactcgcgcacttgtcgcagtgacccggcaggctgacattacttcccacctagccttttcttttcttgccctccctactcagtggcacccaacccgggataactctttactcggttcgcgagatgaggttgcggatgggtggtggctgttatccttgccagacctgaaggcctggttcctgagcaggaaaggttgtgcgctgcacaaatactagcttgctttatctctatgaactggttgcttcctgctgcaacgctgggaggatccaacaggaagggaagagccctagttagccacatacctttcccaaaaggttgggggtgggaggaagttgtgtgctcttttggttacattaaatatttattataagatacggaaacatgtagtgcccttggacagaacatattggagggtcagggttggttagaaagaattgcttattggttgagtccggaaggaatccggtttttttttttaatcaacgaagataaagggtacatttttcaatgagaagagagtacagtagatgctttttttgttcagtgaatgcactctcactctgatgctctttctctgctcctgaattgggaaggtagccatcagtagtgtgccgaacaaagatcattaccactgaggaagaagccattgctattaaagctttactgtggagggtggagtttcaagagtgttaagcatggtgactgtttctgtctttgccattgggtgctaagaatgattgactaaaccaagcaggaaagatttctttgctttcccaatactttgcaaatcttgttatactaactagtctgctgttatactcttatcatctcttactcctctgactcagaatattctactgtatagggtgaatacttttggtatccaccctccccctccatactggaaagtactttcagggtacttagttcattttacaaatacaaaactgaggcctggattacaaaaagtatatgacagcataccttttgccgaaggtatctgagatgatgtgaaactatttgaatctcttgagactttggggttaaaggttaggtttgtgttttgaaatatggtataatggtagtgtgcttttataaaggttgtctttgaagtaattaattcagaacaagatagaccgtcagggtatttctcctgtttggtttgaacttgaatgttggttatacaaggtccttttattttttaacaaagaatattaaatattctgaattggcctaaagtattttaactttttgattagaccatccttctagcaacaattgagagcactgagctttggaatcacgtagacctcggtttagatcctgactcaggtcttatatttactttatgaccttggaaaagttaacttttctgagtctcagttctctactttataaaaaggaaaatacctgcctcttaagattgtgagaattaaataatgagactgttcgtaaaattttaaccatgaggactcaataaatggtaataatgtgaaagaagttactgtggttttgtcagtttttttttttttttttttttttttttttggagacagggtctcgctctgtcccccaggctggagtgcagtggcacaatcaaggctcactgcagtctcggcctcctcaggctcaggtgaccccccgacctcagcctccctagctactctctagctcctaggagtagctgagactacaggagcgcgccaccacgcccggctagttttttgtttttttgtaaagacagggttttgccatgttgcccaggctggtctcgcactcctggacttaagcaatccaccttcctcagcctccccaagtgctgggattataggcgtgagccactgtgcctggcctttgtcagttttttgaaccttaaatgtaggttcaactacaagagcatttaaatattattaaagaaaataaaactaggaacttcgaatgcattttatgtttccatgggttatggtttcattttgttgtgcattttgctgtttaagatagggtgttaaaaattctgctaaggaggatttctactttttttttttttttttgagatggtatttcgctcttgtttcccaggttggagtgcaatgacgcgatctcggctcattgcaacctctgcttcctgggttcaagcgattttcctgcctcagtctcccgagtagctgggattacaggcatggaccaccacacccggctaattttgtatttctagtagagacggggtttctccatgttggtcaggctggtctcgaactcctgacctcaggtgatccgcccgcctgggcctcccaaagtgctgggattactggtgtgagccaccgtgcctggccagatttctacttttttaaagctcttacaggatatgagtcactttttctttttcttttttaacttcaatgctgattatttagccaatttcttatttatacaagtatcctactttaaagtgaagcaagaatgattttatttcaaaatggctttattgtacagagatttattcactgagatggactgcagctgtttctacttagaaggtttacctagcaaatgcaatagttgagggaattggagttagtttgtaactaaccagttcaaaataaagggatattttgattaataggggatggagtggtctaaataggaatgtaatgtggggcgagcaggacaattattctaaattatgtgtttgttcttgaacagtaacctttatttaagcccaatagtgagacttttggtgggagggaattagttttattttatttaaagttgactttttatttttaaaactttaattccttaagtatttacgaacaatgtggttaaggccctgtgggacataagtaagcatcaatcatgatttctgtttacaaatattgtgtggtagacaccaatccacagttagattttctgaaaatatctggatacatagtctattgcttaagacattttcttttcaatcacattggaggtcagtagtaattaaccatcagctgattgtcagtagaaattatcataggaactttgctgtcttgcatcttggtagtagtttttctttcacaagttttggttgagcaactcagattctgctgaatctggaaaaacttgtctagacttgagccttattgtatgcattatatctatatctatatctatatatatatattttttgaggcagggtctccctctgttgcccagtctggagtgccatggcacagtcatagcccactgcagcctcaaattcctgtgctcaagaaatcctcctgcctcagcctcccaagtagctgcaactacaaatgtgctccaccatgcctggctatttttttttttttaagactatcccacttacagaaataaaattttcttttttgtagagatagggtctccctacgttgcccaggctggtctcaaactcctgggctcaagggatcctcccaccttggcctctcagagtgctgagattacaggcatgagccactgtgtcctgccttgaacgcattgtatattaaaaacttttgaggaggttggactatgaatatagttgaaagaatagaaatgtctccaaatttatgaaaactagaatgaaaattaccagttattctctcacgtggtaacttttagggttgaggtactgtctttgatgaattatattttagtccagtaaattagtttgcaagagaaagtataaaactaaatgtggttgaagaggcagaaattttcaatggataattaatatgtatattctgcttttatgcatttagcagcttgatattcagtattaggtatttgcgatgatactcaaatacagcagatgtctagttgataacttttttttttttttttgagatggagtttcactcttgttgcccaggctggagtgcaatggcgcgatttcagcttactgcgatttcagcttactgcaacctccgcctcccgcttcaagcaattctcctgcttcggcctcctgagtagctgggactacgggcatgcgccaccacacctggctaattttgtgtttttagtagagatgaggtttctccatgttggtcaggctggtctcaaactcccgacctcaggtgatccaccctccttggccttccaaagtgctgggattacaggtgtgagccaccacgcccggcctagttgagataactttttaaaacattcatgaattttgagttattttcagattagagtgctttttttttgtagtgttaacattaattggttacattaagagaaaagttcccttgctatctttatgatggtataaggagttgagattggtgagataatgaacataatcattagttaaaagtggaggtcaaaagggaggaaaccaaaacttgaaagtgctggagttggccgggcatggtggctcatacctgtaatcccagtactttgggaggccaaagcgagtggatcttttgagccccggagtttgagacccagcctgggcaacatggcaaaaccccatctctacagaaaatacaaaaaattagctgagcgtgttggcatgtgcctgtagttccagctactagggaggctgaggtgggaggatcctctgagcctgggaggtctaggctgcagtgggctctgcttgtgccgtggcactccagcctgggcgacagtgagaccctgtctcaaaaaaagaaagaaagaaagaaagtgctggaagttttttttttgagacaagttctggctctactcccccggctagagtacagtggtgcacagtccaggctcaccacaacctctgcctcccaggctcaagccatttgcccacctcagcctcctgagtagttgggactacaggcatgcaccaccgtgcctgtctaatttttttgtttgtatttattcatgtattttttgtgtatttttttgtatttaaatttttttttttgtataagtgattcaaaggccatttccttagcaaacatccagccttttgtactaagaggcaacagtgaatgtatcctattaataatagactattaactgaaactgagatttgacttcatatccagaatggtggaccttggaaactagtatatcaactaaccatcctataaaattgaaagtgcattgcttttgtacatcactttaataactttgacattttcttctgatatcaaataaaagcatgtatgtgtttgccacagcatctttgacaccctctagttgactctctagttagaaataaccattctttgtgctgcattggattcactgcctcctgaatgatttcttgctgaatcagctgactgagaaagccagaaagatatgcatttgataatgtactctgtccaagactgtccagaggctagcttatatccactcctgtggcaaggagggaatgtataatggactctctttgccctctgaccagaatgcagtgagctctcagtttttaccattctttccactcgtaccaccatcccagtctctttagtaaggaatggtcttactccttggccttatttttgtatgtttgattttctagtcctgatgtctaaatcaattagctagtttagataagaagaagtcttagtagtcaaaagtaggaacgaatgtaatgtttcctgaaatgctgataccaatttttacaaaggaaaaaatatctagctcagattctataaacgtgtgaactcattttgaactttaaattcagatagaaaatgttttaaaacaacttaactgcctgtttctccattgtttttgaaattcttaagcgtaataccactttgagtgaaaaagaatctccatgtatctagttagtaaataaactgctgcctatagaaatcacaggaagcaaattcatctaatcaagacctattttcaaaaaaatcatggagtcataagtgaaagtatatgccctccttgctttgttgtattttattttatttatttttttaagacagagtctcagtgtgtcgcccaggctggagtgcagtgacacaatctcggcccactgcaacctctgcttcccgggttcaagctattctcatgcctcaggcccacaagtagttgggattacatgcgcccaccaccacacctggctaatttttgtatttttatagagatggggttttcaccatgttggccaggctagtctcgaactcttggcgtcaagcaatccgcccaccttggccttccaaaatgctgggattacaggtgtgagccaccacacccggcacttgctttggttttgactcacagtatgtcagaattattagtttcctaataccccctgtttatctgtagtggcttgggtttttttggcagaggggtctctaactttgaaccaatctgataaatgcaactattaaaggtcattttagtttctgtgatctgtatggtgatgtttataaaccctatgcctcatatgttaaatgtttttcattttgcctaggtctcagtcctgaggtcacacccagtctttgatgaaacgaagtatattcattttgtccttccctacccactaacagcctttgttgttttcatttctgatacattacattttaatatcataaattattcatttagtttaggatttatctttgaagttgttatcttctaaagtagtaagattggcatagcattgacggtaattaatgcctgtcatcaatgccaagggcatctgtgattaaaactgcatgtttaagacagggtaccgtatctgtgctaagcagatgatatgtggaagtcatgcaggtagaaacaggttgaaaagaataaatcggttttattgattggtaactggtcaagaacatgctgttcaaccccctacccccattcctttttaaaagtcatataccttatttttcttgctttatttactctgaagccaaacttcattctgttgaaagcatagtggtgttctgaatatgtttgcctcattcatctgacattgaattctttgtctttccagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcgtaagtctcatggtttttaagttctgtgaaatgggttgccatcgagtgaattagctgacttttggtattggaaaaagaactgttgtttttttcttttaagaattctagtattaggaatccttagaaatttatttataagtatgtttttaaaactcatgatccatattttgagttcttcctggtgtttgcttccatcttgtggttttctgatactaaatatgtttctgttttcagatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcaggttagtgataggaattccatgatatttcttaccattgtgtcttgtggttttgataccttccaatgagagtaataggttataatagtttcagagaggtaaacatgaatgcttagcaagaattgttttgaaagtttgtgatgactgtatagcttttttgctttgagtcattaaaacactaatattttgctgccaaaaaatgaatataaacattgtatattctgtctctttttctgttatgtttctgtgtttacaaaggctgctgtacgtgagctctatgtgagtgaaaggcagaggctcagggagtgtcagggaccaacagggatgcagctgcttaggagctgtaactttttggcttcataaagaattcacgtgtctcttgcccctgttctggtagggacagcatgccagaagacaacattgtgcattgtggctagtgaaagtcttgcggccgggcgtggtggctcatgcctgtaatcccagcactttgggaggctgaggtgagtggatcatgaggtcaggagattgagaccatcttggctaacatggtgaaaccccgtctctactaaaaatacaaaaaaccgggcgcggtggcgggcgcctgtagtcccagctactcgggaggctgaggcaggagaatggcgtgaacccgggagcagagcttgcagtgagccgagatagcgccactgcagtccggcctgggcgaaagagcgagactccgtcccaaaaaaacaaaacaaaacaaacaaaaaaagagagaaagtcttgcctttgcactaatgcttatgctatgaataactttctgtaacagttttttaaatttcccatgcaagaatagctttattgtaaataatatggctacaacatacggaatactatagccaatgtagttgatggagaggatagcaagagatggaaataactgggcacttgatacatttttaccacattttaagtggtgtcattcgtcactagtgagtagtacttagatgtaacaagtatttattttaattaaggagccaattgacaatttctcactttttttttttttttttttgggagccaggatctcactctgtgacccattctggagtggagtggcacagtcaaggctcactgcagcctcgacctcctgggctctagtgatcttccacctcagcctcctaagtagctgagactgctggtgtgtgtcaccacgctcagctaatttttagtattctttatatagagagagcaaaacctctctccagtgttttgccatgttgcccaggctggtcttgaactcctgggctcaagcaatccgcctgccttggcctgccaaagtcctgggattacaggagtgagccaccatgcccagctctcttgctattatttttaatctattaaagtgtaaatattaaagtgtaagtagggtcgggcatggtggctcatgcctgtaatctcagcattttgggagatggaggcaggagaaactcttgaggccaggagttcaagaccaggctgggcaacctagtgagacctgcatctctacttatataaagaagtaaataaagtaagtaaataaataaagtgtaaacagaatggtgcccttactgtcccagaagttgaggaggtcttaagttttaaaaagttctgttatttttccttttgagggcttgagtatatcctattccttgttttaaaacttaacaagactgaacttttgtgtctcccctcagaaaagaatggtttgtcattcattgaaacttcggccctagactctacaaatgtagaagctgcttttcagacaattttaacaggtaagacttgtattttcagattacaccagtaggactagaagttttaggaaggtaatttaaacaaactaatcagtaactaaactatatatcagccgagagtgactatcatttgagagctactctagcaaaagctgtttagagtgcaaaattaactacaacccttgctcactgagcttcagttgtcctaattcatctgatttatagtgggaaaaatactttgaaaataattcattcacttccattattacttcagtccaggtattccattcttcatggtcacaaagtaatgtttaaatgtacttttatgaggtaaatattgagatcccagctatagaaagatataaatgcccttttttaaatttagtaaaggcaaagctagggaaaaaacatttttaaaaattatagcgacaaaataaaattctcccatgatacagaagaagggtatcccttgcgtattctatattgtatcatgggagataattggtagataaaatcagccaatgattgcatatagaaaagttttaaaaagtagttggaaagagatggagttcatgctgttttggaatgtgaatgaccaggtcagcctctgagataagaagtgttcactcatatttatcctgaaactattagaataaccagatttattagtaagattagtcttaatcttctaattagtactttgatgggttgtttttaaatacttttaaattgtatgttacttttaagaactcatgatttaaaatgtggtcttaatatatagtatagttttacgtggcattgttctaaaaagtctatacagagatatgattgagtttccaattataatgtaacaagttttgatttattgtttgtatgcagcccctgtattagagattaacagattttaactttaacatgttatcttcttttactgtaaaaatgtaagcgtaaagtcaaggagttaagatttggaagcctgacttgggttctagtcctggctcctccacttactgttagttgtacaatcttaggcaagttacctaacccttttaggccttaatttctccatctataaaattcatatatattttgaggagttttgttatttcttttttgagagaaggcttatatttataaaatcttgtgataggatttgacttgacttttgtgacctaaaggttttttgtctcagtaacccttagcaaagaatggtctgtcactgccctagacttcaaaaatgagtacctgtaaagtacccattttgaatactgtaaattacttatctatccctggtatatagagaacagttggcaaattagtagctgaacggcaattaaggcatgagaaaattggagatttatgtacctattttattataattcttttctgttatcagaagaatagtgctggggttggataagcagtctttggaacacagtagctttcctttagaatgttctctgtcaaagtttcactgcagattgttttaagcaagcaagatttgattaaatatgtagtatgtctgcaagtccttgttttctttatagccatttgtgtacattttattaagtcaacatgtagagtactagattgagacccaggagttctagggcattacatttttatcactttgcttctactccccgtttaactaaagtcactgaacctccctgctcctcagagtcatagtcttaaaacatgtgaattaaattaccttaaagatgtgtgagcattttaaggcctcagaaagtctcatctgaaaaaactttttagacagtcctcattgttggaatattttttatgttccatcaaatctcctctgctgtaattctggcccatttattctgatattaagtgaagatgagcccaagtcttccatctgcagttaactattttatgcatcattttgtaacattgagcttctgatccactcaaacatgaactagtcggtacttaaaattgagccctttaagagctgggcatgttgatgcacgcctgtaatcccagcattttgggaggctgaggcaggcggatcgcttgagctcaaacatcctaacacctgtagaacaacacagatgtctgctgccacatgcagtgatctcaaaagttcaagaccagcctgggcaacatggtaaaaccctgtctctaaaaaaaaaaaaaaaaaaaaaaaacacaaaaaaattagccaggcatggtagtgtgtgcgcctgtagtcccagctgaggtgggaggattgcttgagcctgggaggtttaggctgcaatgagccgagatcatgccactgcactccagccttgtgggcagagtgagatcctgtctcaaaaagaaaaaaaaagatgaacatatagttgcttttcttaaaattcactctagattgaacttttgttacagcttaattgttgcttgaaagcaaagaagactttagtttcacttgctaccacttttcctttctatattcactgtttcctcagcttcctgcataaatctcactgttggtctgtaggatcagagatcactgcatgtggcagcagacatctgtgttgttctgcaggtgttaggatgtttgttctaaactttcttcctcctgtatgccagtggaagtgtgaatgcatagagaaaacagtgaagaggacagactctttattgcacttgattctaccttaaatgttaacagtcttaagggagtatttacgttgtgttttgatattgctgaaagaaaaaatagctttaaaatttctaaaaattgagatggagcccagtctggtcttgaattcctgagctcaagccatctgcttgccttggcctcccaaagtgctgggattataggcatgagccaccatgcctggccaaaaattttaagttgtaaaattatatatcagaaaatttacattgttacttcagagttaattgtgttgttggtttcagaatagacccatggcattcttgacacccatgaatttgaaagtgactccatgagatgattttgctgatggtatttttttagaggtagtttactagtatgagagtgagactggtagattgctccgcctctgaatttcagtacagctttgtcttttctcaggttcactaaaggatgtttttaatacataccttttacttttttattttaactttgcattttgacaatttcaaatttaaagaggttgaaataatagtaaaaagaatttgcaaatatccttcacccatattcctcagatgttaatattttaccacatctgctttgtccttttctttctcttcgctctaaatatatacatattttttcggcaccatgtgagattaagtggcagacatgatgaccctcatccttgagtacttttcagtgtatattttgtaaaaacaaggatattctcttttatagccacagtataattatcaaaatcagagagttagataatagtgccacatcagtgtttaattacagaccttattcagattttgccagttgttccaataatacccttattagccaaagaaagtccaagatcaggtcatgcgtttcattcagcagtcatatctctttagtctcctctaatctcgaacagttcctcaatcttttgtttattgaccttgacatttttgaagggtacagtccagttattttgttgtgtacctcattttgggcttttctgatttctttcctcatgattaaactcaagttatacacttttggcaggaacaccacagaagtgttctcagtgcatcatatcagcaggtttgtgataattggatgtcctattaattactagtgatgttaactttgaccacttggttaaggtgatgtctgctaggtttctccatgtaattaatatgtccaggatatctttttagcatgaacactaaattcttttttttttcccctgagtcttgttctgccaggcaagactctgcctcctaggttcaagcaattctcgtgtctcagcctcccgggtagctgggatcataggcctgagccaccatgctctctaattttgtattttaagtagagaccggttttaccatgttggccaggctggtctctaactcctggcctcacgtgattcgcctggcctcctaaagtgctgagattacaggtgtgagccaccgcccctggccttattctgcttttggtatgtcagaaaatttccataaaaaaaaagttagagatgtattaactgaattactacattttccaaaattaagaactaatttctcagaagttgaaaaacagtaagctgtagtcaactgaatatgtaaactaacaaaaacagacagcaagtgtatcttttcttagattcttttgtgggggaaggggagtggctaaaatttatgtctgagaaggttgacagtggttcaaatgtgaagaggcattaaggaaagacaactaggattcaataaagacaggctactaaaattaaaattaaaaaaaaaaaggatatggaatctttatttagattttgtttcaatgaaaaaggatgggatgggagggtgccaaggctaaagaaaaggatttacctttcagtcattcaatcagatgagtggctaaggaataaagataattaacttgcatctttaagctttccctctagtctcaaactgggaggctcttctttttcaagtgtaaattatgtgtgtaaattaagatgaaatatgtaacccactgtaagttttaacttccttataaattgttttgaagattaaattaggggaaccaaaacaaagaaaagttcttacataaaaaacaaatatatgtaaaactggaagagagggaaaggcagacttctcaaagaacatagagaagtaaataattaaagagatctcattacaaagcaagaaatttgagcagtgttggtgtgttacaagtacagcatactgttttttagaaatagattactgctgcacttactccagttaccaaaaaggatgtctgctaataaaaatgccaccaaagcaataaagagtgattggctttaagaggttccacaagtaatttacatacttaagtctcttgtggctgggtgtgtcattaaaaaaaaaaaaaaaccaaaccaaaaacctgataagaaagtaggaagcaggtaacttctagctgtctgattagagaaggttatttcattgggagttttgtgggggtgggggggtatgctaaactagatctatttccttctttcaaaggcatgttctcctttagaaccaaatgaatataccaattcctatgcagtcgcccccaccgtttttttttttttttggagacagggtctcacactgtccccaggctgaagtgcagtggtgcagtctcaacctcactgctcactgagtgagactctgtctcaaaaaaaaagnnnnnnnnnnnnnnnnnnnnctacataatcacaataccgtatgtcgtatccaagaaatttaacatttatacagttttttttttttttttttgagacagtgtgctctgttgcccaggctggagtgcagtggtgctatctccactacaacctcccctccgggacaagcgattctcctgcctcagcttcccaagtagctgagactacaggcgggtgccacccccacctggctaattttttttttgtatttttagtagagacggggtttcaccatgtttgccaagatggtcttgatctcctgacctcgtgatccgcccgccttggactcctaaagtgctgggattacaggcgtgagccacctcgcttggcccatttatacagtttttaatgtgcaatccatattcatatttcttcagtatactaataatgtcctttgtagatttgttttttaattaaaaaattcaagatccatttaaagatcacatgtataggagccaagggaagtgtccctattgccctctgaaggtttgctgaaagctatctgatacagctttggacctttcacgaggtccaaacgataggtagaggttaggaagaaaaagaatcctgctttatcatttttatatcatttagatttctcttgtaggagatctaaatagaaacctctgaaagtttgctggaaaatcaactcacaaaaggcattttaattggagaaaaggcatacgaaatttattaacatgtacactgtacactggttttctctggggagaaccagagagatgacccacctcccaatggcattcagaggcttatgccattctggcaaaacaggttatgggaaggaggagaaaaggaattctgttgaggggattactggggaggatgaacggatcagtggacagaaattaattggtacattatctcgtgaaagagtctgtttaagtgtggttacattcttgatcttacagggaggggaagaaaaaacaattgtcccttttagtgggtctggatctcaggcagatgaaggaacttcagcttcatcctgtgccagggagagaggatgagggggagaaggtcagagagaccttgaggcttctttagttcagcatatcaaaacgccattttggagtatgggtttctgagccttaacagatggaattgttttgtatctgggatgttgaataaagtagccacaggttactattgagcacttgaaatgtggctagttagatgaggaattggattttaaattttatttaattaaaatagatggctactctcttggatagcacaaatttagaacatttatccccatctcagtctggatttatctcattatttcctcatgattaaattagttttaaatatttttgtcaggaatacatggtgtcctttataggaatacattgtgtctttcctagtacatcgtattaggaggctaattgtgttaatttgacacatttttagaattatcttgctttttgagagtagtgtttttggagggacaactgggagagtaaacaaaaataaggtacattctctgttcttaaggactttataatctagtcacagggaacaacttttaggcagtgcagtataagaccaaacgtgttacatacagatacttattgtggaggaatttagtgacattcatgcggttatttatttatcacaacacatgttatatgttgcagtacagcagtaagacagacacagttttgatccttacagagtttaacacttagtaaaagaggcagacactaaattatttttgataagtgtcatgaaataaaaatagagtttacatataacatcttaagttgcctattttgtatcattctttaattacaatttaagttttgttcaggaggtcactgataaacacattatctttttttcccttccaagaatcgtttgggattttagcatgtttgttaagatgtactctgccgaatgcgtctgatagtgcaaatttatttattttttgtgtggtacaatgtcattgtgtgtaggcaatttttgtttgtttgtttgttttttggggtaaaggtagactgaaaatactcttatggtttactttgaatctaagtccataaacaatgtaatgctattggcttacctcttttttttttttttgagaccgagtcttgctctgttgtctaggctggagtgcagtggcacgatctcatctcacgacaacctccgcctcccgggttcaagtgattctcctgcctcagcctcccgagtagctgggattacaggcacccaccatcatgcttggctaatttttgtatttttgtagagacagggtttcaccatgttggtcaggctggtcttgaactcctgacctcaggtgatctgcctggcctggtttacctctttaaacaaagatttatttgactggtgaacctttccctctgacatggaaaaacctttgtttcttttcttacccaaagggcaattgttaaaataaagggttgaatctaatcagtggctgtttgaaaataaaactttaaatttatgtattctctgttcagtttccttagggactttgatgcaaatatatctcctacctttatgtatcttttatcctaactatgataggtttattcacactaagtattgtggtttcttttttccttcagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggattatttcttatgctgtcagattacatttttcctttgagtgctttgggtgcagccgtggaatcctgatgtaaaagcataggttcttgcattactgagtaaacattgaattgggagcatcagtgtgtgaattcagctttgattttagaactgcagttcaattatgctttccttggaaaaagtatgtccaaaaacattaggaaagtagtgtgtattttcatatataacagtgtcaccagacccaggaaaagaaaccatctctattttattgaaagttggtggtagattttttacaaagtaaggagaaaagagaaaaactaaatagtgaattgaaaatgaataaagtaaacttagaatttttacccaagtgtagacttaaatgttgctttgagtatggctggatcttgggagaattccaggaaatattaggtattagaaaatgactttgattgcatttcagcaggtgtctttattctgagtagtatcttaggagacaaactgtctcaagcaagaaacaataaatttttaaatattatgacagttcagggcttaaggcagtttagaagtattttgctacttgaccttgattttcagttattttaactttgaatttttttttttttttttgagacggagtcttgctctgttgcccaggctggagtacaatggcaccatctcagctcactgcaagctccacctccagggttcatgccattctcctgcctcagcctcccgagtagctgggattataggcgccagccaccacgactggctaattttttgtatttttagtagagacggggtttcaccatgttagccagggtggtctcgatctcctgacctggtgatacacccacctcggcctcccaaagtgctgggattaaaggcgtgagccaccgtgcctggccttgaatttttttttaacctgttatatagtctcctgaatagttagccatggtgccttgatttaatcttatgtcattgttctcaaatgccatgatttctctttaatagtagttgtcattatgtaagggtaagttattgcccatttaattgtaattataagaagaggtgccagctagtgaccttacatcagtgatcttttaagttctgaagggttctgcagaaaagttacacttcttgagtttgggttgcccatcagagctggtcacatttctttgatcattgaaaaaatgaatatcttaatttttgtctttgctgactggtatttataaaatacaaatgcttttagtgggttgagctgttgtgataatctcttccatctaccttagagaagaagctgtactatttagacagttttggccaacactagaagcaaaagaattcaaaggctgggtggatatttaagaacttattctaacctgtcaggtttcaatttgtggggcttggtttaacagaggaaaaaaatataaattgattttctgatgtctcacaaatatcacatacctggaaaaaaattaaaacaaaaaatgaattttgtaaaaggttatgtatgacttccatttgctctgtaaaaaaatgaacaaagattgtgaaaggatcctcttccaccacatcatttaatgggttagcggaacagatagggagctatgacactagcaccaaagagagatttttcttctggttgggtggtgctggtgccacgcccctttctgggatttgacaagtctttcccactcacctatacaatatgccaaatcaactggagttgtcattctaatgttttaaagaatgattgggttcccccaaactgtaggaggtcgatggtaacaataaagtgatacaaaatgcttatgtcattataatttatgtaagggagaccattaggctgagaatcaatatgattgaggttatctattctcctgaaaagtgaattggagaataaagaaagaatatttgaaaggatgttgtgtactaggcaatatactagcatgtattagaaaatacggtaaactgtgggttagaagagtgaaagtagctggtat

SEQ ID NO: 13501 - DNA, 128516 bp, Human
atcaataaatgtggattgtgtcatccttgtctctcttgacggacgggaagaggagagtgaaacctaagaccacagcggcagcgcgttaacaggaggaccagcaaggaacggaagccaggttgtcaagcctcagttggctttcacgtattctccttttcaggcgggtatttaggaagagaggagggtgaggagcacagcgcacttctgcagcagcagctgcggattggcttgtgggaggcggttctccggagcaaggcaagggcccctgccgcttctgggctgactgtggattccgccacacctcacagggctttgtaactccccacccacttgagggttccagataactttttttttttaacaaagcaggggtgggggtgggagattcctgctgttaaaaacaaacaaagggcttagacaccggctagtcggctgcgggaggcagcaagagaaaggccgaggggcctggagtagctcctgaaaaccgccgagggccctgcgggcagacgcccctgaattcttttggtggggagaaaagccgcggagctccccaatgtgccaattggtttgttgttgttttgctttttttgaatacacaaactctccgaaaactcctgtcttgccccacttttttgtgagttcattgctttggaaacaaaactctcttccatttattggcaattatcaaatttccgatccttctctatcaggagatccagcaacaaacaccctgttatgtaaatttctttcaaagataaattcgaaagcccctccattcattccttcaagaactcaacagatgtccttgaggctcattttctgccgggcactcggttcacaaggctcaagagacccctggctccagccattgtccaggttgtcactggtgtccccagctctccacttctgaggacccacttctcaccccctcctcctccgcacacgttcccgaggctctcggccggtgtgatctcaccgactagagaataaaaacagcccaggggcgccggcgccggccaagggccttgacggggatcagcaagcgcgaggccaagtgcgggccccaacttcctgggcccgggccttccgcgcgccccctctcgggctcgggtcctctccagggtgcactcgcgtccggacgacgcttacttgctgcgagtccaaccctctccggcccgcaactccaaccgagccgcccgagtgtggactccgagagcggacgccacgggccgcgctcagccctcccgcccgaggcccctctcgccgtgtttcccaggacttcctccccgcgcccgcccgacttcaggtcgggccgcgcagggtcccgcgcgctccagccaggactgccgccgcccgggtcgcccacgtgggctgctgggcgcggggtggtggccggccgggcgccctccccggagcagggggcgggcagggcgccgggaggaggtggcggggcgcgggggaggaggcggggagccccggcggcgagggggcggtgacagcacttggaaaggaggctgcacgcggatttgcatgaaacacagactgggagcgggcgggagcgggagcgcggcgcacgccccgggccggcccagccagcgagcgagcgagcgcgagccgggaggaggagggtggcggggcggtgaggccgcagaggcggagggatctgcgcatcaaagctagcgaggcgagcgaagtttggccgggggttggactttccttcccggaggcggcacccaaacagctaccccgtgcggaaacccaaacttctgctgccacttggagtctcgcggccgccgcctccgccccgcgttcggcgcttcccgaccctgcactgctgccgtccgcccgcccggccgctcttctcttcgccgtgggagccgctccgggcgcagggccgcgcgccgagccccgcaagctgcagcgcgcgcccggccggtcgccccggcaacttcgccgagagttgaggcgaagtttgggcgaccgcggcagccccggccgagctccccttctgcgccccggcgtcccgtcgagcccagacccgccggggcgctcctcgcgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtgggggcccgcccgggggggacccggggtcacgccggcccagccccctggcactgcggggccgacccagtggggctggagatgggaagagggagagagagggagggagtgagactgtgtgggtgcgtgtgtgtgagagtgggagagcgcgggcaggaagggggtggggggaccccaaacaaaaccatctctgatttgcaaagatcagagcccgaggcttccacgcggcactctggcttccacacctcacattccctttccacctccgggaggggagagcgggttgctgcgggactcggccgcccccactccggggagctggggctggaagttgaggcccgctttgttcggctccgcgggccggagcccctcctccgccgccgcctcccgcccccgcggcccgcgctcgtggaggtggtggtgtctttgcgtttcttttcttcagtcgggtctccccactttcctctacaggaatgcggtccgtacagctggggctgtgggtgaggagcgggagcctagtgattgacagattccttcttcgttctttctttgccttcgggattagcatttttatcgagtatttttagactcggttgtgccagtctcccgccccctgagcatgcacgcactttggttgcagtgcaatgctctgacttccaaatgggagagacaagtggcggaaaatagggtcttctcccacctcccacccccccatcccgactcttttgcccttcttttggtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctatctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgggatttggttccagctctggttgttaattcttctgtattccttccgtgggggtggctagggtagagtgggtgagtatgctacttctctttctggggaggggtctgccaaacctaccttctccttatctgcctgggtgcattgaagacaagtgctttatgtattgaaacagaagaaaaaaagtggtatcaattgtaaaacaggcagctgtgaaaagtgtttcacagtttacaaagcactttcacatggttttctgaggtcctcaaaaaaagacagaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagcagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccactgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatcttagctcactgcaacctctgcctcccggttcaagcgattcttgtgcctcagcctcccgagtagctgggattacaggcgcccgccaccacgcccagctaatttttgtatttttagtagagacggggtttcaccatgttggtcaggctggtgttgaactcctgaccttgtgatctgcccgccttggcctgccaaagtgctgggattacaggcgtgagccaccgcgcctcaccgaatctgatcttttactgtagcctcctcttattatctccttgacttttgccagggtactctcactttgagaaaggaaaaagatcctagtctttaacatgccttttccagatttctggggatagacctattactaaggctgtagaggcctcccttttctcttggctgcacttcagagcaccatgcccgtgtggcccattggaagcaagcccccttccagctgctagggaggtggtccattatctctttgctcttgttaagtttgattaggggagttccacgtagggcctgagaagaggaggtgcctgcaggacaataggtagctgatgagggatctgactcagctgcagctgaacctaggcgccacttgacgttccctgggaacatttagaaccttggaacatgctgcttgcacctgggagtggaatgtttgcagacagcccctctgttgttacagggctggattttgttgatttattgatatttattggaccctcccatgtctgagtcaattttttaggtaccagaggaggatgcagagacacgtttgagaagctcccagcctgtgagaagcttacacatcagtaagggaaacatgaatagggcattatttgagtatctaactgctatctctttctcattcccagctaccagtagaaatatgagatctagtatggatgatttttgatgggggcgggcgttgatgtgccttttaaatattgtagaattcactatgttaggaaataaaataatgacaggcatctgtttttttctgaaaaaaacacaaaattcaggtcctgtacctgccattttaccacctgcaaggatttgggaatccatttaagtttcacagcttttatatctgcacctgtcaagtcaggatgagataagttctgtggaagtgttttgtgaaccagagaatttgacaggtatgttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgcagtatgatgttgggaactttttggtacatggggatagttccctataagaatgaggacgtctttatcctcttttactaaactgagtgctgctataaatatgttaccttgtaactggcactgaacagctagtgacttgggtgctatattttactccactgtaaagcattttctctttgaagtaaaaagtaagttagtactgcaaactgaaattcaggtttccttggtgggaacagggactttagatgtatcagctcagaatatgacagggagtgttaataaaaagtggacaacttggctgggcacggtggctcacacctgtaatcccaagcactttgggaggccgaggcaggcggatcacgaggtcaggagatcacaaccattctggctaacacggtgaaaccctgtctctactaaaaatacaaaaaaattagccgagcttggtggcaggcgcctgtagtcccagctactcgggaggctgaggcaagagaatggcgtgaacccaggaggcggagcttgcagtgagccgagatcgcgccactgcactccagcctgggcgacagagcgagactctgtctcaaaataaataaataaataaatgaaaagtggacaacttgcagatggttgttttgaaattcaaagcttcggtgtgacctagcttctcatttctctagttaacacttgctgagaataaatcctagacgcctgagtttctgaatgaacataggtgcttttagtggtatattttttaaaaagtctttgcaagggtgaagttttaaatgacaattttaataacagaaaaatatgaatacagtcgcatttaattctgatgagaaatgcaagaagttgatgaaattgaaagaatttgtttcaagcttatcacatcaggaatccaactaaatgagttaaaaaataaatattggtttaataatgtaaacatgtgattgctgtattattataatggaataaaattaacacgatttaatgaactgagcgaccattaatttttacttgttaatttattaggagattttaatgccatttgatgcacagtacagccattattctgcgtgagctccttaatgaaataaataagaccaagcagggcttgcttcaaattggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccccatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaaggcccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagcattttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttcgttgcctcttccttactctgtgagtctaaatcagtgaaatttaactacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgttaggcagcgtggatgttgcaagtttaaaccccaactaggaaatgaaaagtgagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagttctcctgcctcagcctcccatgtagctgggactacaggcgcccgccaccatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctcccagcccatgggaaggcagagtgaattactgcttgttgtgccaaccctttacattttgtgtgtggctgtttgtctctacccagacaggttcttcacatattacctggggagcaggagagggggaggacaggaagagcacagttgggcagaaagagcaaagcctctcaagtctgatgggtttgggtttgagtctgacagttattagctatgtggtgaccttgggtactttgcttcaacttattgagccccagtttctgcatctgtaaaatgaggatgaaactacctacttcatagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagcttgccgtgagccaagatcgcaccattgtactccagcctgggcaacagagtgagactctgtctcaaaaaaaaaaaaaatcaacgcaagtgagataagatgtatcaagtactttgccagtatcgatcataatacatagtagatgcttagtaaacgctcatttttcctttccaaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaacaattcatattcttaggcggttctgccctcccccatcaccttctctatcattattcttaaaaatttgtttggtcgactaaaaataatagtactaaaaacaaacttcgatgaatcaggtctcctggggcgggggatgggtaagatcctgaagcagaaacgcagtgactcacgcgcctgtcactgatagctgcccgtaagtgcatggaagtgcatgatgtttattgttgctggtgtttttttgaggcccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctcacgcttcaagagtcatgctttggccctccacctggctgtgctcctcttactggggcaaggagactgtagggccaagggacaggcccatctagagcaagcacttcctttttccagatcatgctcagaggcctgacccttccagttccctgcatcagtgtcttgagcctgtttccaagtcctgcgtgggcctcttccccaggtctgttttacttgagggcagactgtgttggccatggacagcatgtgtacctgtgggaccaatggctgggcaaggggtgcaggggcatgaaggaattggctagagcttggacttgtggcctggggactctacttgggtgtgcacaaggcctctgaaagttatgggtggtgctaggggtgggctgagatcttgggctgggtctctctgagcttccacattccattgtgaaaccaagaggtcagggaatcctaaactcaaacctggacttattaaagtattggtcaaggcaggatgatagaacgcattctgtgtaaccgtttgttaccttgatttgtctttaaatactacatatggtgtgtaggccttcctctgtatttttgctcttagggcaggcatttctgtatgtatgtatgtatgtacgtatgtatgtatgtatgtatttatttttgtagcatccgctcagttgcgtggccacaactgaatcccagtccaggtggcaccattatatgggtagcattttggagatgttcacaggaattgatttccctcaccctcaacccaggccagagtgaatttaatgcagatgagggagaaggtgctacatattatagctgctcattcaaaaagtggagcagagagctggaccactgaatgtgcctttgtttgctggaaatctttattaagtaccagagatatagagatgaagttgtgtctctgaactgctcagaggcaaaaaagggacaccagtaaccacagttatggtgggcctgtggaagagacactatagtgaaggtcaaacaaaatatttgggagcctagaggaagaacaggtctatttctggaggtatcagaaggcttcacagaggaggcaatactcaattggggccttgaaggatggataggagtgtaggagtggagtgggaggcagcacagagcacagaccagactgcggaagggcctgacgtctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgccggagttatccaggtcagagtcgtaatcccttacagtaccatgtggacagctttaggctatgtctggagcaggttgaagatagtgttttgttcactgtcaggagagaagacatgttgttcagccaggagggctcagggagcccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccaggctttccaattccagaccacactgcaatcagtggaaactacctaaattcagtactgcagacccatagcaggatgtatgtttattgaaaacagattatattccttaatgagagactaaaacagcatgtttaaatcagtattcttcattccttttatcattgagagattggttattatttacctcgcctttagagggtcagcttggtggtggtggtggtggtttaagttgctgggtttttaaaagattgagtttcatgtccaaggactgattctacttcatgggctgtttttgaaaacattgctagaaacctcttaactgaaggcaagaccaggggcagcctattgctgcggagtgccctgggttcaaatccctgctccccaacttactgcggtggtgactgtggacatgttgtttaacttatttgagcttccttttcctcatcagtaaaatgggaaaaacaatgacctccctcaaggagggatgttattgaagttatttacttaaatcagattagatttattttagattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggctattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcagcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagtcagcagtgttgactgttagcaaatcacctaagcccactcacatggggtgatcctggtacgtgttgcatggactgagtgtcaactgcatgctgagtgtatgccagagggggtgatctccttgatcttatttacttacctacagtactctgggtacttatgtatttatgtttacagaggaggaggctgaagcattgaggggtcagtggcagaacaggaatcttaactctggtctctggttcctagttctctgagctctaccccatagcccctcaagaaaggatggccattgttgtcctcatacaaaaagctatgacactgctatcattattctcatttggtaaatgacagaaacaaggttcagattacttaggtaagttgctttaagtctcaggctaagggctggagctggatttgccactgaagctctacaccttctagaatctagggtgactacataatttatcaaacaaaccaggatgtttccaagagtgaaaaggggcagcattattaattatggccactattaattacggtccttggccataaatcaggaccgtccaggcaaacctgggtaatagtcaccctgcctctggtcttgatacctgaccaaggtaatggagaattggatccgccagctcatgtgctgttgcttaagtggaagggaatgtgcaaattatgtcctgctattctaagtgaaaggacttgcccaaggtcatgcaacaagttggcaatgtaatattttaaaactggacgagatgttgaaaacatggtaaagttagcactagagcttaattaactggagtatgagttagggaacatttggctatgctgatgtctactactgaagggaaaggaggtggaggtcaaggtcaggtgtgtatggagcaggtgggggtggcagtggcagggcattcacgtggctctactatgtcggcaccatcatcaggccctgtccctttgaagtccgggagatgccactaggcccagtgcaacttggatgatatttaatggccaagagcagagacttctgggacctgacttttcctgctctccactttactttagctctgggcttcaaagggactattggctgggagtggtgaaagtttagtggataatcctgctgaagaattttggaaggccttgaggaaggaattaaaaataacagtaagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctgatactacagtgcccctgtcgttagcctttgtggctcagctgggtcttataaatagaacacgatgcatttccccttttgctaccccacagacacgcggaggcatgtgtgggggtggcatggacagagagtattcattacttatgctccagtgcatcagatagtcatcgtgggaactgagccctggtgtcatggggatgactaggccatcttgtgggtaaggctggaagcggcttttgagtctcctgagttacagctcttcttacccttgccagcctcccttccccagctgaggccctcagtccttcatgcctgtgtgccgcagtaagccagttggccccttccgtcgtgagtccatcccacattctgtatcggagcccagcattgctgtatcaggatgcttttggccaaaagtgacttgaaacccaacaaatagcttcaatcataagagggcttattacttccactaagaaggctagaagcaggaaagtcaggcatcagaaggtctcaggagccttacatctttcctcctggccatattctcttcaagcttgtctcctgttggtccaagggtggccacaactgttgcagatattaccgtctataaacgttgcatccaagggcagaaaagggctcctattccttgggggtctctttaggaagaaaaccttccctgggagcctcctggtatcttgttggtcagtattgtatcacatgcagtcaatgacagaaataatggaccctcagaagcctctcgaggtcaagggcccaggctattcctttgactcatcagggtgattagtatggaggtaggtgcttagtaaattttatttgggttagtgcaaaagtaatggcagtttttgccattgaaaataatggcaaaaactgccattacttaggcaccaacttactaattaatgtttgttggttgctggtttccttcgctaagtgagactcctgaacacttactgatgatgtcttgctgacttctgaggacatgatggtaagtctgccctcatggagcttgcagtcgaggtggagagatagtgctataattgtgtttggagtatctcctgagtagattgtggcagtctggtagctttggaagaggtgttaaattgaggcccaaggagacaaaaggacctgagaaacagagcagggggactctctgggcctctgaatgccatgcccagggccacacattttgtgatgcaagccaggttgtttcaggtttcaagcagttgcgatttctgtctccacccctccaccagtcttattttcctgttgacaaaatgataacaacttgccctagggtttgaagtgggggcagggcacagcgctgagagcctcctccctcaggggaaattttctaaagtttctcactgtgttctagcttcaaaaccatatgcagtttaattgcatgtttagtatctttgtgcatctctcttgttttgaatctgctggaaactttctctgaaagcatatatataggaagacataaaaattctataaatgtttagtggttaaaaacaaagtcctgtccaaattatataaagttttgccgtcgtcggacagaactttctgcagatagggaatacccttgagtcttcagtcgcaaagagctaatcactaacttcaagtgtgcaagtgccctttcattccaattcagagaaaacagagcctgtcccaaggcctcgtgttttgttttcctattgatctaggagctgggataacttggaaccccagggaacatctcagagttaattagttttttgaggtcttcttgtttttcttgcttgattaaaagagttacagtttttgctctgattgtttaaaaaaagaatctatcactgctactgatccaagaggtgagggttggcatggggtgggcactccagtaaatacgtaagttgtcttcctgccgtcttgtcctggtggagcagagagaggtgcctttgagcatgggcctggaaccaacagctactttcctggaaaattcttcagtttccagaagcagtggccaggtgagccggggcatgaaaccagacgaagttgccgcagtgcgaggctggttctgtttgcctcagttctgaagttaatggtccaaggtcaccactcatagagcgtcagcctgttggggagacggaggccctgacggccatgccagggtgcccccaaccctttgtttaaccacggctgtggaccagtggtctcagatgtttaccatcgcctgtttataagagggaagtgtggtcatatttctatctctcttgtgggctgcacggttgccttactggggttcatgtgggaagtggttaccgttaggaggaggatgaaataacagtactcacaaaaaggctttgatccagggatctttttaaatgtcatcttttggccactgtgtttttttatttttattttttgctatctgctttaacttcaacgatgagaaaatcaaaccatatgctggacatcattctgcccagctgggctgagtcagaattgcagttcaaactacttctgctctccctgggtttcgtgtgctttcaatgtggggatatctttcagatctgcagttctccagagctagggacccctcagctccagctgctctctggacaatacctgaacatccctacaatatctgaaattgaatgtttgccatttcttcttctttctcctcacacaacctactctgatgttcatgattactggagcccccaggttctaaaaagtgttgaattagcaagtgaacaaataaaatgagacccaaagaaactgtgatcttagcatcctgttttctgggtgaggttgagggtccttggcctctcttgctggtggagatgggctttatgactttggggaagtcaacttgacttcctgggtgttggtcttctcttctacaaaatgacaagcttgaagggagaatctgaaagaatctgtgtatccgttctcagattttctttttttttctttttttttttttttttttttttgagatggagtctcgctctgtcgcccaggctggagtgcagtgatgcgatctcggctcactgcaagctctgcctccggggttcatgctattctcctgcctcagcctcccgagtagctggcactacaggcgtctgccaccacgcctggctaattttttttttttgtatttttagtagagacggggtttctttgtgttagccaggatggtctccatctcctgacctcgtgatctgcctgcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaattgtattatcattgttgtttaattcatcacatatttactgagcttcttttgttggtggtggtgccatcagacacagtggtccaggagctgcaatgcgttgctgatgaggatggtcacacatagctctgccctcatggagcgtcccagggtgaaatgagacctcccctgagaaccgactcccagggtaggggaaatcagtctgcaggcaaagaggaattcaaatttagcctgaagcacaggttttctgtgcttctaggcaccggctgcattccaaccgtagtgccataaaaatacaggaaggaagggaaacgtgttcacaggttggttagagatgtggaaaccaacaatcagctctctcttatccgtaagaaactagaatctactgctggcttcagtccctcagacctgctgctcaacagagtgccctttcaaacctgggttagactctgtgctaatggcttttttcatgaacctcagacagccggaaagtatattctttgaggattatgatcgactaggatgctcgggaatctttaaagagaagcactatcttggctatatttgccctcagttgttttaaggccagtgaggagactgagcatttcagaggtgaagcatttagaggatggcctctgaaagcatacggctcagtaaacaactgacccatcctttgtcaccgtttttgtccagcggctgtcaccataggggctcctctggtgtggaggagagagaattagaggcagcaggcctgggttctaggtctgcctcattgtgaaccagcttcaggaccttgggtgagtcacttttctgccctggcccctggcttcctcttctataaactgaaggtgttggcttagcaggattttaaagtttcttccaccttaaaaactctgattcctgcacttgcattcaaagaaatgactctattactcatttgaatagtttcagaatcactgtatagtcaactctggactagaaatgggggcctgcagttgaggacaggatggaaagaggtttggggttcagggtgggctgtgagggctaggattcttgattcctcatgatttgcaattggttgttggtgttaccatggaaggttctcaaccatggctgcttttaaaaattttgatgctcagaccacccctggagaccagtgaatttcgaatttctacaggccggcctggggaaatccatgttttttaactttcctaggtgattccggtatgtggccgggattgagaatcacagccatagatgcttatgtaaagctgtgttcagtgttacaggcatctgttctgggtggaaagtgatagtggttggtcaaaaaaaaagtgtgcgcacacacacacacacacacacagagaacagctctaggttctggaagtgtgttgatttggtcaccacaagtgctggtggtgagtagttgccctgaggtttggagttccagttccctcctatctctgggtcagtggtttctcaacatctttgaagtagtgaaaccatctgtagttggttatttctggtcagaaactcacagtacaaagtggggggtggtgcaggggggtggagctggaatggattaaacaggcccttacaaatgcccacacttttttcatgaaactaagttagaggccttagccaactccagcataccttagtgtcagttctttggcattgccccggtggattctaggggctgtgaaggctataggggtgtgtgttactccctgctgctttggtgagagagtgtccctgtctttggctgagagcatcctgtcctgccacttcatcagcagtagcatctaaacagcccttgaagggaatcagtatctacagcctaagaaatctgatgggacacatctctctgcattaaaatattaacagaaaaggtcaaactgggaaggggcagctaagttggaatatctcattcaggtaaagggatgggcttgtggatccttaattggtgtgaaatgcgccctaggaggggagactatatcagtgctgaaagcccttgagggctttcacagatgaagggggatggtatgagaagctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcatatcttctccttttttttttttttttctgagacggagtttcgctcttgttgcccaggctggagttcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcctttctaacgtgatgtcagtgtctctgggaagcagccttagttggcacctcactggcagcaagaatgacttcatgttcttgctcccatgaaaattctctgctttcaggaatatactttcctctaggttttttctttgtctgcaagtgggggggtgttctttgccagatccctgctttgatgattaccatctgcccacctgagtttcctgcatagtttcagttggaaactcttttctctttggaccctaagataccgtgtaataggattgttcttggtttcagtaggcacctggcaccctctcagctgtggctgcatttcaggtatggatgggagtgattatctgtgcatcagaaaactcaagattgtcatgtgagcaagttgtgtgatcatcagtaaatgcagagctggctttgttaggccctggttgtggccaaggctttcctttcctggcgggtgattattccagatttcatggtcactagctgagtgtaatcaggagcagataagaaagccctgtatagagcaaagtatgcatttcttaaggtggtgggggaggtggcagaggcattatatagacgtgtgtgtttgtgcatgtgtttaaaaaaagacttatgttttctgggcagcagaacttaagtttccagtaaacatctcctccctttttactttaccttttaattttgtgtttatggtctctgtgctttgaaattgtttttgctgtgatgccagccctgcctgaaatgggtggagcaagccaagccctttggaagccatggtttagatcagagttcttgtactgacatggcccagctgattgacagctcagatgtgatcactccgtctcaactagaagaataaaaataaaaaccttgagctggagcggagaggggtcacacatttgttagtttatcccctactctcacctttatcgcaggaggagtgataaagtgctgctgtgtgtaattctggtctggggttggttttctgtagtcccaaacctgggactaattctccctggagcccgtggcccagaagatgggtgcacagtagggttacttgatgctaaacggctttcctgatagacttgggatctcactgttcttgtcttagctttacttgttgggttggaggaggtgaggtgggtgggcaggggcctagggaagcccactatagaaacactgggacagagaatccagcccaggctaggtgagagcatctgccagtgtgaaaacacgtggaagcgggggaggcaggcgagaaaagctgtgggagaaaacctcacaaatgcagcaaagctgcccagggcccaagcggtggggcggtagcgagggaaacacagtggtgtttggctgctgcttcacaccacttttaattcagcgctgctaggaaggctatttcagaatgctcccgagtgggagggggcagctgctctagggtgggaaggggatgctaaggccgggtgcggtggctcacgcctgtaatcccagcactttgggagccaaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagctgagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatgtacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgaatcacaccagtgggaaagtgcactgtatacttggtcatgtgcagagcaccttcccattggtttatctttacaactgccctgggtggagacacggcaaggtggtcctatccctattttgcaggtgatcaggcacaacttacagttagcgcaggaacagggactgaggccagccctcagttctttgacagagttctttgtctacactgtgttgcctcagaaaaaaatgcccatggggagtgtgtgtgcgtgggcatgtgtgctctcctcgtgtccctcagaaaagaatgaattcttttccaactgatgtcactgggaaagggggacaccactactttcctgcatactgcactttacagtttacaaagcactttcccacacgtcatttcgtttcatctccctgacagtccctggaagtgggtgctagtctggatgagcaggcgcagacttggagaggctgagggacttggcccagggcatatagctaggaagcggccaggcagtaagtgggtagcaccactgcatgttgggggtggggaagcatgagctggatggagcattcggtggtctaaccagtggccagcagtagtgttggggtttgctgccctcacctctgaagccacacaggctcctgcttcctgaggtcaccctctcctggagggctgcccccgcatgggagtgtggacaagtgtgcacgagggggaggcacacccaggccgagtggaacaccaccctaagggggtggtgacaggtggcactgggagtggctggagtcggggttcaccttactcagggtcagggcttcccattttgcaggactgagaggtggactctgaaggaatgcagtgcttagaatcttggtgcctctcctggggtggtgggaagagcagggagtctcgagtccgattttgccaaaaatcccaactttcctgctgagtagctcatgagacaggcatttcacctctctgaacttcaacttgggggtactcagatttccttcagaggctgtgaaagagtcccctgccacaagttactcctctgttcagaagtgacttgactgatcatctagcccaaccccatcattgacagctgggggaaactgagctcctgagcggggcagtgacttgcgcaagtcatttgttgggaagaatggggcaggatgatgatgatgtccacttcttggggacgatggggcagggtggtaaacacttctcaatgcttgcttatgggctctgatgtgaaccactcactataggctgaatcctggttttccaagtgtttagaggctgagctgttgtcccctgggattttggaaggtagactcacatttcactgaaagccctagatgcttctccttactgcagttcccctccccagcactcccatctccctgttttctggggatttaaatcagctttgacttgggtctgaaagtaacccgtgacagcagtaagcctctcgatctgttgtttgcagtgtttcagctaaaatattataaacagaccaccaaactgtgtttggtccaaggccaagcccctccctccctacttgaacacttgattacctgctgcagggttgcgtcttgagctccgaggaggaaactgtttatttcagggctgttagagtgcagtgcaggaatccaggagaatttattgtattgttaccatctggtttcatggagtctgtttcttttgattttaattgtgccctctggagagaaagatcctcgaaatggtggaaaaagaagataccaccttcctccctgccctgcccatgccctggcacacacattgctatggtgcatggtgggcatggctgaaccaagtccccttattctttgaacatctttgcgtattattcctgctcccccagccgtctccaggccccagtctcctctggagggatttcccagatggcttccaggccagagcctgacaggagagataggacctgcctccacggtaacaaatggctgaaggcggtttggggtgttgccagtagcctgcccttccgcagtggctaaggatccggtgttgcggtgatacatgatgtgacctcttcaaccagtgagtcactcacccccagataaccacccggtactttcaggggaaaccgttgtatcattgtggctgtggccatggtttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaatgggaaggaggaactacatcaggtatttagcacaaagggaatttaatacgggaccttggttacacaggtgataaagcagctgagaagccacaatgggaaggtgaggtgatccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccactgcttgctgtgagagcctcctattatttaaaccctgctggaggcctcctgatctggagcctggaaagtcagggctcagccccagggaggacacagcagagcacaggaagatgagggatggatcagagggcaaactggacttggaccagcacagggtgcaagcctgatgctctaattttatattttatcagcattttcttatatgtggctttcataattacacatattttatcaagtagatgaaccgcatttaaccattccccagctgttaggtgaacactttaaattactataaatcagcagttctcaaagtgtggccctgggccagcagcgtcagcatcaccagggaacttactaggaatgcagagtctcaggccccgcccccaggcctcttggatcagaaaccctgagggcggtcccagcagtctgaattttgtacactctccgagggctgctgatgtgcatttgagcttgacaatcatgattataggcaatgatgcaccgtgtggaagctgggggcaggatactgaggagggtgctgggggtaggagtggtggagggagtttgtccaggggaatgtggtgtagcggaaaaggcacaggactggtagggctgtgcccctttaggcccaagcctgcccttgctcttaacctcttaatgggtttcttctttcttctgttaaacagctaaaaatatcaaatcatggggttgctgtgacggttaaatgtaataacaggcacgatgttccatatatgttgggtcttctggagctttggggaaggaggtgtggcaataacagccagcttctgcatcatggaaaatggcccccatgcccatccctgagttgtgtggtctgaaaatcaatgatgaacacttaggaggctcgtagcctgctttgagtcaacaggaagactggacttgagagtttggaatctatagtctaacttcccttcctcaccctgtctttgtaaatggtgctcatctaaccctacagttactatcttttcactcatgtctagccacttgttagaggggaaggaaccctggtgtcaggacaggactcctggctccctgagcttgctgtgtattccggggcatatccttaacctctctgagatgtacttttcttatctgtaaaacctctatgttgatgcaaatcaggtgcgatgatggacgcaaaaactgccttgaacaccttagcgggcctgtgaatataaagccttcaggatccacacctctgccagggccgacaccagcctcgccacctcggtgagcctctcattccactgccagtgcaggggtgcataatcaggatttgccagtggaggtaggaagggtggctggattgtgactgtcacgctcctggcatcagatgatactggtagcaagctagggtcgtctgtgcactttgctctctctcagtcttcccagcagccctgtcaagcggggagtctagcaagaagtggccaaggcgcagatcatttaagaggaaggatgtgagcaaactggatcccaaggggacagacggaggcccactttgcctcagagtccagagagctgctgctgctaagaagggaaagaggaactgggtcggggtgcctgctgacttgcagcgctgtgttggcatgcgaggtagcactggttgggaggcggttacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttggcacgagacaatcttattcaaactctgctcaaaattgctaccctgaggagagggctgtgaccaggcaggacggggtgtgataacatggaacccagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttctctgagcctcagtttctccagcagtaaaatgttacctgtctgttagggttgtaagattgagtcaacatatgtacaaggcattgcttagtgtttaccaccttgctgtgagctggtaaatggttggttggtcccttcctctccccttggtgttaagcatatcaaaagatggctgcgtgctcacctcccctgctttactgggtggacaaaggagctgtcacacagtgtggcagccttagaaaggttaaagaaggccagtgaagtcttctggctcatctggtcctgaggtgggtgagcattaaacccagatcctttttgtgtttcagtattggatcctttggccgtcatatctgagacccagggcctcagagtgtggggtcctaacctaatttggctttgggtgaactggccagcaaatggaaggatggctgtggaagtgtgtcttgagcctgtccttacacaggtgtggctgtcatcaaggccatcttcatgggcacgtgacgagtacagtcacatagagttcatgctcaggagggccctatgcttggtttaatgctctgctgtcaccagcttgaaatccttttttttttgttattgttgcccaagctggagtgcaatggctcaatatcggctctctgtaacctctgcctgcgggttcaagtgattctcctgcttcagcctcccgagtagctgggattacaggcacccgccaccacacccagctaatttttgtatttcttttagtagacgtggggtttcaccatgttggcgaggctggtctcgaactcctgacctcaggtgatccagccttgggctcccaaagtgctgggattacaggtgtaaaccactgcatccggcccatcttgaaattcttaataattttctctttgacctagtgttttggagcatgagcatggatagaggagatgtgggcagcatgtgcccattgagccttctgccccattcacatgtagcatttgagcacagacttctgccggacctacaatgtgggggagttgagtgagagtcaaagtgagtgtgagatgtcacatctgcgactgagtagcaggggccctgacagtcctgatgctttccatctaactggaacttgtcttggttgtagaaagaaggcgatgacattctaagaaacatcaacgaccaaagaaccccatcatatcctttattactcacgtcacttccctgacaccaaccacttatattgaaaatgatgacggaagaaggaaaaggaaagatagggcacccatattgccttttcctttcagatcttccttactcctcaggcagcataaagagtgaggtagaatggacacatagcgagaagtgaagtaaaaacgattgagttagctttatggatgtttctctggttctggtacatcacaaaatgcacatccaagtcctaaaatacaattcatgtaatgttggtgattccacatactagttaaaggctttttatatttgcagttaaaactggcatcacacaatataaataggagtggtaaaattcatgctaattcatgtaatttaaaattttaatgttgctttacttagaataatattaaatagcaaattaaaaataccatgacacatcaagagagagactgtggaggaaagagaaaaagctttctattttagtaccatgattgatactttttttttttttgccttttgcacaaagggttccatattttcattttgcactgggccccacaaattatgcagccaaccctgactggcatcctggggctggaggtctcaggctggtcttgcacgtgcagcctctagatccctggtctgctcacattgtctcctgggttgcggagctaagaagcatcatataggcaagtgagcatgtgtgcttgctctgaagattccaagcttccaggtggtggtggctctgttgatagagataaaaagttgaggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttggatgagtcatttcttcatcaggcagtcctcagtcttttggttgcagtgtagttgttaaaaatgtgggtacttggaggctgaattcttgggtcaaatcttatctccatctctctgtcctttttttgtggttttttttgtttgtttgttttttgtttttgtaggggacaggttcttcctccaccactcaggctggaaggcagtggtatgatattggcacactgcagccttgacctcccagctcaagcgatcttcccacctcagcctcctgagtagcttgggactacaggcacacatctctatgctgggctaattttcatgttttttttgttgttgttttttgttgttgttttttgtagaaacagagtttcactatgttgccccaggctagtctcaaacttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagaaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcctgccttagaggatgagacccagctgagatgacatatggagaaatcgtttataaacttaagtactggtgttaggaagagctaacacggtgagtcttcagtgtttctttaagtgctgctcactactgtcctgagagactccaagaagcagttactttgtttgggcctcagttcatcatctgtgagatgagaggattgggctttgtgcctaaactgcccccccaccccaccacccaagacagattaaaaaagaaggaaggagggagggagggagggagggagggagagagagcgagcgagcaagcaagcaagcaagccagccagcaggatttggaatcgtcccctaattggaaccacaatcgcaggtttcagggactcaggaaagggtgcagcccagcttgtggttgagaaatgaatgtcagatgttaggaagaaaaaggcctatctcaacatagcaggggtttcttactgcccctgcctcctcagccccggtagcctgtcactccctggcgaacagcttggcagcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtgagtacccatgataattctcctttctgtggtgccgccctgttgattcatgtgtcagccttagagaaagtggctgtgacttctgcattcctgggaatacactgacatgagaagaagtagccgctcttgttcaaagtcacagggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattgtgcaaattgaattgtgttttaagactactgggaaaaccatttaaaggaatcctattgtaagtcattttgaaaaatggagaattacaccacctccccaaggattttctgttttggtaaatttcatgtggcaagattacttgaagaagggttccagtgttttgctagcttataatggttactgcataaggaaggtttactcgccagaggtccgcacacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccataccttacatagattatcttatttaattgttgctaataatagtactacagtctgtgaatgatttacttagcaattaattcaaaagcatattccactctacaatggaatattttttgagccaagaaatgaagtacgtggccgggcgcagtggcttgcgcctgtaatcccagcactttgggagaccaaggtgggtgggtcatttgaggtcaggagttcaagaccatcctgaccaacatggtgaaaccccatctctactaaaaatacaaaattagccgggcatggtgccacatgcctgtaatcccagctacttgggaggctgaggcaggagaattgcttgaacccaggaggcagaggttgcagtgagccgagatcgcacccttgcactccagcctgggcaacaagagcgaaactccatctaaaaaaaaaaaaaaaaaaaaggaatgaagtatgtgccacaacatgggtgaatcttgaaaacattgtgctgagttgaagaattcagacatcaaaagccacatatcacatgattgcattcccatgcagtatccccataggcaaattcacagagacagaaagcagattagtagttgccagggatggaggagaggggaatggggagtgactgcttcatggatacagggtttccttgaggggtgttctggaacaaaatagttgtggtggttgtacaatattgtgaatgaactcaatgccaccaaattatacacattaaaatggctaacatggtagatttttgctgcatgtattaatatattaatgtattaataaatgtattaattacaatattaatatattgtgatatactgtgatatattgtgataaatatatcaatatattgtgataaacatataaattgattttaatatatattaaaatcaaatgtattcctctaatggtgtccatgtcactgacttagtttctgatatgtttgtattgggtaggaaagaaaggaatgggacatttacgtgtacactgaggcagaagaaagaatgggactttccaatccaggctctacctttatgaggaaccagagacccagagagtgctagtgacttgctcaagggcacagagcagcgtaccagagttgagctttggcttctagcctcctcactttctattggggaagtcacagtggaaaagggggttttggctcctttatgtctttgggtatgttctgggtcactgaggatcagctctattccacctggcattttgtgctttccttgggtgctcaggaaactgtctgtctcaccctgaggtgaggctcaggaggctctggggctttgtagtagaaatagaaatatcccaagtcctgggttgtgtccttgtggatgtgtctagaacaattcctgttgtgctactcgctttgggcagttagcgaaagggactaattgtgtgcaaatacatacgtttggtgtttgttgggagacttgccatgtgacactgcttcttcttttcttctctttttgactatgaacacctgacactacaggaaataagaaactttccagtacctaatttatgcttactctactttcaaaccctgttggccccagcacagggtaaatgaaactgtagcttatagtaatatttacgtatgggagtcaatgagctgtttaaatacttggatgtcagaaaaaggtttcaaatttagcaagccccctgactctcccaccctctggcatgtactgggtaggcctgcctgctctctgaggtcgagctcttgtatcctgtcctggtcggtgccagtatagcaatgatgatgacagtgatgatgatgccactggaacaggctgagctgtaattgaattaaatatctgtgtaatccctaggagaagctgaataaggtttgaggatcttggaagttcagttatactctcagtaactgaggtgagatccgtaggcaaggaatgacaagatcgagattgattagctacatgaccttaggaaagtgacctaaaggttgttcacattcagagtcctcatctttgaatgtgaacgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactggtttgtgttgggagttgtacttggcacagctgaatttgcctttgtctttaggagagccttagctgtgggaagcagggcttggaatgcgctgatatttatttcttccatcaaattggattatgaggcacctgatctgtttaaggctgtgtgagtagaaccaggtcctgccttccagaagttcatggttaaattgtgttttcatgggtcacctggaaggcgagcttgttgagaatgaggataattgacccagtgaatccttcctgcctcgaggcccaccatgttattcagatcagtcttgggggaaatgctgtgaaagtgtgtgtgtgtgtgtgtgtgtgtgtgtgcggtgtgtgtgtgcatgctcgcgtgcatgagtttgtgttgagagaaagaaaaaagccaggagagtaggatgagtcagatttaaccactgttttttcccttttgaaacttgttatgttcatacacatacagcagtcatgcacttgctcagaaatgtgtgaaaaccacttaaaatgtgtgaaatgcagccctttagaaagtgtgccttccaccacattcttttgagcagtggagtggatttgtgagtgttcatatctgtcctcatctgtgggaattgtatgtccaaggtgctaattcagggccatactgggatgacgtgtgtgtatagacttgtcctgggtgagatgggagcaagaccgtccaatgtatgatggggaattctgttaaacaggtagaattctgaacctcttggtggtcctggctggtcagttgcagggagtgacgttgaatggactgggaagatctggatataccatgtttctgtaggcatgatacgtggtcccttagcttggtatttaaagttctttggaagtgaccgctttctggatttacctctgtgcagcccctctgctcctcccaggtgaggctcatcatagctcctcttcaatgtgctttgtccacaactgctgccatgttttagctccccattacgtttcctgggatgctctcctagactcctctgtacctttcttctttcaaacccaaaacaggtcccatctccttagtcttaactgtctatgaatggtctgttgcctcacttcccagctctggtatgtagtacgtgctcagtacacatttttgaatgcattaatttggctcttttctgtgaaggcagcttgtctgtgtgtcattcatctgcccaaatttgattgtcaacttccttcgtatggagctgtactgctctttttgttgtttttcttaactccttgcccctgcctcccatcaccccagtggaagagttatagtcaaggtagtgtagtcaaggtcgtgcaaaagctacacacttgaacctgttccgtgtggtttcacacaaggcacatggcctccttgggactcacttcacatcactcgacaaggggatagcaggacccaccttgactgtattgaagactgcatgatgatcaggagagagtgagggatgagaaagagtttggaaaacagcagaacacgatgcaaacatgagttattcatggttttgtgtccaggctaactgtgccctgacattaaggctgggtgggtctggcccagggcttctggggtaggcgctgtgctggtgtgtgctactgacctggagtccaggatccctgagtcccactcaccctccctgggctgcagtttcctcagcccagctaccctttccagctgtgactgctggttgtggagctgaatgtgtgtggggtgtgggcctgtgtgtggactccccacccctgtgcggttttcctaagcacacagcacaacaaggagctggaacagagctgcaacaatgaggagggtttcctccaactgtcagtgcttctggatccaccgtttcggctttgacattaccgtgagtgaccaccctggacctctttctttgtgccaaactcgttgctggattgccataaacacttacttggattgattagagaggctatttgccgtattgaaggtggcagaattatttcaccttttccagaggtgttgacgttcaagggtagttggtggtgactgtacagaagggagacaggaagcctggaggaaggaaaggggtgcgtagccgagaaagtgcacaacgggccctatttttaaaagtgcctgcctctgctggttttgttgtggcagcgctcaaaggcaggaagacagataagatcggatttcaggattttcgtctgccccccatctccgcccccaacttttgacaaccaagaacttttccccaccaggagtgggtatatttcaacttctgtaatccctgcgtctcgcacaatgcttggtattacaaggtgctcactgagtgtttgaatgaatgaatgccttcccagttctcatcacagctatagggtgtcactgtatacatcaagtcatggttagccgcaggtttgattggggaagagacactaatcaatgtatctgattctagaagaagatggagcttctaggaagggcctgccctcaggctgtcctctgtgttccccggcattctgcattttgcagtcacccctcattatccctgagtccaggaacacctgagattggaaaggattccagccccatagggcctttatcgtggcccccagtaagtgataaatattcgtactaatttggggcagtgtcctttttccagctgttttcccatgagtgccctctgttccgtcaggtggccgaagacggataactttggcaaagggcttggcacaaatggccaagtttacactggatcactatactccgtgttatcttgtttccccgatggtcattgccacacaagaaagtacttcctctgtgggctttgcccaccctcttctcttgacagagacctctgggcctagataaatgtgtaaactgcattgcaggaatgaagccgtttccattaagaactggggtctatgtcctgggatccagttcttctcccccttttagtactgaaagctgcttcccatctgaaagctgtctggggacagacaccgtgcagctgcgtgcagacttctttcagagtttgatcttgcaggcttcccagtggctctcctcttccttgtctgcttcctgggggtctctcagtatcaaagccacctgtggctccatctcacctccctgaacaggaggcactgtttgtcaggaggccttgccacctttggccctttctttccaaagaaagatccctggcctggagtttttgtctcagctctgttgtgtgaccttaggcaagtcagttgacttctctgagcctcagtttactccttagtaaacaaaaaggttggatgaggcgctctccaaagttcttgccctctgtgtccttcctctgcgttctacagggagggagtagctgcctctgtttggtggtggggactcaggcaggatgggtagggaggggtaggggaacaagatcatggcgcacctccacggccacagtggaaaccttgaaccttgagctgtatgcggtgagtccaggatgctgagaagatgccgggctgttgggtaagcagagcccctacgggaagcaaagagtattattcagccctgtggaatgctgaggcagggctgagcttgggcagggtggctgagagaattgtggctctagctgtgggcagaaattcatggccttgaagaatggctactgtatataccagtgataaatattagtcactctggcagcagaatgagtttcctgtgctgcatttttggcacttccagaaaagggaaagcctttctctctgacagggcacaggagggagaaacaggaatgtgtctcttaccctgatgccctggctggagatcccgtggggttttcaacctgcctgaagcaacgcagggcctgctaatgcctcctgttgccctaggtcaggccagggcccattgttgacatctgtgctgtgctgcctctgaaggtcttgcttgagcatgtcctgaatggaaggcttcatctgcattcattccccggccctccctgccgtctgcacagcctcctccaggcctccccttcccagtgaaaagcaccaccatccagacctcaggaagcaatcattttagcctcttctccttctccctcaccatccaggacatcactgagccctgtcagttctgcccccagaatatctaagttcatccaatgccccatttccactgctgcttcctcacccaaatcaggatgtttctggccccgtctccctcctacctggtctccctgcctgtaccctcctctccactgggcccattctccaccggcagccagcatgatctctaagaaatgtacatctgtcatctgtcatatctgctgaaaattgttcagggcttcctgctgccttgagaatgagggtctgaatcccaaacaagggttcaaatctcaacctctcaggcctaccctgaccttacgtatctttcctcagggcctgtgcacatgctgttccttcttcctggaatgcttgtccccatagttttcagctggcgaatgtgagtcaggtctccccttaaatgtcatctaagagagccctttctaattcctccccttcatcttaactctatccccaatacactctctcacagagactgttcttttccttctgagaccctactccagcttgtagttctaaatctgtgattatgcactgtctgtcttcctcttgaggtcaggggccatttcttttgttctctgctatgctcaggacccagatcaaaggagctcagtaactatttacaggcgtacatcatatgtggaggacacttatgctgtgatggccccacacacagcttcctttggggtctgtcccctgctctccgttacccgcgtggtagccactgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaaaaaaaaaaaagattttaatgagtcatgctttaactgaagattttagtgtaatcagtcattgggccttggatgccaaaggaatgacaaatggtgggaatttcaggcacagtgactgtgatagccccaaggaaaccaagagagaagtagctttatctgggtggaggggagtgggcctttcagagcctcgaaatcttcccacctgctgcgccactcccaccacataagcaccccacccttcttcccagggtgagatttctcagctctgctttctggggtgccagacaaggggagagccttgttgccatgccctcctgccctcctgccctcctgatgcagtctgtggtcacctgcaggcagagacagatgaagtccgtcattcggctgcgagtaatttctgatgggagaggggcttcccccggcccttcccgcctctctgagccttgccacggtcacttggtttgcccagcctaagtcactgcctgtcgctgtggttattgcatggacagggcctccctctgtccctccacttcccttccctgccccatactgttgccctcacccaccccaaagcctcacccttcccttccatagggatatggcctgatagaggaggagccatttgattttgactattgttgaaattgagtggggaattttgggtttgttttaggttttggaagggaggattatctgaggcttgaggcttctgtgatactgacatctggtgtggaaagtcatcctccctcacctaggtgactgggcctccaggtcatctccccgagcagcctccctggatctgctctcctctcccccccacccccccaccacctcccgcgctgtgcccagggtgatctttctaaaggacagatcttgcttcagcacctccctggttagaacccttccgtccagtggttcctagtgcttcggggataactcgccttgtcccttggggtctgcacagtgtcctccatctcctctcacttggccttgccctcgggggctccggtaagaagctttccaacctggcagctgcagactctgtgcggttgtattattgctgtaaatgggcagggattacgcatttgtggagtgactgatttcaagtacaactgccaccatgggagaggtctgtgaaaatcactggaattgaaaatgaccatgctttgcccaaaaaggttgagaatccccactctgatgatactagaagcctgcttgcctccccaccctgtgccaagccatttcttgcctccttgctttgcccataccagcctggaatgtcccaagcctattcaacttacttcctccaaaacgtagtcccatcttgatctccaggaagcagccttcagatgccccctcctcctggccactgcaaatgtgtccccccagctgctgagcatgcctaggtctgacacacaccacgatatgttgaaatcattggtttctgggttattcttctcacagtcccaggcagtgagccctcaaggacaggggctccatgggactggtctctgggtcggaggccaggacccaggtcactaagggcatgtcactcatctggaccacagctccctgccttgtggtgtggactctgttctctgcactgggctcgttctaaaacggagcatttggtccttgcagcctgccttgtggtttatgacttagtagattgaaaatgacagttgtgctctattttcatttggaaagaaaaaaaaaagtggaaaaccagagattgcactgatctggaggtagagagaaaactgtggagatcaaagaagatattatgtattatgaatgttacacagatcaaggcatgtttgaaataggcttaattttcctcaagttggcttttgtctcacaattgagttcttgttgacgaagaccagttattattcgtcttcgtgtctctggagtctagcacctagcacggtgcctgataaagcatggtcacttcacaaatacttgtcgaagaacgcatgggatgaatatgcatttgggtatttttaatgcttgatgattagaacattctcatggcttgttaacttgtaagacataattttcattgtaagttctttgtgtgtgcaaatgctttttgcgtggaatgcttgccatgcactgaaaaatgctttgtgatagcagttttgaaaaattgagtcattttgccctgattgaagctgggtgaccttgtgcaagtcactttaaccctctgggacttgtggccctcatctgtaaaatgggtagaaggtcagagtggacctcgtggcctgagaggctagtaccccatgctgcatgtaagtcttacatcctcctctttggtgattggatactgaccctctccccaggggttcctgcacagagctggaattctctctggtgtctttgcattccagtgggtggaatgccttgtttctcagtagcaatgagaaatgttaatgtgaggttatgaaagcaagccaagagccatggaataattaaaacacacacgcacacaaagaaggaaaagcgagagggggaaacacacttaatggacaagggatgagtaaaacccaatggactgagaaaaccccagagctgaacttcacatgaccccgcgtgctgcctgcagttgcgacacccgcgtgccccttacgctccgccggcctctcagtgatgtcagtgggccatgggccccacaggaagcaggggctgccatcagcctggtggagcgtgccagcccgctcctcctccacggcccacttcccacccacccgggtctccagataacatgaagccatagctcccaggctcgtcagcgggggaaaccaactcagtgcttctcagaaaatagaaccccagcccattagtgatgtccacgcaggcaagagatgaccaagaagaatgtttgccttttaggagttctctgcctgaaaccagcaggtttcctttagggatagggtgactgtgcttgctgaacacctctaggtcgtcagtgaatgaaataattcattctgtgcttgagtgtctaagacccagggggtttaggaataattaggatactggctgtacccttggagttctgtgctgcttgggggatacgactcaaactcacagacatctgtggctcaaatcaaggcatatagatgcagtgactcttggaacattcgagggagaatcaccacctctgctggtggaggaaaggccaggaactgcccacctagttttcccatgaccccagcctgtagcgggatatgtcagaagatttggatttagaggaacttgggtttgacaaaatagaagtgtatgtatataaacagagttgggagtgatgggggataggatgctgacagcaccttggtagtccctccccctacgtgacagtattgacttcatagtgttgttgtgaggcttgaagaagatacaagagggaagaggagcgttccttgccgtgcagatgcaaatgctcattgttacttgttctgcctctctgtgtctgtgacatccagccctgtgtgggctaccctggttgcaaagtgggcctcctgccgttgagcagctatggtccagtgggcaggtacaccacagtcatggaagcctagttaaatcattacataatagttagctctgtatgaccaatcttttctttaaagaaattcttccttttggaataatcgtagatacacagaaaaactgtacacagataatacagaaagttccagtgtacccctgacccagatgtccgtaatgttaacatcttgtattaccatggtacacatgtcaaaactcagaaacaacattggtacattactagtaacacaagtccagactttattcagtaaaccttttgaaaaataatagctttattggcatataattcatacaccataaatctgctcttttaagggatatgatttagtggtttttagtgtattaatggagttgtacaaccatcatcactatctaattttagaacattttcaacaccacaaaaagaaacctcatacccattaacagtcacttcctgcccatcccccttagccctggcaacttagtctactttctggttctctggatttgcctcttttggacatttcatgtagatgaaatcatacaatttgtggacttttgtgtttgacttctttcacttaacatattttcagggttcatccatttgtagcatgtgtcagtacttcattcctttttatggccaaatagtattccagtgtatggatataccacattttgtttgtcctttcttcagttgatagacatttgggttgttttcacttcttggctattgtaaataatgctgctacgaatatttgtgtacaagctttttttgtggaaatgtgttttcatttatcttgagtagatacctagaagtagaattatggggtcatttggtagctttgtttacctttttgagaaactgccaaattgttttccaaagtggttgtgtggttgtaccattttacagtctcaccaccaatgtatgagggttccagttctccccatccttgtcaacacttgttattgtctgttttattttagccattctagtggatgtgaggtggtatctcattatagttttgatttgcatttccctattggctaatgatattgatcatctctccttgtgctttttggcatttgtgttttttgtttgtttgtttttgagattgagtcttgctgggatgtccaggctggagtgcaatggtgccatctcggctcactgcagcctctgcttcctgggttcaagtgattctcctgcctcagcctcctgagtcactgggattacgggtgtgtgccaccacacctggctaatttttgtatttttagtagagacagggtttcaccatgatggccagcttggtcttgaactcctgacctcagatgatccacctgcctcagcctcccaaagtgttgggattacgggcatagccaccgcacctggccttccatttgtatatcttgtttggaggaacatctacaaatcctttagccatttctttttttttctttccttttttttttttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtattttttttttttttttagtagagatgaggtttcaccgtgttagccaggatggtctcgatctcttgacctcgtgatccacccatgtgggcctcccaaagtgctgggattacaggcataagccactgcgcccggccttaaaatatatttttcaaaatctacattgttcaaaaaaagaatctgtggtaactctcagaaatccaataattacaatagtaaatacaagtaaagatagacaaggaaattaggggagaagacaagaaaataggaaaataagatgacataagagttaatgttagtacaacaactaatatgttgtaaggtttgtgagattgttggaagtagcctgcacatttggccttgagctttctagcagccaagggtaaaatggaaatgtgactaatgacaagattaacacagatgtctgaaagattgtttaaaaaaatgtccccacctccaatattttcagggactgaaatataagcatatttctcccatagatcctaggaacctgagcttctcacgcacaggatcatttcatttgtgttagttctttccctttagacgaatagctctttgaggacagtaactgtgtcttatttccctcacatctccctgtagtgcttaggacaaagcatgggagatgcttacaaaatcttgattgaattctttttcaaattgggaatgtttattacattctttggcagcatttctgccaccaggttgaggttagttgggaccaatttggcggtggagaagtggcaggggctgccctcctggatgcattttagaagtgttttcttgcatcatgcttcctgagtgctggctaagcagtggaaacattgggcaggtggggttgtgtgcccttgccctgagagatggccatcactttggagtgaaggtaagcagcattgcttcactcatgtggaacccacccgccttcccacctcctcagcgctggagggtcctctctctcgcccactccctctgacatgcctctgagactgcctgcccgatggaaatatccagcatgtatgagggaggtcctggccaaaactgaacagcttctcatggaattgggcccctcatcacctacggttatgtgtggcgcacagatggccactctgcaaagaggcccacccagatagctccctcaccgggggcaaggaacaagccaccttcaactgattacatgtcatattgggtggacctcttcgtcccacacccaataaagggctttaccatttttcagtagcatcctttcttaagagaaacaaaaaatagatttgaataccagtctttaaaggggtagttgtcattacttcgcagttgacagatggggaaatggaggttcagggtgcgttacctgcctgctctaagtcatatggtgagtgggttgcgaagacctgactccaacccagagaatcttgactttgacttcatcctcccctccttccacctgccagtacccagtctttatctaaatttagggggcttgagaggccattctttctattttgggtaccttcaaacaggtaagcacagttttctttgaagttacctctgcctccatgtgggagagtatcaacaaacagttcccccttccccctccaaaagcactctctgcacagtcacccctaggccaggagcagccttgtaatatgccacacatgttgttactgcctgtggcttttcacacctcctgtctcaaatattggagcttttttggctacagccctgtgatgaaggcagtgtgggtgctgttgaccctatcttacccatatggacactacatcatctagggtcaccctgttggttgggatctggagtaagcccagaggccaggattctgacttctggtccagtgctctgccctaggccttgagcaaatgtgtatcaagttgcactgacaatctttgaattcctggaactcatgccatgagcacttccaggagcaccttagtgcttcattacaaagatgatgagacgtaggaaagtcttttttttttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccctttggggcgcttgggtcctctcgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagcaaggggtggtggtctgggaaggttcccccaaggaaaagacattggagccaagaccaaagggtgggtaggagtaatcagaagagcatgtctctcatctctggacttctgtagagagacttctgtaaccactgtaccctctggaagtgggtacagaagtccagagatgagagagatgtttaacaacagagagaaatccacccgaaggactttttacatctctctaacatctcctgttcagtttatctcagctggcctttgctgagcaccagttagttgccttgtgcatccttgggtgatggattatggagatggcagtggttgacactgtctgagagcagctcccagataaaccagcgcactgtggttgatgggctgcctccaggtagagagtgaggccctccaagcacatcctggccatccacatcttcacatttgcagtgcctagcacacagtggacaaaagggatatactggacacgttgtcctaggatgcagattcctaccaggccttcaaggcttgtagaaatcttccctaaaactgatcatgtggcctccggtaaggaatctaagcttttgaatcttggatccatctcgggcacagggataacggtggcgcccatctcacggggtgtgtggacgttgtctcaataatgactgacgtgctgagcaagtacctggctggagaagcgtgtggtaaaggggagcagctgtgattattatgggtatcattcctagtggttctgcaattagtcttgacagtaagtgctgcaggacttcagacaaggagaggctacaggtgtggaagtgctcctcaaagcctgtgggacctaaatgggcacagtgaaggagagtcttaggtggaagcaagaaaactgagcatcaggaagggagcaagacccttggtgatgggggtatctgttctgcatggaggatagatgacttctcagccattgggaaaccagctaaccagctttctgcttgatggttgtagtaaaatcccatgattagtgacaatggcatgccaggtttgaagagcaaaggtcaggaggtgagaaagcagataaatgcaatgtttatcttgaaagaagttgtcaactacttggaaatccccaagcttacttcctccaggaagccattctggactacttcacccagttctcatagctcccgggccctccatcttcccagcactgaaacacacactgaaaagggcatttttctaaatatgtctctgcctccccttgtggagggatgtggctccttgagatctggggtcacggctggcgtgtttcgtggagtagctagaaagagtaataatcctttttgaatgcacagcatttacagaggcctcacaggctgaaaatggtaattaggatacacaattgggtcttttgacctcaaatccaggcattttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggcgactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtggctcatgcctgtaatcccagcactttgggaggccgaggcgggtggatcacctgaggtcaggagttcaagaccagcctggccaacgtggcaaaaccccgtctctgcccaaaatacaaaaattagccgggcgtggtgacgggtgcctgtaatcccagctactcaggaggctaagacaggagaattgcttgaaccttggaggtggaggttgcagtgggctgagatcgcaccgttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagtaagatcaggactggggccagcagacttgggtccaaaggtgtgtcatttttataccagactagaatcgggtgaggggagatgtaaagagatcactattgtcacggaaggcgctggaaggagctctgcttagaaaaaatgcctttctctaggaggttttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatgagaaggtccagacctgcacctgaagaacagccccatttagggaatgcagggagagacagaggaaaagcaagatggtgcacagtgacattgaaggtgagtgacgagaccctgcagcaagaggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccattgcagggaggcccatagtcaatgggaggtgggcagtagacacagagagctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttctgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgttgcccaggctggtctcaaactcctgagctcaagcgatctgcccaccttggcctcccaaagtgctgggattaaaggcgtgagccactgtccctggccaagactctgggtttagtaagcctcttgcaactcactaggagtggatttctaggacctccccactttcttgcttgttgtttcttttgctagccgtaagtccctggagtacactgggtactttatgggaaaaagaggaacagtgtgggacagactttgccctgagctgcttaacgtgatgtggggaacagaggtgataagagcctgtggcagctcaggcagccctgccatgacctggagttggggaggggtatcaaggataacaagtcttatacacatgccatgctgtttctttggatcaatagatggataatttttaaaaccccctgtatgtatcaaactcactttggagatgtaaggcatggcctctgtcctggtgacagtatctgagtgggaggcctggtaaaatgtctgtgtttaggatgatgaacgccataatctaagactgctaagtgctgtggggtggtctagaagggcagatgggctagctgcgaggagggcagaggcactgtgcaatggtgttgcctgggaacactccgtggagagtgtgggaatctcaccctggccctaccaggtaagaaattgggcctgggaaattgggaagggaatttttcaagcttcatggctgctccaggacttgaactaagactttcctttagagcaagcttgtccaccctctggcccgtgggccgcatgtagcccaggagagctttgaatgcagcccaacacaaattcataaactttctgaaaacattgtaagattttttttttgcgattattttttagctcatcagctatcgttagttagcgtattttatgtgtggcccaagatgacgactcttccatcgtggcccagggaagccaaaacaccggacacccctgcttagagaaagtgcgttttctgttataaaaggaccttgaatccccatctcatatgttgggactttgtcttgcatgttttcaggcagggcatgattgtatctgtaacataataatatgtaagaatgtgtacttcttagcctttgcagagaggcgggaggcctgtttcctgcagcccccgccctgtcctggctgaggggtgggaggcagcttgctggccagccccgctgagtcaccctccggcgtggagcccggtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgagaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgcctccatttcttgatatgaggaaattttgcttaaaaaaaaatctctactgataggacctctgcatattcatgcatgtttttcctccagaactttgtgtcccaccactgtgctaggcagtttacaaatgccatctgatttcattcctgccacttcagtctaaggctatattgtccgatacctatccaccaccctcatgtggctatttaaatgttgggtcattaaaattaaatacaattacaaatgctgtccctcagtcacaccagccgcatttcaagtgcacgggtaggctagtggccatcagatcagctcatatagagcagcacgttttcatcaccaccaaaaattctattgggtagcactggtctaaggtccggacatatgtccccattttgtagatgaggaagctgagtcctacagaggttaagttgaccacttagaagaatgaacagatgaaaccttttcattttacacatgaggaaactgaaggttatactcccctttccttcttagaaaagagaaattgatctgtaggcttcagggactcttcagttagcctgggggtactgtgcgggtcagctcttttgctgttccccccagaccctgtcagctgtgggtggtggctggtttctcttggtttcctcaccagagtttgggaatgagcaagtcaggactgctttccgtacggtaatcctttggcccatttcctatcgggggatttatggagctggtgatctcttgggttttttggccatttgttagagccaaaagaggtcacaggaaatgatatactagtttcattgcccaaaatactgaggtccagagaggtgaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaagtcctcagtttcttcatctgtaaaacagggataaaatatctcagtgaatttgttttaaatacttgcgtccgggcatggtggctcatgcctgtaatcccagtactttgggaggctgaggtgggaggatcgcttgaggccagaagtttgagaccagactggccagcataacaagaacataacaagatctcatctctacaaaaaattaaaaatattagctgggcatggtggtgtgagcctgtggtctcagctactcgggaggctgcagtgtaaggttgcttgagccaggagttaaagtctgcagtgaactcgccactgtactctagcctgggcaacagagtgagaccctgtctcaaaaaaaaaaaaaaaaaaaaaatcagccaggcgcagtggctcacacctgtaatcccagcactttgggaggccgaggcgggtggatcacctgaggtcaggagtttgagaccagcctagctaaaacatggtgaaattccgtttctactgaaaatacaaaaaattagtcaggtgtggtggcacacgcccgtaatcccagctactcgggaggctaaggcaggagaatcgcttgaacccaggaggaggagtttgcagtgagccaagattgcgccatcgcactccagcttgggcaacaagagcaaaactccgtctcaaaaaaaaggaaaaaagaattctaacatgtttgagattgactgcaattcctagcatattacaagtgttagtaaatagtagccattaatattatgagcttatcatcaccttcagccagcattctaattttacagtatagaatccagtacataggaggcactcagatagacgggatgccccaaaattgggagacggacaaacttattttgaaatagtctttttttgacatttccaaagaatatactcaatgtttttctgcaaccctttgccttctttttaggtgaaggacctctacatttaaagcagtgggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgatctcctgattagctgggactacagaagcaggccaccacgtctggctaatttttgtatttttctgttgagaagaggtcttgctatgatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctcactgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcatttaaggcccatcttcaccccataaatgccagctccccaaggacagagccctttcctgtcttgtccacaccatgtcccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacaaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacgggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtagccttggccgagtccctcaacctttttgcctcagtttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggttggtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtatatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcctacaccaggggtccccaaccccggggccgtggactgataccggtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccatgctgggaatgctaagtacttctcaagcctccaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattagcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttttaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcgagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctcccgactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgcctgttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttctcctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctccgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatctgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatgtgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttacgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccagcttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcaccctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcagccaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggcctggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaaataacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtataatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcctacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccccagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgagaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagcatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttactcccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccatgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatctgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgcgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggcggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcaggggttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaataaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcttgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggatttttttttttttaagtttccaaagcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcaccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctcaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacaatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttcttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtggagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaactagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcagacttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcct

SEQ ID NO: 13502 - DNA, 88758 bp, Human
ctgtggggaaccaaagagtgattatatatatcaaagagtgattatatatatatatatatatatatatatgtgtgtgtgtgtgtgtgtgtgtgtgtgtgtgtgtgtgtgtgtgtattttttttttttccttcagtaaagcaacagagaggttactgggtcgggggattgcgatgtctttccccgctgtcctgactccaaaagtggcggcccatgctgtccttagcgctctccagggaaacgactcgggtctgcaggtgctggcccaagcgggctgtgccgctgggaggcgagggggccgaggcagccctcgggaccccaccactccacgaggccatgtccctggccaatgacacgctcccgcgccgggtggctaggtggggggtggggggtggggaagacttcgtgaaccgctgctgccgctctcctgtgtgcccatggccccctccccttctgctccccactctctgcccaatctgcctgaagctgtcagcctgccatctctggctgaatcccgttttcctcctccaaccccgagtccctcaaactctccacccgccagggctgcttgcgctcttggggagcggggctagaaggacccaagaagccgcgtttatcctcccatcccccgccaaaacccgccggcggctccgcccccgccccctccctggcggctcaggccgcccctcccgggctccctccgcgtgcgccctgcgccgcgctgggtctgcagcgggagctgccacagcagcctcgccagctggctggggaccaggcgggaggtggcgcgccctggaggctgcgggagggagggagggagggaggcccggcctcggcgtagcccggcccccgctccccgaggccctcccgccggagcggggctgccaagcgcacacacacacacacacacacgcacatacacacgcgcacacacacattcgggctcccaacggcgcgcacgcacgtagcgcccggggcagaccagcgcggcggccgcctcccgggacgcccggacgccggagggccccgacccccgcgcggctcatgcgcccgcgtccgccccgctgctccgcgaggcccgcgggacccctcccgccgccgccgccgcgcccgccgcccccggaggagcgggctggccgaccgccaccgcgccgtcccccggccgcccccgaagccgctccatcgcggtccctgccgtcctggggccgcgccccgctcccgcgccttgggggttgagccgagcaaacttcgcgcaccggccgacgcccggcggggaccccgctgcgcacccgcgcgcccgggtgggcgctgggcgcgcggacctttggggagcgggctgcccctcccgctgcacctgctcggccccctccccgcttgcaggggactccagagacaccgccacttcgcaaacttttcctccccaccaccgagagggggcgaggaggggtaaaaggggaagcaggttccgctgggcgcgcggacctgcaggctccttgctgggcaccgccacccgcgagctggacccacaggggtaccgggccccgcggccgccctccggccgctttctggctccggttcccgtccctgcgtttcccgcgggagcggggggcggggtgcggagggcagcaaggcccgcgcggtacccagcggggccgccctgcatggccctgcgcagtggggcgggctgcttcggccgggtctggcgcagggtgtcggggttcccggacgcctggccccggcgctcgagcagcctcctgtgcctgtccgccttctcggctgagcccgggcccgcgccgcccctgccccgccagccgcctcgcggtggcggtggctgtggcggccccagcggagggggccccccccagcctccccgccccccgcctccccgctgctgctgctgctgctgccgccgccgcttacaacttggaggcggcggcggcggcggcggaggaggaggcggcggcggccgccgggcgctgcagtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggtaagggctgggcgcgccgctgggctcccgcgccccgggaggagtccggggaggcggctgagcgcgccgcgccgggctgggtgcagggcgtcgagggttaaacgcagcctcccttgggggccttcccgcagcgccccctcctctctagggagccccccctccgcggcgcctccgagcctcacccttcggggaccccacccggtgctctccaccgcgctggtgtctgggccgggcgtgcgagccccgagcgagtgtgcctgagccgggagggcggaggcgccacttttgcgaagagagtggagcgctaagaataatcccatagcagacacccacccacccaccgccccggcgcgggctgggctgcgcggggctctgagccttacacttactacctctctgggagttggagagggctggcctggcacccatggctcctagagggactcaggtggcaggggagtgcgcctggggcgtgagaggcactgaccctccgtagcccctgggccccgctccaggcttctctgagctcagatttcatctctcttccccccgcccggctccttttttcccctgagttccagttctggagcttggacttcccaggcccctgggaggagagagtttgctctctggtgcttgcgttgggggtggcagcccctcaattgctctcagtagaggtggagagtgggggcagggcagaacctgcccactccctaggctgtgacactgggaaaggccagtctagacattgcccagaaaccagggaacttgagccccagtcacgagagggggtccagctggtaaactgcagggatgcccgccagccccactgccaagggcgctattcacagagcagggtctctggtcggtcccgagggcagtgtcccctctaaggctgggggctgggaggactcccggacgttatacttggagacctgtgggagctggggcaggtaccttcattcgggtggacgtggtggataccctgcatggcaggaggcagggtggtgtctctgtggttcacttgccccagtgaggcaggctgcctctctagggccatctccttggacttgccaaggccagtgtgttagtgggggtggtctgtttcctgcacccctcagggcttcacacccctgtgccctgggcagggacctcctccttcccccctcccttcttcccagctcctcctgtctcgcttctctggacctcctcctctaatttccctcttgatatttttctttgtctggaaatctctgcatactgaaaaaaaaaggatttctcagtgccatatgcaacaggaagcgccagcacaggacggcctgtctttccttcttggttgaaaatactttttagagagtcatcttgttttaaatgtttaattcattggtgcaggtttttctgtttgtgaaggaaattgtccttctgttatctacataatcagcttggctcttgcttgccccacgccctttgcccagcaccccaaacacagatgactccttcccttcccacactgtgtttccagcttctgagagggccagtcattgccattttctctggctttaaactgtggcagtggcacgcagatgcacagggcagtgattctgggagacaggggcctgtttgctggagagctggagagtaagaaatatgcctctgaaactggccacccctggggaaaggagaaagccccaaggcccttaaacatgcctttagggttgaagatggaagacaggtgaatttggctagcatgctggcttccagtagtaaaacaggcacataaaatgcttggctgatcccgagagttgagcgacaacatcgaggagaggattggtgttaaaagcaaactctgaaatgtgccagttttccttaagaaatgcattgtggagactgatgaagttcttactgaggtgtgtttccatggttgattctgattggtagctctgggtgtatgcctgtaacggttaaaactccaaagagaagctgtcaagggaagtgtagctaaatggagggtgtcggcttcgcctcaggggctgtgggacttgtatgaataagggaccagaggccatctgaggaattcgctgattttcctcgcttccttctttgggctttccactgattttctggaaagaaaggttgggaaaaaaatgtgtgtgtgtgtgtgtgtgcgcgcgtgtgtgtgtgtgtgtgtgcgcgcgcgcgcgtgtgtgtgtgtgtgtgtgtgtgtgtgtgtatgtgtatgtgaataaaagacagctctaacactaacacagctgtcctgttgtggaaagatgttcaacttggaacccacagacctggcttggaatctgaattcggccatagtgtaaagaccagagagaggtcatttcccaactcctgacctcagtttccccacctgcagaagagatgtctcacaataactacctgacaggctgacttttaaggtccaggtgagatcccgcgggctgcagctgccaggcacagtgtggccggcacttagtaggaacggaatccacgctcttggacgaagcctgatcgagcctccgctctctgccctaagaagctgtttagcacaagagttcaaatttacaggaaacaaagcacctttccagttaattctgtttgtttttttttctttttttaatataaatgcaaattaagatgctcctaggcctagaacaaaacccggccccaagcctcgccctccaaggatttgtctcctattgggcagtgatattaatgagtcaggttaatcttcattggcgttttgatttttaatctaaccttgagctatttcttgagcatgctttaactttttgcccaaatctccaaggctgggacaggagccgctggtgctgggcggccacgaatgaaggcttcttctcagatgcagctattagcttgccctgtgaaatggatttttaaaacgtatgtaattaccactttgcgttgaatctgtggccgagccttcctaaaaggctttggagggatattaccctgagtctcaccccagctctctggggatcccggggcacagtgaccattgtcataaccagggaagaacgggagtccagctgggccccgcaaagggcaaattcagttacatcatttatcaggctctgtttccattcctccccatttgcttcctttgatgtctgtgccacttgtagctatttctgcggagattatgtttagttctaaacttgtgaagtgctagacctttgcatgggagaccctcgtaggtaccctgtagtttccttttgattaggggttcagtctgagtttccccccaacccccgccccaccacctgttggtggaagtggtgaaagtcaggagtgctgggccagggtctggacaggggtggaggagttttatttggatttggcctgcttggggccaaatggtgtgtaagggacccctggaacacacatgtgaccttccttcagcaggcgctttagcctctccccacgatccaacagagttagagtctccatgacacttctttctccaatctaacatctgtgacctgagctgttatcaccttcaggatcattaaaaaagaagaaaccatcagatcttagaaatcagatctcatctgcagagtgtagaggacaatttgaaatcgggcttaggtagggaaggagaggtgggtttttccttttcttgctacagtttgcaggagcggaagccgtacatcaggggcagtatttccccagaacctcggggcccagctgaagctaggagtggttgctgtggggattgagctgactggctgggggcagggtacactctgagaaacagctttggggtccctggaggtgccttgctcccaggcctgtacctgctggaaaacagagtgccttgagatagcttccttttctcattcataaacggcaccttaaacagacttttcgtgaaacagacagcattttccattttttttcctggcactcttggtgcagtttttggtacgtggttcacactctgggcgagcacctggccctgccaggtctgtgctgctccaaggctctgaggctctggggacagtctagatgacaagataaggcctggccttgagtgaggaggagggagctggaaacccaaacagttggttgcagtccagggtgcagtctaggggcagctaagcccagtggctgcttcaaccccttccctgccaccctgcttagcacatgcagggggtatgttccttggttggctcttttaacctgtcttacaggggcttgtcctccaagaagtcttcccagcctttcctctcactgcctgcctcagtcccagcctttttctttaataaatactatgttttctgctccaggccctacctgtgtgtgttttcccgtgcacctgcagggccagcacaattcctgggccagagtgggcctcttggaagggctgcagaatacagcaccaagcagaccccacaggctggtgccagaggagcacggagcctccacacgcatgcactcacctcccccactttacagatgaggaacctgacgcagataaggccacacacaccaaggcagagggccttgaactctgtcatgcagttgggatctccttactgaaggctccaactgtggtgttttccctgggaccagggctgggctcctggagtagtccatcgcgtttttccttctccctttagctccacccttcagtagaactgcccagcagacccagatgaagggcctactagggcgccatggggtgggcccagaggagtggggcctccttggtaatgtccagcagggtagctggccatgctggggagccaggagatgcctgtgggcagctcctcttccccacacccttctcggacctgggctcgctctgctctgggccctctaggaagcactgcctctttgtagatgtcatggacacagccaagaaatggggcagaagtggggtttcttctgattctggggtacatcaaagagacacctcggaatgcggagacacccagcatggtgctctgaggaggggtgggaatcaggtgagacccaggagttggagatacccattgccctcacctactctttcctgggtcactttcatcagtggagtctaatgaggtcagagcagtaggtgaaacaggccccagtatacacctcttcctccatgcagcggttattcacacctccatctctccattcacaatgtactcacttagtcctccatgcacctgcttattcacacatccatccacccacccacccagctatccaccgtgcatctgccacccatcaatccacccatctacacatccatccatctgtctatccccatccatcctcccatccacccacttatccatccatccatccatccatccatccatccatccatccaaccatccactcacccattcaccattcatccacccaccatctatccatccacccacccatccaccactcatctacctatccatccatccaccattcacccatctacccacctacccactcacccatccatacacccatctacccactcatccacccatccaccatccatctgtccacccacccatctacccatacattcattcaccattcatccactatttatccatccacctacccaaccatccaccatccatctgttcacccacccgtccacccgtccatcaatccattcattcaccatgcatcccttcacccatctacccatccaccatccatccgtccacccatccacccattcatccacctacccacccacccatccatccatctattcatccacccacccactccttcatccatctatccatccacccactcacccatccatctattcatccacccatccatccacctacccatctacctacccacccacccactcatccatctatccatccacccatccacccaccaacccacttacccatttatatccatttacccactcatccatccatccatccatccatccatccatccatccacccactcatctattcacccacccactcacccatccatccatccatccatttatccacccatccatccttctgtgtactccctcccttcttccctccctccttccctccctcctctgtgtactcagtgggtcctcaactcacttgcttattggacggatttctgcctctgcctttccatgtgctgggtgggagccctgtgctggtgggaggcacacggtggtgagcaggcacagtaccctcattagagcctcagtgttaatgcctcaatggcctccatgaaggatctccaagatgttctagacccatctccttcctgcaaatggtgagccaatcccaatcacttctgatttttaagcatttttatttaagtataacgttcttatagaaaagtgtacatttcacaaatgtattgctcagtgaattctcataaggaaatcatgtccatgtaaccagcactcttaacaagagacagaacattactagcaccccagaacccccgaagctagtcatctcttgaatgcctccagtggtaaagagctcattatgtaacacataatgaagtggtagtggatgtgtttagacgaatgttgagattatctcttgtggggttctgatctggtgaggagtggtgtgtgcatgggggttgggatggcttctcttcaaggggctgcttgtctctatagtagtcacctgaggaggacccagcagatgtacatttagaaactggaacgtggggggcttagacctggaagatgagagggatttcagctcacagatgcgaagttgagcctggagtggggacagtatgctacagtggcccagggagctggccccagagggttggcccctctgactcagactgtagcaagcagctctgggctgtgtatacaccagcctcctagaggatgagggaaacatggagaaagagatgcaatgcttgttctcagtagagccccaggaactaggaggcaaccagcccaggtaggctgggctgataaaggaaaggcagtgggcattcttgagagagtcccatgggcagagaaattctggggcctgagaattggaggagggtccttcccacctccaggtggagcaccctgctatggccagcctgaaggagcctggagtctgaggtccctttcctcaagggatttttgttttgagggtctcttttcctgcccatccccacctggggacctccacctgtagaaagctctccctttttaggtcagtgcactcaccgtgtagcttatgatcctccaaagggagggctgagtggagcttggcctccctcctgttctgtaacagcctgtagggatttggggatagccctgggctcctgagtttctcccaataatgccctttgtagccagttcctctcctctgagaaattttagcctgtatgtgctttcccagtccagtctgagcattcagggagagctgaccatcacctccccttgtctacacaatatacttctgttaatgtcctcagttggtgcactagcttttctgggtagccccttcctgcattaacttgttttgagcacatgtacttccattttgtgctactaagcaaaagtgtccctgtcttgcattggtatggtcccaaatacaaaccctggcattgatacctgagcacaaagtagaattatgtgctagggaccaagaaaggaaggggtggttgatggaaaaattcatggcagggaagatgagaaaattcaggtgcatctgtgagtgtgttggcctggcttgtcgggacactgtgggcagatgtcagccactgggcctgaaagtccctccagctcacagtttgctggcctcagcccaaccatgcccttgcctggggtcttggggtcaaccagccctgagtgatggaagagcctggccagggagtggctgctcgaaggtggtgctaggtgagtggggtggacctgccctgagccatcctcatccttatcagaacttgagccctgggaggaaccagtaggtggcaatggggtggagggagggggctggagtagaggagggtgggctgaagtttggggtggcaggtgatgggtggaatgttggtgtgacaagagggatgctgggccaggcatctggagagtggggggcaggtccctaccctacgcatggccagccatccaatgaatgggccatgatgccacctgtcacctgggcaggatttcaggggctcctctgtggcctctcttatgaaggcacacagctgggaagcaggcagacctgggatgccagtgccctgcagggcggctcacatctggctcatgccccatcccagaggcccaatcccaggcacaccccttaagcctgggctccctcatctatgaaacggagacttagagctcagaatttgtgtccttgtaaggatgggaggaaatgtgtgtgaaaggtttcctcgcctcctccacccaggaggcagctggtgagtggcagctttgttgtgatggtggtcatttgggcgtgctcattaggggacagtcacctgggtctggttgtgctctgtccactcttggcaaattcactttcagcttccccttgccacttccccaccaccccctttctgctgccgccgaacccctgatctaatctcatggccccaatcttagcaagggggcacctgaggccgccctgactgagaaatgctcctcagagatggaaaagctcctaccatccaatggatgggggttgggatggtgtcaagccgggggctttgggggccacaggctgcattcaaggtgtctctgtgttggattgctatggactggaatacaagccctggctcattcaaggagtaagatttccccaactcagttctgttgggatactatggcttcctgggacaccaccttccactccaccactgcagtgacctttaaaagcccatggctgccatcttcgccctgccccagaccccagcagctccccatcccctgcagaatcagacccaggtcctcagcttgcagcccttttcatcctccagccccgctcaggccctgttcccacaccttctgccctgagtccggctctgccttcctcttttccccaattgtcctttatcctcttgagcaaaggacttgtttctttgctccccagcccactgtgctactcagttttctgagtagacatcagtattccctaggggctgctggtctcaggctcccttgcacctggccaggcccatagcaggtgctcagggaaggctggctggacactggctggtactcctggctccccgagagcaggagcagctgagagctgagcagtttggggtgacatctttctgcttggttgtgccttgggaccactgggtaggtgcaggacaggctgcagccttttgaactcaagctgttgcttttaatggaagacaacaggttagggatctgtcctgctgagtggggagcttctcactcctgaggcttagatgtgtgatcttggtccccaaggccagctgctggcgccaggcctctgtgagtctgcagggcatctggcaggaagagatgcctacttgtgaaatggactttggctgtcactggccctgtcagacatgtgaggtgcagcccactcaggaaggtgagaggcctttacctgcagctgacaggcacgcagcgcacatgtggtgtttgtcagaggtgtggaaggtgggcatacatctgggatgagcttgtcaggtggggctggggtgaaaactcaggtgaggttggggtgaatctctcaggtgggcctgaggtgagcctctcaggtgagcagggtgagctgggtggtattgagaactgtggggtggacacttggttcccacatttgaagcagaagctctaggcagcattttgtgtcagggcagcttgggtgcatggtcccatgtggtctggaaacaggcagtgccaggccactcatgggtgccagggcatgggcattcagttggacgtgggggggagctgattgccactgatgccaggtggacctaggctgagcttatccgggctgcagggaagggcccagcccagggatgccacggggtgtgggagaacgttccccagtgagtctggtcatgatgagaggctctccctgtgcggtttcccagagagaacttctttgacagcacccaagtgctgaggagctctggcagttggggaaattggtctggtgtctgtctgggacaatgttcaggccataggtattcaaacactagtgagggggaagccagtgtgtgttgaatccccaaatagctctcatactatgggaaagggaaagttggcaagcaacggcagagtgtttcgtgaaagggaggaaattccctacgactctcctgagaccccatgatcacatccaagaatggcttcagcattccatgttcaccttcttgtcattgcccaaatgtgcttgctgactttatcatttcatcagagtggattatttagggatcgtgttcaggagcctctagcagaaaagccaggtaacaaggacttgagcaaacagccgttttgtctttcttggttgcgaagcgtggggcaggcagacgggctgacaggtggctccacaatgccttgagagagcaggttctttccagctttctgctcagtcatcttagcttggcatttgtcctctggctggtgtctcatggttccatggtggctgctccacctccaacatcctctccagcatccctcccagcaggaagaagaggaagaacacaagtcaaaggcgtgtgccagctgagcctgcttctttctaaagaaccttcctggatgacccgcccaacagcttctacttatatctcatcagccaggactatgtcttatgaccaactctagctgcaagggaacctggaaaatggggcatgctgcttctcaaagcaagctggggtgtggctggtgaggagtgggtggagtcaggtattgggaggtgcccacggggtctgtggtgatatgcatagcatttcagagccccttttctctttaagtttacatcacacattaccttgagtttccacagactgaagggaaatgattttaatggctatatatccactgaatgaatggacacttaattattgaaccatgcctctatttataatgatttaatgtattttttctttctttaggctaactatagataatggtttgttggacatctctgtgtgtgtggattctgtgagatcctcctttaagggtttgctggctgtagtgggatcagcaggtcagggggcacagcactcagttgtgttactatgttgttcccatcaacaactgtacaagcaggggtgggtcttctggcttcactgcaacttcagcagccctcggcaatgttgaaaaagtttttgatgttcttactatttcaggatgttttcctagtggtcttcaggtggccttggaaaggcagctgggacaagctcatgtggagttggaaagctggtatccacggtgaaatccttgctcaccccagacacagccagtgcagggggatctgcaggacacttgtggacgcatgaaatgaggagggggaggggaagggagcctgtagacccatttcagctccagggatggggacagtttgccttgtcagtctgacccagccgactggctctggtcactggagcattgtaccacgaagcagtctcagtggggaagggtgccgtgtgtgattgattagtcatgtctgacatgggtgtgggtcaggcagtggtagcatgcttgccacataagcccaccctgggctggtggaagacagaatttcagaggtagatgccttttcatcagtgtgccaggaatgatgtcactatggataattgcttgacctgggtgcaatctagtttacaagacaggttcccatccacaaccatctttcatccattaacaagactatgaaatagggccaatggttacctggttatgctgatgaggctctgagagatctggtgacttgcccaaggtcatgaagtggagcttaggacttgaacccaaatctctcctcaagcttgatgtggtctccattacacccacagcctgtccagggtgcagtcccagacactgtccctctgcctggaattaagagcttggatacaggaaggattagcctcagtgattatcacctgacaatatcaagagaactcagaagcatctggtcccaccctctcaggatggcagcatcactgaaccttccagtgacagggagttaactgcctcactcatagagaaaggtagaaatagcatcagttttaaaataaaaggccaaaatgaccctcattggtttgtcttagttctcctgaccagagctccccaggataagtgtgacctcaattctcttaccacaaccaaagagctattgtttatggcatgcccatgggattctgtttttttacagtcactatctcaattaattccatcctctcgacaatcctatgagatagatattttcatgtatccccgttttacagatgaggatctagaagatcagagagactaagcaacttgcccagggtcatgtagctaataagtggcagaaaggagttatgcccgggaagtctgacttcagagtctgtgctaactatgttgttacatacagtgtcttttcacctttatcagttagctagtgatgtgtatgtaacaaatcatccacaaacacagaggctgaaaacaaccaccatctattactgttcacagtctgaggctcagctgggcagcttttacccattactggtctgcaggctgatgggggaagctctgcttcaagtcattgcatgtttttcgctcaatgatggcaaaggtggccgggcgtggtggctcacacctgtaatcccagcactttgggagctgagacgggcagatcacgaggtcaggagatcgagaccatcctggctaacatggtgaaaccccatctctattaaaaatacaaaaaattagccaggcatggtggcgggcgcctgtagtcccagctattcgggaggctgaggcaggagaatggcgtgaacctgggaggcagagcttgcagtgagtcgagatcacgccactgcgctccagcttgggcagcagagtgagactccgtctcaaaaaaaaaaaaaaaaatgatggcaaaggcacaggagagcagcaaatgcaagtgacgactcttttgccatgacactgccatgatgctgtcacttctcccacataccattggccaaagcaagtcatgtgaccaaggccaaagtcaaaaggtgggaaatacatcctgcccacaatgagcccaaagcaatggtacagcatctcagcctgccatctgaccatgcctcttgccaagtccctcctgccacctactcctcaccatgatttccttcctggtatagtggagagcatagctttggtttccaagtgggttcaaatcctgcccattgcatagctctcagatgatttgctgttttctcatctgtaaaacagatagtccacagtctacctttggattcgtttcagtttgctggggctgccattacagagtaagacagggtgacttaagcagcagaaaatactttttttctcacagttcttcatgcctgaagtccaagatcaaggtgtcagcaggttgatttcttcggaagcctttctttttggcttgtggatgatcatctccctgggtcttcatacagccatccctctgtgcatgtctgtggtcctaatctcctctccttataaggacaccagttagattggattagggctcacacgaggggcctcattttaccttatttttttccaaaaacagttacatccagaggtcctgggggttaggatatcaacatatgaatttggggtgaggggacatgattcagcccacagtaacctgctaggactgctgtgaggattaagcgagatcagggagatgaaagcacctagttctgggcccatcacatagaagtcactcagctcatgttgcttttctgccatatcaaatgtatgaatctgagtttatcttactatggtcaagaagactttgttgtccaaacatgttaattaatctattgttacctatcaaaatctgaccatctgctaggctggaagcctgccatggtcaagtggacccaacccaggatcggtcattgatatggtttggctctgtgtccccacccaaatttcatctcaagttgtaatccccacgtgttgagggagagacctgtaatccccatgtgtcaagggagggaagtgatcggatcatgtgggcagtcccatgctgttcttgtgatagtgaatgaattctctctagagctgatggttttaaagtgtggcacttcctcgttcttgcactcactcttttctgccaccttgtgaagaagttgcctgcttccctttccaccacgattgtaagttttctgaggcctctccagccatgtgggaactgtgagtaaatttaacctgttttctttaaattaccctgtctcgggtatttctttatagcagtgtgagaacggattaagacagtcatgaagggacctgagctcaacccctcatctaccttttattagctggggtacagcaagtaaaccattattttgctctcatcatcagcatccttatttgtagggtatgggtgatcctatctcctttagcatgttttgagttatacaaagtctactgtgcttttaaactttttcttaattggatttaaaaactggtaacatgtaaaacctctgtaatttaaacacacacacacacattaatgttaggtatttggtgtgattattattatgactatatataatgaatgagtacttatctttaagagataatgatgcatgtataaatgaaattattattatgactatatataataaatgaacacttatctttaagaggtaatgatgcatgtgtaaatgaaatgtctgggattttctttaaaataacctgaatcacatggagaagtggatgggggtttagataaaacaagattggccttgagttgttaattgctgaagcttgagtattcatatctgggggttaattatatttttctctaccttggtatgtgtgtctatatatatatgtatacatatgaatatatatgtatacatatgtatacatatgaatatatatgtatacatatgtatacatatgaatatatatgtatacatatgtatacatatgaatatatatgtatacatatatatgaatatatgtatacatatatatgaatatatgtgtatacatatatatgaatatatgtgtatacatatatatgtatatatgtgtatatatgtatacatatatatgaatatatgaatatatatgtgtatacatatatatgaatatatatgtatacacatatatgaatatatatgtatacacatatatattcatatatatgtatacacatatatatgtatacatatatatatatgtatgaaaatctacatagtgaaaacttaagaaaaaccaaacaaaatgtagcatagaagtagaagcctcctgtcatggtccagccccttagccccatgtctaagaggtgacagctagcagcaggttgttgcatagaagaggatgaaatgtttggctctgttgcaggctctggcatgcacatgtgttttctttggctcttacattctttgaaaatatttggaattagttgtcaacatttattaatcttttaaaagaaccatctcttggtgttcttataggaggttatcaattttattgattttttgcttttattgttattaaacacttactttgcattctttaggtttatttatttttttcctcccttcatgcactgacagttactaggctttctctttttacaaataaattcactaaaggctatatgttttcctctgtgtgcccctttggctgcatcccataggtgtctcattatcatttgtttgtaaataatttgcaagtgagtttatttttttctttaatccaagggttatttgaagcgtgtgttttaaagttatacacaaaacacacatgcatatacacacacttttgtcagcaaaatgattaggtaggagaatgagttttggagccagactgcttgtgtgttattctgtcttggtcatttactaattgtaatgtaattacatggacatgcatttcagcttctctgtgccttggcttttgcaatctatgaaatgaggatgataacaacaacaataatcgacctcaaggttgttgagaagattaagttagttcttgcattttgcacatttaaaattgctaatgtgcattttttcatatgtctgttggctgcataaatgtcttctttcgagaagtgtctgttcatatcctttgcccactttttgatgggtttgtttgtctttttcttgtaaatttgtttaagttctttgtagattctggatattagccctgtgtcagatggatagattgcaaaaattttctcccattctgtaggttgcctgttcgatctgatgatagtttcttttactgtgcagaagctctttagtttagttagatgccatttgtctattctggcttttgttttcattgcttttggtgttttagtcatgaaatctttgcccatgactatgtcctgaatggtattgcctaggttttcttctagggtttttatggtgttaggtcttacatttaagtctttaatccatcttgagttaatttttgtataggtgtaaggaagggatccagtttcagctttctacatatggctagccagttttctcatcaatactggtcatcagagaaatgcaaatcaaaaccatgatgagataccatctcacaccagttagaatggtgatcattaaaaagtcaggaaacaacagatgctggagaggatgtggagaaataggaacactttcatactgttggtgggagtgtaaattagttcaaccattgtagaagacagtatggcgatccctcaaggatctagaactagaaataccatttgacccagcaatgccattactgggtatatacccaaagggttataaatcatgctactgtaaagacatatgcacatgtatgtttattgtggcactattcacaatagcaaagacttggaaccaacccaaatgtccatcaataatagaataaataacgaaaatgtagcacatatacaccatggaatactatgcagccataaaaaactatgagttcgtgtcctttgcagggacatggatgaagatggaaaccatcattctcagcaaactatcacaaggacagaaaaccaaacaccgcatgttctcactcataggtgggagttgaacaatgagaacacatggacacagggaagggaacattacacactggggcctgttgaggcattgggggctgtgggagagatagcgttaggagaaatacctaatgtaaacgacgagttgatgggtgcagcaaaccaacatggcacatgtatacctatgtaacaaacctgcacgttgcgcacatgtaccctagaacttaaagtataataataaaaaataaaaataaataaataaaaataaaatagctaatgtgtttcaagtgttcactatctgtaaggcatacttataatgcataatttctgtattttaaaatttacaggactttttctttgtagtgcaataattaatttttgttgagttccatgaacatttgaaaagaacatttatttctttgtgtataaagttctacacaaacctattaaatcaaacttatttgttatgttactcaaatccttttcaaagtctgaaaactggtgattcctggctcaatcagcttgcacacatgttgggtttagcacatgtagtgtttaaattatcattattttattaacttttatgccttaaatggatcatgtgctctgtctagttcaccatagttcttagcatcatcatttcaggtcatctcactcatttgcttcagctgcctcactctataggcattttgatgtgtgtctcttgctttataatctgactataattattatcaggtctacttaatttctgagggagatcccttagtgtctctaccagtgcttggtcactgtagcttgtcagtttctccttgtatttctgacaattttagttttatgttttttgaagctatgtggttggatgcataaaggtttatgtttgttgttatttcttcttggcagagataagcttgcctatgtaaaacaagctttttaaaattctgtttgatccttttgccttctttttcccctgatcttattgctgtacctgcttttttaaaattagcatttgttatgtatatgttcatatttttagcttattttcaccctttttcttctaggaaagtttttgacatgccttataacaaaagacataaaaataaggtataaagttagtcacaaaatatgggtgtatactgaccttcatattggctgtgatacaggttcacatttacttgtggcttccaaggagaaaagacagaaagaaaataagtcaaatgttataactgctatcagaaatgtatggtgctaaattgcacaaaagaatgtactctcatgccttcactgagggttcaccaagtaatgttgtgttagtgtgaggaacaccaaagaggactacaatgaaatgtggctgacttggaaacaaccagggccatggagttctcagggcatgtctgggtgggatgtccagtgagtgatggtgtggtctctggggacactgtccaggaccacctgggacctgggcttctttgactttttggctttgtcttccttagtgtattggcatttgtacttgggtttatcacatctctgttccaggcaggaagaaggagggggcaaaggtcagaagggttatgccagttgagattgtccttctaacaaactttccaggaagccccactcagcaatttccacctgtgccccataggccaagggtgggccacatggccacacttagacccatcattggcagatgactgggagaaggaggtgtggctccatttcccatatcatgcctgccttaatacttaggggacatccagtctggtctcctggaaagtaatggaccttctggtggcctgttcagtggcccttcacactctgctcacatacctcctgtgacagggacagccctctgagccctcagctgtgttcagctaccacgtgtcctggatgtgacctggtaacccgtggtcaactccaacccctcgggcagacctggcttccccgtctgggctttagtctccccatgcgtgagtaagcccatggacaaggttggctttgaagtctagtggctggtgatggaaactctcagacctgctgctgaagacagaggccaccagctgcttcatttggcatctggggatgtcccaagagtcccctataaaagaatcagaagaggaggagatggagctgaaatggggaatgcttttggcaggagagcacctcagagtgagaacagcagaggggaggagggagggagaaggaggaagctgccagcaggggtggggcgggtgctcttctctctggctgcttccttctctgcctggcttccagggcacctgctcttcaccctcgtctggcaggggagaaatctggagctggtgggtcattgctcttatctccttgagcctttcgttctgggaccagaatcttcccgtacaggcagggtgtcagtgctgtgacccttttccttcttcctatcaggtggacatttgctgtaagctgggatcttgctttttaaaatttagaagggaattgtagatgccctcttccctggcccctactgcctctggttgaagtgccttaccaccccagtcccaggaggcctggacattggaaatgctctggtttttttcctttgagttttgttttccagctcagtctagatccattctgggcacacagaggagccctctctaatttttggcttcctctggggatgacctaagcatttgtttttaaagggcgggtgtgggggggtcaccaggcattatgcaacactgcactacggcaacgtcacctactcggccttctccaagctgcatgcatttctgagatggccagggcctgtgcttatgtgcatcaagctagccacaggagatcgagtcactgccctgctcacaagccatccatggctccctgtggcccacagcctgcaatacattgcttaccatggcccttgaaatctaagctcttgattacccctcagccctgtccctctctccaccccgtccctctttccacccctgtcccatgcagactgagtcccaggctagagtggggcatccctagccactgaagatgtctcctctgtgcagccttcccaggcaggtgagatgtctctcctatgtgtccctgaagttccagggctcccgccagttcagcacctgccaccctgtgtcgtgctcagctctttccaagccagtctttatcccttgcccccagcacctctcagcagggactctcttcttcatctcccaggggctgaggcccccacccgcctgtgtctggcactaagcaggccctccgagaatgtttgttgaatgaacataggcatggaaatgggacagctttcacaagagctatatttaactgttctagaatattctctaggtctttcagaaaagcaaatccttgaaaaacagcagcccacgaatctgaatggcaggtgtttgtgagaagaggtgggtggtcccattcggagggcttctttcggagccgggcttctccctgcacccctcgtgctccccactcagcccgaggtgcctgctgaacttgccgttcttcctccaaatcccagggtacctgcagggcctggtctggttcccgtggtgccaccggaagcttccatgggctgggccacaggaaggtaaccctttgtgccccacctgggtctgggccatctttcctggtgtctccctgagctccaggcatggctgtgactgtccaggccgcataagatgccggttggttaaatagcagtgtccacgcactgacgtcttctttccaagtagggtgctgaggccaggtgtccactataggttgcctggagccccacaccatgatgtgagattggccactgccagcctccccagggagctggccccagaggcctcagagactcttgttccttatggcagagggagcagccagcttgctgcccgctgtgctgctgtgccacctgcagcccctcagcacagggtgacctcctaaagccagcgacccttgttccagctcccaagcactcaggggcaccaggaagtctgccgggtcaagttcaaagtaaggagatgtgtggacctcacccacctggctccgccctgctctcccagcttctcactccttcccctggagctctgggcatggggctctgggcactggctgctggtgccttgacatggtccctgcctcctgtctcacaccttgacccaggttactccgtctgccggtgtctttcacggccactctgctgtttcttcacttggtgaacttcggtgggcggtgtgctcgggagaggagcacagcctgatggttccctccctgcctctttctcattgtgtgaccatgaatggacatagcttggagcctagtgtttccatatgtaaaatgggtggaatgatgactgccttctggagatttttgtgaggcttacatgggatcacatgtggaaggcgcttggccacatggcacagaatgaatgcacagagggcgatatgattagtgttctcatctgcctgttctgtgccatgctagatgctgtgctagaggctgttggctccaaggcaaaaagagcagacacgaaagccacatgtgtgcttgaggagacggttacaaagctggagctctaagttgtgggaggagaggggctgataggaggctggggtgaggctggagagagccccaggctgctgggcaggaccatggagattgtgaggaggagtttagattttgcaccctagaccttgggatcagagagagggggcatggctctgcagttccagaatgcgaccgcctgggttccatcctagtgtggcctttaataatgggtggccccagagaagctaagcaccttctctgggccccgtttcctctcctgccaagtggggatcctgagagtgtcagcctcacagggctgagtgtgcatcagggattaggagcacgcaggggaagtgcccaacgccatgagcactcactcggccatgtgggtggtgggtttgcatggggcaggggcagatctgagatgctgaagccacagaaggccacgtcagcctcctcctctgatctcctccatgggtaaggatccatcttcctgtccctcctccagcccaggactgtgcctgaggtggccctcctgctgtccaggatcatagcccctccggaggtatgtaggacccagttagcccccaagctgctacttgtaggcccgggataatggctgtggttcctggggaaggtgaaggggcagatccgggtggggaggtggaaagtgagcctccacagccctggggaagtttccttcctgaagctgggccccgcctgccccctctgccacccccagaagacccagacacgggaacttgtggtccctgtgcctgctgctgctggccaaggctgaacctgaagcccgcgcttggctggctctgggcagaggcgctgccagctggaagggacgctgccggcccttgctggccttgggcatcactcctgagtccccgtaggtatgaggtgggagcaggtggcgcaagggaagagacctggtcggggtgggagccatggtccccagaccatgcacccaggaaggcccatgcctggtacacagagtacactcacctcacccaggatgccccatccctcctgagcgacccagctgtgacatactacaaggtgcatatgagaaaggcacccaggctgagggaagcatgggctgcaggacagagtggagttgggggttggggacaccacagccttggatcacaggaagggcgggtgacataaacacgtgcttattgctgagtgaattggcttggacccctgtgtttccccaggtttccctctctagcttctccttccgtgaaggtagaacctgggcttctttgaaaagacctgggtttgaatcctgaccctctcatacaggctgtgtaaccttgggcaagctctgtagcctttctgagcagtcttcccatccatccagcaaacaagttgaggacatgctggcacgtgctaagctcttggtgacttcgacagattcctgctaagctcccttcagctttatccaaggatgtgcacacccagaggccctgggctgaatgatcgctagactgtgttgacttcttgttagaaaaatctgaccagtctgggtttcccttgtaacaagaagtgggtgtcagcaggcccggctggcagggctcctgggggaagtcatcgcagacctgggcctgtgcagttcccacacccccgtgctcagggagtgcctttcacctgccattccgcatcctgccttctcggcaagaggaggggagagcagaggcaggtgccagctgggcctgcacctgtgcgtcagggacacaggcgctctccgggaacccacctggcatcacttccataggctgtcattggctggaagtgggtcacgtggccactcctggtatttttagctgggcccgttgttgttttaaataaaactggggttctcttagtgaggaagaagggaaggggctgaggggacagcccaccctgcctctgatgcttacgactatgaagtgggctgttaaaaaaaacaaagcaaaccctaactccccaaaacgagacccgcaaatgcatcttttcagccagtgttctttcagccagggcaggcccaagcctctgcacagctgtctggtcttgccactgtgtagatgtaaaagctggatttagctgtgccctgtggatgaaggttgcatttttcttacccgtttaaaacctggggagagaggccatttactgctgtgttgtctgtagacctaggaccttggtctgagaatgggagcccacgtggcatcaggggcccagtgatggccttcagccctggccaggtgaggtctgggggccagaacagcccacccaagcccacaggccttgacccccaaagaggaaggtacctgtggaccttggaactggctgtggagtttctatcagcgctatgaggctgcatccaggactttctccagggatgggcctgaggccctcgggggtgttgagagaacattccagctgcatgaggatctggcttcctgagcctcatcctggaagaacagaagggccctgtgaaggccccggagctcagagcatgagtggagacgggccgagctgggtgctgaccaagagccagatgcaccttgccctgagcaggagtggggcttcctaagagcctagggtggacacggggctgtggtcctagagggacagtgacctcagggctctcacccagaagggaggtgggttcctgtctcagactggagaagggagctgcctgcaaggtgtacatgtcaggaaagacgcttccacgacatcctggaatcccttcacctctgagagaaggcagcctgcaccttgggcagaatcttgattccagtgccttccaaggagttcgtatggccctgagaaacctgagggattgtatggaacacgagtccagtcacctccagggccaagcagggggcagcctttggcaccagtgggtgcagaagtctgccagctgcagttgagtgggcctggatgggctgggtcaggctgtggggctgggatgcaaggtattactctgcagccgtggggacctgttgggctgggatgtgaggtattactctgcagctgtagggactcattgggctgagatgtgaggtattactctgtagctgtggggacacattgggctcagatgtgaggcattcctctgcagccatggggaccccttgggctgggatgtgaggtactactctgcagctgtggggacctgttgggctgggaggtgaggtattactctgcagccatggggacacattgggatcagatgtgaggtattactctgaagctgtagggacccgttgggctgggatgtgaggtattactctgcagctgtgggaacccactgggctgggactcgaggtattactctgcagccctggggtcttgttgggctgggatgcatggtattactctgcagctgtggggagtcagggaacacctcctttattttttttcctccttgtaagagtgtccaatccactttctcaccctcagtcaaatgcttggcatttagaggaattgtgttctcccttggccctgagctgctgcttggggtttaaacaaaccagcagcccaggcgagctgggtgatgaatactttttggcatttggggtcagactagcccctgggacaagtgttttggaaagagccccaggccctggggttggatgagcccaaacagaagtccagcattgtccagttctcctggcgtgactcagtgcctctgcctcagtttcctcatctgtgacccaggggtgcacacccccacaggtgataggagaagcatctaacacccggcacaggcacaggtgcagccgctacaccacctgctgtgcccagcatcaacctttaattggtggccacagggggtagggtcccctgcggccaccaactaaaggcaggtccagaaacatgatgtggggctgcctttgggggaggtgcatgcattctgcagcctactggccagcccgggttttcatcctgtctttgcaacctaccagctgtgagactgtggacaagtgattcaccatctttttgttttgttttgtctgtctgtttgtttgtttgtttgttttttgagacagtctcactctgtcacccaggctggagtgtagtggcacaatcttagcccactgcaacctccacctcctgggttcaaatgattctcgtgcctcagcctcccaaatagctgggattacaggcatgcaccaccacactcagctaatttttttgtatttttaatagagacgggtttcactatgttggccaggctggtcttgagctcctggcctcatgtgatccacctgccttgaccttccaaagtgctgggattacaggtgtgagccaccgtgctcggccatgattcacgtattttgtgcctccgtgtcgtgaaggtcaaagtgagcaaatatttgagaagagcttagaatggtgcctggcatgtgacttacacatagggagtgcctcctctcagaatcaggggcaggctgggtctagaaggccctttgaggacaaacttctcattttccaggtagccctattctgagacatcctggtgtgttcatcaggcaacatttatgagtgcctgcactgtaccagccccagctgggaaacagaaataagtaactcacaagttgtagttctgtcctcaaagagcccacagaccagagcaggagacaacaagtagccagctaatgatggcccagaagaccaagggctagaagtgggttgggggaatccaccactggacacttcattgttgggagaagagggaaggatgtatagatatgcagcagtagtcagcacaggctaactgctgtaacaaactgccctcacttctcagtggcttaacacaatacaaatttatttggctttcacattaatgcaggtcagagttgaggctctgctccacttggtcattcagggccccaggctccttccatcttgtggccctgccctcctctagggctttggcattctttcattcaactagccaatagaaaaggagagcccatgggcagctatgggacatttctcatgcctcaggcctggaaaagcagtgtattatttctgcccacattccattggccagcacttggtcacatgatcctacctaagtgcaaaggagtctgggaaatgtagtttatctgtgtgcccaagaggaaattgcaccaggtttatgaggtttggtgaacaccaacaggttctgtcacaggaggcttctaggagaccttaaggttgacttgggttgtgaaaaatgaatgggaagtgagggtgggggacacataagctctctaagctctctaggcggggggtcagcttgggcaaagcaaggactgagagtgtcttatttcgggctgctataacaagatgtcacaggctggggagctcagaaacaacagcatttgatttctcatggttctggaggctggaaagctgagatcagggtggcagcttggctgggttctggtgggggccctctttcggttacagatggctgacttctcctgtgtcctcatgtggtggagaaagagtgagctggctttctggggtctgtccttataagggcactaatccctttcttgagggctctacccccaggacctaattgcctcctaccagccccacctaatgctgtcacattgggattaaaattttaacatatggattttaggggacacactgagtccactgcagagcgtggaatacgttttgggaaggacaagatgcccaggcagtggggcaggtggaagggtgagcaaagaggtgctgggatgtctcccctcctcccctcccacccttttcatgcggccccatgtcccgaatgttgccaggtcaggcactgcctggagtagggcctgctgtggaccttattacgtcatttgctcctccaccgctgctccttttggggttggtggataaccgaggcttgggaagagaaagtaattttcctgtagctcactcagccaaaaagtagagagccaggattgaatccactgtggctgactctaaggccagtgctatttctgggggtgacagcagacactcggaactgtgtctcttgtcagtgaggctaagaggggtagggagaggggatccagagtggggaaggcttcggggggaggaagagccatgtccctggggtgccaggccaggggaacttggcctctaggtgtggctttcagggaagtgcttgctgggtgtgggcctcgcaggccccaccccgggctgagtccctgtcttgctgctaggccccagggtcactggggtgcttggctttagtgactgacagcctgggccctgtcacagcaccagtggctctcacaaacgtgtaggcagcacggaagaggggagagaccgtctggccccgtgaggcactgcagaggcatgagggcagaactgggggctggggtcctgaggtcttgggttggagtcccggctcctcccttttgctgtgtggcctaggcatgagggagccccaggctcctgagctgtgaaattggagaaccgggtccctgcccctcacagaggttgcaggagacacaggctgtaggagacactggggccctcccacctggccctggccccctatactcatcagctcaggctgccctcggagcggctcagacaacagatgttgacttctcacagagtagaggctggaagcctgagagcagagtgctggcagggcccggttctggggagccagcttccggctgtacatgcagccctcctgctgtatcctcgcatggcagacagcggaaagaggagaggtcatcgccttcctcttctatgagggccctcagcccatcacagggccccaccttcatgacctcatctaagcctgatcacccccaaaggccccacctccaagtaccatcctgttaggggttagggcttcaacataagaactctggggggatgcaaaccttcattccacaatacaccccacgtgggttggctgttggaaacaagcctggggttcctgtcgccctggcacactgcagggggttagagccaggaggaagggaagggctcaggcagaggggaatagcacaaggccagggcggtggggcaggggcggggctgccgtggctggagccgtcagctctggttccaggaggaggagaggtccccgaatctggccttgggggagccagggagcaggtgggatgctggctcagcatgatcctgggatgaaaactttcctctctgcaggggtggggaggggctggtatccaagagcaccctgaggggccccaccccactcctgactgcagcagaagagggcccatcatctctttggtggcatttttacaaactgcaaaggggcttaacccactatcccaaatgtgtagagctgacattttgctcacattttctttctctttgcagtctgtttgccggctgtgcagccctggaaagcccttgaagctctcctaaccctgctgtccctatctgtaaaatgggccagtggtgttttaccagccacactgtcagggatgctaagtgaggtgacacctgtcaaggggacgggtgggctgcacgcatccccactgctcaccagctcccagccagtgccgctaagctgcccctcacaattcctggcataggcctggcaaggcttttgactttttcatttttgtagcagctttattgagatttcgttcacatagcatacaatcccctaatttaaactctgcaactcaatggtattgagcattttcacagatatgcgcagccatctccacagtcgattttagaaccttttattcacctgaaaaagaaaacctgtgccctgtagccatcacccccggccctccattccccccaggcctatgccaccactaacctactttctgtctctatcacacaaggttttgagcccagttccgctgggcactcatttgtcaactaagggggcaattagctccccagatccaaggattgaggaccttcttgcctctcgttctccttgcccgaatcccgttctgcacgtggtaggtgggttgagcctctggttattcatttatttgttcctctcgccttcttgtccttccccaccactggctgctccccaacatgagcctgccctctcccgcctggcgcagtgccttctgcactgtgatgccagggaagatccgggcagggtggaacccacgcaggtgccccggggcttgggaccccttctgcctgtggcccttccccgcccgcacaccctaggatgtaagtgacccccaaacactccactcctcaagctccttcccatgcggctcctgtctctggagaggaaacaggactggagacccagttcttggccccaagcctgctgtagacagagaggctcccccacgggggctgtgtctggacagggtgggccgaccctgtcccacaaccatgtccctctgctacaggctcccctgggggcagcctcaggcgaggggccgttgccatgggaattgtgtattggagtctattttgagaccatcttgtagtgtgatttttaatatggcctggtgttggctgttggtttttctacatttgcccaagtgaatggattttgactgaccagaagggttgagctgattttgtcttcagatgtggtgttacccagaacattgtctgagcagttaattacaggtgacaggggccccagagcaccctcttaaagactgggcttagcctgccaccacgaagtgtggatgggaggcaactagacacagtccaaggaaggaatcgttgtgccagccccgaggccctcccctggtcctgctcctgcctctgggcagctggatgaagtcaggtgggtggtgtgtgtcctgtcctagagaggaggaacccagaaagccacctccaagctgcagggagttaagcgagggattggagtgaggaacctggtctcgagccttggcgagcccctgccgtgagtggctgctggggtcagtcccacctgcccggcctgaggaaggatctcacccccgcccttgttctcctagcctcaagccgatgctgcatcatgttcatcagggcgggaactgcgagtgtgttaacattttcacatctgcctctcccactgcactgcagaccccatgaggacaggtgggggccggtggtgctcctgccacgctcaggggagccttgaataaatacttatgaatagaagaattggccgggtgcggtggctcacacctgtaatcccagcactttgggaggctgaggcaggtggatcacttgaggtcaggagttcaagaccagctcggccaacatggtgaaactgaaaatacaaaaaaattctgttgaaaatacaaaaaacaattacattctactgaaaatacaaaaaaattagccagctgtggtgaacacgtgcctataaccccagctacttgggaggctgaggcaggataatcgcttatcgcttgaaccctgaaggcagaggttgcagtgagctgagattgtgctactgcactctagcctgggcaacggagcaagactccatctaaaaaaaaaaaaaaaaagaaactaaaaaaagaagaatgaacgccagcaagtggccttgggcacgggctcaatgctggccacgcagggactcatcctcccgcctcttgctggtgggagttcatggcttaggcgtctctcacctcctctgggctggcttttggttccttccactgcgaacacagtacaaagaagtgaggatattggcccaagagttccagaagggtgtcccctaggagggtgcatcagtgagtgatgggggctgagccaggcaagaaagggggatgtgcccgctgccacagaagccctctgcccttcaggctgggcagccagaagcccaggcctcctctgcacatgagcttctaggagcagaagggccagtgacacttgacagacctgtggttgctattgtggttacgcttccttctggttactgataattgctatcagaatagaggtggtcccaggaaggagcgagggaaggaagcccataggaggagtaggatgtagaacagagcgaggttctccgcatggcttgggggtggcaatagtggaggggatgccactgcaggtgcgcgtcacaggccagcttggggccctgtccctgccctgtgatgagaatgtctccggggtggtcatcaaatcctagagctgcagaagatgctgctggggaggtgggccacccacgtttgacctaccacattgtttttaacgttaaaaaacaaaatcattttaatcacatcaataatacataattattgtaagaaatataagaaaatacagatgagttaaaaaagatctgatctcctgccctccaaaatcaatggctctgagactcaggatgttgttggtccatattcttccttttcaaatatatttgtcttttggtacctgggggagaatggatcctctccgaaacccaaattgatggatgttcaagtccctgatataaaatggtgcggtatttgcacataacccaggtacatccttctgtatactttaaatcatctccagattacttccaatacctaacacaatgcacaggcagggcttgttttattgcttttcactttattgtactttatagatactgctttttttatttttatttttttaacaaattgagggtttgtggcaccccgtgtcatcaagcccactggtgtcatttgtttccaagagcatgtgctcactttgggtctctgcgtctcattttggtaatgctcacactatttcaaactttttcattatttattaaatccgttatggtgatcaatgatctttggcgttactattgtaattgtctgggggcaccaggaaccacatctgtacaagagggcacacttaattgataaatgttgtgtgttctgactgctccacccaccagccattccccctaattctactctgcctgtgctctacaagtggtacaacaaagcctggatggcagcctgtttacatcatggcttactgaatattttaagcccaatattgagacctactgctcagaaaaagagattcctttcaaaatatgactgctcattgacaatgcacctgtcacccaagagcgctgatggagatgtacaaagagattaatgaggttttcatgcctgctaacacaacatcctttctgcagcccatggattaaggagtcatttagactttcaagtattattatttaagaaacacattttgtaatgccatagttgacatagacagatttctgtgatggatctcggcaaagtaaatagaaaaccttttagaaggaatataccattccatatgacagtaaaaacatttgtgattcgtagaaggaggtcaaaatatcaacatgaacaggagtttgaaagaagttgattccaaccctttgaggggttcaagacttcagttgaggaagtaaccacagatgtggtggaaatagcaagagaactagaattagaagtggagcctgaagatgtgactgaattgctgcaatctcatgatcaaactaatggatgaggagttccttcttatggatgagtgaagacagtggtttcttgagatggaatcttctcctggtgaagatgctatgcacattgtttaaatgacaacaagggatttagaatattccatacacttaattgatgaagtagcagcagggtttgagaggactgactccagtttctgcagtcctagtccgtggaaattgctatcaaacagcatcgcatactccagagaaatctttggtgaaaggaagagtcaatctgtgcagcaaacttcattgttgtctcattttaagaaactgcaacagccaccccagcctttagcaaccaccaccctaatcaatcagcagccattcacatgaagacaagacttttcaccagcaaaagaattataacttgctcaaggctcagatgatcattagcattttttttttttagcagtagagtacttttaattgaggtatgtatattgtttcattttagacacaatacgattgcatacttaatagacaacagtatagtgtaaatagaacttttggatgcactgagaaatcaaaaaatgtgtgtggcttgctttattgctattgctttgttgtggtgtcttagaccgaaactgcattgtctccgaggtatggagaatagatgtgagctggaaaagaaagcagctgaacgtgacaaggttgagcctcagattaaagagaaatgacatgtgcagcccttcctcagagatactcaggctcagttcaagatcaccacgagaaagtgaagattgcaataaagggagtcacacaaatgtgtttgtttcccagtgcatgtaagagttccatttacacgacgggcgcggtggctcacgcctgtaatcccagcactttgggaggccaagatgggcagatcacctgaggtcgggagttcgacaccagcctggccaacatggtgaaaccctgtctttattaaaaatacaaaaattagctggacgtggtggcgcacacctgtaatcccagctacttgggaggctgaggcaggataatcgcttgaacctgggaggcagaggttgcagtgagccaagatcgtgccattgcactctaacctgggcaacaagagcgaaactccatctcaaaaaaaaaaaaaaaaagtattgtttacactatactacagtctgttaagtgtgcagtaccattgtgtctaaaaatacagtgtacataccttaattttttttaatttttattttaagttcaagggtacatgtccagatttgttatataggtaaacccatgtcatgggggtttgttgtacagatcacttcatcatccaagtattaagccatgagttaatttttttgctcctctccctcctctctcaccctccaccctccaaaacattcctcagcaaatgcaaaagaactgaactcataaccacataccttaattgaaaaatactttattgctaaaaaatgctgacacacagacatgaagtgagcacatgatgttggaaaaatggtgccaatagacttgcttgctgcagggttgccacaaactcaattggtaagaaacacagtatctgcaaagtgtagtaaagcaaggaatggtaaaaggaggtgtggctttggagtgatgcggatgtgcagcactgtgcatggcccaactatgcaatggaatcttttttttttttttattaagacggagtcttgctctgtcgcccaggctggagtgcagtggcacgatctcagctcactgcaagctctgcctcccgtgcaatggaatcttaatcagccattaggaattgttctcctatgttggaggtgtaggttatttcattttttgccgttataaggaatgttgtgaggaccatttttttttctgagatggagtatcaccctgttgcccaggttggagtgcggtggcacgatcttggctcactgcagcctccgcctcccaggatcaggtgattctcctgcctcagtctcccgagtagctgggattacaggcatgcaccaccatgcccggctaatttttgtgtttttagtagaggtggggtttcaccgtgttggccaggctggtcttgaacttctgacctcgtgatctgcccacctcggcctcccaaagtgctaggattgcaagcatgagccactgcgcccggctgtggggaccgtttttatgcacattcatttgcacacttgtccaattttctccttaggataaatccctagaagtgcaatggcagggtcacaaacacctgctacaagcccattcagttccatcttgatggaagaggcctttagggactgaactgcctgggcggcaaggatggagctaaggccagcaggcgacctggagtgcatcccctgtggggactggtctgataggtgggggaatcagggccagaatcccagcccactcgggcgcttctgagatggtgtggccttgggccactttgtgtcctgggcatgcagatctgcatcatagcaatgttccccttgggctgtctggtctgcaccaagccctgtgggagccctgtgagagctggacagggtggacgggcaggcctcacctgggcatggctacagaggcagccgtggcaatgctgccataggggacaggcattgcaggaggaatggcaccattgctgaagggtgaaactcagccctctgggccagggcaaagccaagggcctcagtgcccagcttgggtcttaccttgaagggggcaggtgccttaaggctgaaaaaatggatgaggaaaatgttaagcagaaagaaatgacaaaaatcaagccagatgttggtaaagagctggtgatgtgccaactagcggatacagctagacatggatctagagctttccatgcagccaagcaccttctccgttcagccggcagggatttgagcacctgctgtatgcacagtgctgggctccgcagcctgggctcagaagcctggcctcagcaatgttgtggcggctgcaagtgcagagctgagcctaggttcaagtcctgaccatgctgctcagtggcctgtgagcttttggtgactgatggatcctctttgcctcagtttcctcctccataaaaatggggatgaccacagtgttctgagcactttagagagtgccaccggacggccgactcatttaaacccgagaggctcctgctaggtatttatattagcacttaatagacagaaagcacctcacacagcactgacatagcgccgtgcttagtacatggtaatgggattgcatattgtcttacccaccctacacaataggatgacttccattctacagatggggaaagcaaggctcaggagtgttaggaacttgcctcttgtcacctggccagtgcactggaaagccaggctttgcagctgtctccctagcaggtatttactgtgactcccctctcagttctctcctgcttagaacagggacctaattgccacagggcccatggctggtgaccaggtagctgggatcaaatcccagatgggacccaagttcttcccttacaagacacagctcccggggtgcttggcttgctttaggagcactcactacttcccaggtgctgtgtgacagagttgtgctgtgtggcgggtgttgatgcatttaaccctcttgaggtggttctagggctgagcttctcaggctcggccacactgacgccatttgtgggccagcagtgccagcttcacctggcagcggggtggatggtggaggctcagccctgccagacctaccgtgttggaagttgcattctgacaagaccccagggcactgtgtacacattcaagtttgagaagggctggtctggacagcaggctgtggggtgatctgatggcagccctttgtgcacggccacctcattttacagagttagctgtcaggagcagggtgggtggtgaaggagctaaggtccacagaacacctgtgaagctcttccggcaggtgggcacagagccagggcaaggtaggcacctaacagttggcagaatagtgtcttctccttcagccccacaaagatgtctgcaaatctgtggatgttaccttccatagcaagggggaattaaggttgcagatggagttcagattgctgatcacctgagcttaagaaagggcgaggttcctggatcaatccaggtgggcccaatgtgatatcagcgtctttataagagggaggcaggagggtagagtcaggagagttctgatgattgaagcagaggtcggaggggtgtgatgtgaggactacagccctgctttgaagacaggggaaggggccatctatgagccatgcagtgcagaagcatctaaaacctggaaaaagcagggagtgacctctcccggatggccctcagaaggtaggcagccctgcgaccccttgatttttagcttcatgaggcccattgcaacttctaacctcttgaactgcaagagaaaatgtgttgttttaagccaccgagttcatggcaatttgtgacggcagcctcagaaaactaaaacgtgcagtagcaatggctgtgtggccgcctgggcctggttaccttgtgtagaattatactggtgctggggcctgctgtgcttgttgtaggaaggagacatcccccccagatccctcaggtttgatttttttttttattgctgggggagggttatctttccctcccttctgcaaaagccacacggtggccccacccagcccgtgctccaggaatgaagccagagggagcctctgcaatggctggaggagctggctcttgggaaccagaagttccagtgactgaggactctggccaaggagaactgggcaagaccctggagggccatgacaccaggctgggatgtggtcacacgccttacggctcccagcctgaccaggctggacttgctggtggtcaggatatgactgtagagtggagggcggggtctgtgccctgtctgtggttggcacctgacaaaggtgacggcagtttctggctgccagctcctggtggctaagcgtcttctggattctcaattcggtgaaactaggtttgttggggggcttgagtttgggggagcatatttagctaataagggaagctggacatagcttgaaatgcagccagcttgcagtgatatgttaaggcctagaggctgtgtaggggaggggaggcgggctctggagggctttgcctggctgggaaggctgggtgggctagggcgggagacagagcagctccctggaccagcaggattcatgctgaagagtggaaccagcagggtttgctctcaaggagattcaggggagggaaaggactgcagagaagtctttgaacacaacatacccatcttgcaggtgaggagacgaaggacctgaaagaggacagacttgaccaaggtcacataatgtcagacatcacagccctggttctgcccctcccggtcagtctgtcctgtctgggttcaaatcttagctgtggctgggttcaaatcttagtgtatggccttgggcaggcggcttgatcggtccctgctcccgtttcctcctctgtaggatagccgcaagccctcgcagcgttctccagagcattcagggacttggcacagagtgtcaggccccgatgtgttatttcgcaatttcttctcgtttccttgactgacttcacgcttcctgtataagagcttgttccacttatccgtggctacataacaaacatctccatctcagtggtgcaaagcgacagcaatcgtttgctaatgttgtctctctcatttctggggactggctgggctcaggcaggcagtgcttcctcgaggtctctcaggcggttgcagcgacactgagttaaggctggaattggcacaaaagcaccttctctctctctatctctctctctaacacacacacacacacacacacacacacacacacacgtgcgcacgcgcgtctgttcctggggggaaaacgtgaatgcctgggtttccctctgtctctgtggtctctctgcagagtggcttcagagtagctggactcctgcacaggtgtgtcctcagggtgaacgagcaggtgggaagcaatgctgtcatcaccaagtgtcactctcgcctcactgtctttcgcgccagggattgaggctaaggtggtggtgtgtgagggtctagatggggcccagaggaggtgctctgtgttgatgggggcgccgagagcatgtgaccacctgtagtcccccaagagcggatgggaggaacacgtttgctgtgttggcctcgcgctgacctgtcttccttttgtcttcagacctggatgctcccaggctttgatgctgggtggcctgggaggattcactgggaccctgtgtgtgtgcacgtgtgtgtgcatgtgtatgtggggcgtgtgcacatgtgtgcatgaggaagcttcagcccatttcagcagaggctctgggtgggtctcttcctcttcagacctgcacagtccctcctttcctcccagggagtgtgttgtgtctgggagatgccatggactctgaggggcttagaacagcactggggcactttgtggggctggaggggtgctgccctggtgtgaagagctgggggtgaaggcaggggtgctcccttttactaagcccctgcacactaaggcgcatctaccctctgcagcgtcaggaagctcctagcctgagatctgtcctccagccccccccccttcccccacccctccccttcctcccttctcccctttccctgacccccctcccctgtcccccgcacctcactaggagggccagactgtgtctccttgattctctgctaaatcctctgggctggcacagtgtctgttcagggtgggtgctcatgaaatatggagttgggttgaaaatggctgtggctgcccaccctggctagaccctccctcaaggccaggagcagctggaagagcagggggtggggtatggctgactgaggccttaacctggcagcctaggcctgtccagtccaggccagcagaaggggccaagcctggacctggtaggacctggtgcatggggtcaggccagcggctggtggtggcacagaacttgagcctccttttttgcatgtccctgtcttatgaatacagctgccactagagagcagggtcgatgccatgtacagctcagcataaagaactcacccagtcccccttcgcctcacactgccctggccacctgcgtgtcccctcgtcccccatcctggccacacccagcccctagcaagccaggcctttggcccatctgagtccctgctgtggcttcacttgcagagccctgggcaggaaggaccccagcctcccagctcaccccatagcctgctcctgccatctctgcctgcagtagagtgggatgtggggcctcaggaggatggggaggcccagaggcccacagggaatggggcggctacaggatcctccccaagtggtgggggagaggtgggcccctgaccacagtcaggctaggcaggcgctggggaagttcagtgaaggtcagcctggccttgagtctgcctctgtcccaccagcaccatcctgacctgagcccctctcgacacaccttggtccccaagccaccacttgaggatccactgtggactgtggaccagcagccagcagtccctccccacaggaacaggaggctggccctcacagagaaaggggagtgagcctctattcacctcctggggctaggcctcaccacatcccacccaggtgggtcaaatggtcccctttgcagcccagaaatggacgtcctcagaggtctgggagcttggtcccaaagtgacacagcctgcacttcctgtgtgtcaggctccaaagccaggcctttgccctggaattgtagacaccagtccctgttggcctctcctgggacctcctttgaaactcaaagttccctggagctgggccgtcagcctgggctggtgctgggggctggatgatggggcgctcaggatacctcgccccaggtgattcttatcactgggaagctgaggccccagaggggagggcatacccttcctgtgggctctgcttgcttcccagggctgtgacgagggcaagcctggcaggggacacccacgaccctaccttgtgtacttttggccatttctatacagctgggatgggaagagccctgagacatggccagcatcggctacctgaaggtgctgggggtctgagcctgcagcccctgccctgatcacctggaaaatggaaatgtcccaaagcgctgagttggggtggggggatccccacactgggatgtaagctctgtgtgggtggagactgggatgtggggcatatggtgtgtcacacagcaagaggcacatggcccaactcagcgtcttcagtatgtctaagactgggtcagcatggggtagaagctctctaccttgtctgcgtgatcggaccccactgcagtgactttggcctgggagtggctggagagctgatgccctgatgtccagccccgctgggtttgaggcctggctttgtcactttctcaagggggcctcaggaaagttattttgagttgggcattttcactgcttttctgtcaaagatgtacagaggtgctggtgcctgtcacaagctgggggttgaggatgctcccatggccagaggacaggggaaataagggctttcaaagtggaagcaactgggtcctctaccagctagctcttaggcctccttaggcaggtgatgtgacctctctgagctttaattttcccatctggaaaatgggaatggttgcaagacatatcttctcaaaacaacctgtccaggaggggctgtctcctgggctaagtcctttaatgacagccagtatgcattattgttaatcaataaatgcttattgactcaatgaaaaacacatctatgtcagttttatccagatttattttttttatttttatttttttaaagacagggtgtccctctgtcgcccaggctggattgcagtggtgcaatcttggctcactgcaacctctgcctcctggattcaagtgattctcctgcctcagcctcttgagtagctgggattataggcgtgcaccaccactgcccggctaatatatatatatatatatatatttttttttagcagagacgggtttcacgacattggtcaggctggtctcaaactcccaacctcaggtgatctgcccgcctcagcctcccaaagtgctgggactacaggcgtgagccaccacactgggcctatcctatttttaatgcatcgtatggaggagccaggggcctgtcgccagtcttcatcgcgggctgttatacaggcttttgctacctgtgaaggggtgctctaagtgctttttaggggctctaccatttaatataataatattccagagaggttgaggctcaacgtgtaccttctgaaatgtgcccgaggtcacagaaaaataagcaaacaaatacaatagttctgaccagcaattttactgaataggcaacacatctacatcgttcttctgtgaagacagaatatgaaggtgctccttaagactcccaccccactctgttctttccatcccatctccatccctcccactttttcctgttatcacaaataggggattgttttaaaaatcaatatattgtttctggtatacacacaaatatatattatcttatctcccctttcttgcacaaaaggcagtatacttgatcattgttctgtctcttgctttatctcgtaagaataggccgggtgcagtggctcacgcccgtattcccagcactttgggaggccaaggcaggcggatcatgaagtcagatcgagaccatcctggttaacatggtgaaaccccatctctactaaaaataccaaaaaaaaaaaaaaaaaaattagctgggcatggtggtgggctcctgtagtcccagctactcgggtggctgaggcaagagaacggcgtgaacctggggggtggagcttgcagtgagccgagattgtgccattgcactccagcctgggtgacagagcgagactccgtctcaacaacaacaacaaaaataaaatcctcgagatctttccacaccaatacaggggtagggtccaagccagagagaggccaggggtctaacacctgctgctggaggatagggggagaggagtattctctatttttaatcaatgtgtctgaggcaaaggacaaagacaagaggggaaactcagcctgaaccctcagtcctaggcatgagctttgtttcaaatatttgaaggcagctcttgtagtgcatagggaaagccttgggtcaggtctcagggggtcaggactccagcctggagccacccctagcaagtgagggacctttagcaagtccctgacagcggccaagagtcagggtcgtatccacgcaggtgtttaggtcccagagcggtttcttgcctatgaattcatttgactctcacaaagccccgaagactcagcggcttgatacatgctgtttcttcctcctagaatgcctttctggctaacttgtcttcccccaaaacttgaatttttgcttcacactcacctctaatcacagaccttctgggagctttcctgggctgccccttccacaactgcctcagcaaaccttagtccttcccgtgtaccctcatccacagcagtggtcagcacctcggacagtgcctgaggcaggtggactctggagtagaggccaggtccaagggcagtggcagactcaggacatgggcagggaacagcccagaaggagagccacctcgcttcctggacactggccctgcacttggaggcagtgtgaccgtggggaagtccaggcctctcagctgcaaagctggggctctggagtctgccagtttcacagagctagtccctgaggacacatctggtttgtgagaatagcatccaggacccagttcttgtttcttggtgggtgtggctgaattccagaaggcaggggttgtgctctcccctccgtggtatcttttgtacagtggaggtagtgaggcttggattgagggggagctgcggaaaaggaaaagggtaccagtggctaggggcttgctgggcagcagggaagtcaggcgtgacccgtgtagcctgaggcccgcatctggtttccttgtgttcagcaacattgtggggtgttctggaggaaagagctgggggctggcctccaggtgggtccagccatggggctttgggatgggtgtgccttccctgctcagcttttccagcagtggttgtccccccatgacttacagcatccactaggtggtccctgcccctggctgcagtgctcactgggctcctctcagcccttcaggcctgtgggtggtaatagctgccccctgctagccccttgtgtcttactgccctacttggtgccctcaacctctccttgcctctgcaaactctctcttcattgaagacaagggtctttgccctgatttgatccatctgagtggatgccatgacctgtttcatgccatgaccctgacctgatacaaccaaggacttgagattttattctaaacccaacaggaaaccatagcccattgtccatatatctgcccaccctaccatgtcatctcctctgcctgtcctgtgggggagacctgctgttggacagggagaatcctgggagcaggggccagccatgttctctgcctggatgggggtgatgtgggtggggaccgctgggatagaggcgagtcctggagaggcctccccacccgccagggtgataacgtccctcctctgtgaggagacaggaagttaattcatgcaaagcttttatgaataaaatggggccttgttagtagtgaccatgcggtgcagcttagcaatgatctccattctgcatatggggaaagggagtgtcccagtcaacgccctatgctcagatccatccatcccccacttctgcagtgtatggtgggaagctcagtttcccaggcgctattgctctctggctctggggggttttggctctggggggttttagttcagggagccagtgccggaagctcacagggcaggatgatgagaagatccacaggcagagagggttcactgtggtgtccctggcagctgccacaggtcctccccggctcctgctctggccgggagacctgatcctgacctgccttctcccactgcctaagggtggaagcagcttcctgtgctctcctcatcacctctgtgactaatgttctggattgaattccctctgttctaaattctctcaagtggtggtggttttctagccagacccatgagaagttaagctcagagaggttcagcaacccacccaagggcacacagctagttaggggcaccagaatgcttgagtgcaatcctggctcaagctagcacctgccttcccaccattctcacttccccaagagagacaagtggaggcttcctgagggcagcaagcttggagctgagcctcaaaagaagagttggattcagccaggtggaccaggcaggagacagggtggttcctgttggaggacatagcacctgcaaaggtgtggagggggcaaatggtgggtttggaatgggtactgaggccaaggggctgcaggggggtgaggctgcactggggagggctgagcctgcaagggagagccccatcttgggagggtgagcagggcctgggcaggatctgatttgtgttggagaagatggttctggttgtggatggtgtggcctatggggccaagagtggctccagggaggccctgagaggctgtggtctctgtccgggtgagagatcacggtggcctgggctaggcttctgcatggaaactaggagaaactgcaggtctaggagacaaccatggtcattgaagaagcatttgtggtatagatagggcactgtgtggggttgagctcctccaaaatttggcataaagaagaaaatcatcagtcatttccagggaagcagttagggaaggttggggtgaatggatggcttcccggggcaggtgtcatctgacaagcttcagcattcccagctgctcactcatctgtctgcacctggcgggtcctgtctgcagattgtgagggagaggcaagcgcgcccaggacagtggggaagggcactccaggccgagggagcggcgtggggaagacccagaggtggtaagagcttgctgcatctggacagcaggggcgtccgagagcacaggacctcaggtgcatgtgggctggaggggccaaagagttagtggcccaggctgagccccagctggatgggctctctgctcgggctgctcctggctttttatatttttttcttcctagtactcctgaagaccaagctgcttgcagggagggcctgacagctgccacttggatctgggcactaggtggggtatatttacctgcacctgggggcatcagcctgtaccccaacctggctcatacatacctcctttgctgtgcccatgaggaggggtgacacagagggagtactgaattgtttgaatgtcccggagcttcatggctgagtgtagattagagggccgccctgcttgcctctagcctctgtctgatttaaactttacctgatccctgcaggggcagagctcttcttcccattatgcagaggaggaagctgaggcttgggggcctccagggacattcccaaggctccacagcatcgctctgtctccccctcgctgtaggcagaagttctctcttgaatcctgtcttctcccccaggaaaccttccctgatgatctaggggtgtccaccatgtccactttcttcctccggctctgattggcagagcccctgagtggggagagcccaggggtgtgggaggagcccagtttggagttggccacatctgcttagagtcagacatgtgcgaccttaaggggttactgcccttctctgaacctcagtttactcagctgagaaatagggatttctcacagggtggctgtgggacttgtcccccattcagagctgggtatcgctcagcttcctgcctccctcctgggatggtgctgctgcccttggtgttctttcacctggacctgatgggggtcacagcctcccatgccccttcctcccccagccccacctcagcgctccagaaaatctgcctagtcaggtttgaatgggagagagccagccagccagcatgtctgggtggcgagaaaggctattttgggaacaagccggggaaggagtgttttgttttgtttgctcctcgtgattacaagaggtggcagagtcctgctcctgctcttgggcaccgagtgaggtctgggtgagggctggggagggaaggagggatgcacttctctgagatggactgtcaggcttcttgacaacccgaggccacaggggtctgcagcctgaccccattccctcgtcactgtcagcttggtcccaagcagtatctgagggaggggagtgggggcgaggagcctggagaaaccaggccatttggatctcgacaccagacttttatctctagctctgccacctgccccagcgcccgccccccgccatccatctctgtccactggaactgtctctttagctgaccatctatccatggtgcatttgtccgtccgtcacccatctttccattcactgccccctctgcagccatcctctcgcccatttatccgcccactctctctagccgcctgcctctgcacccacccagccatcctctggccccagcggcccactgcagctgatgccacaggggctctgtgcatcttgagctaggccccggggtagcatggtgaacaagccgctgatctgccttcccccacccagaggctatgagtaagcaaccagtgtggcatgtaatgcgtgtcttcgtggatcttacagtatcctcaggtgcctggaaggattagcacagggaactgcatagggacccacgtgaaaggctcctggagaaggtgacagttcagctgtggcctgagggctaccgcagaatctgcctgtcgcctacctgagggaagagcctggcagggggctttgaggtggggagaagtctgttgtctggttgtggggatcatccaggaagccagagggtctggagctcaggaagggggtggggatgggtcagacaacaccagggcctgagcgggcagggcatctgctcattggctgtggtccttgggaggcctggcagggtctggccgcgctccgaggccagcgtcctgttcagcagctctgctctctgaccaggcagagccatccccagatgaagggggctgaacgctgcaggtcaccagggcacccagcgatctggcagcttgtgttttccatgtaagtattaaaaatgctccccagagccttcgctggatatacaggcagaaaattcagacaaacttcagctattcctcagtgattcttagtcttatttacagttttctttttccttaaataacagcatcgtccttttcctaactggaaagctctgttcctggggcaattgacttgacaaggccctaggcaggggatggggtcagagtccaggccgaacacccacttgtgtggcccatgagccacggacttgcccatcctgggcctctacttcccctgggtggaagaaatgaacacgggccttagctccggccccttctgctctgaggctctggggtttagggacttggaattggtgaggtccctggctaccccaagcaaaattcctgggagggtgttgcccgagagctgagctggctggtgggaggagtgagctccgcgtgggcctctggacagtgtggaagatggattttttcttgagctgataatgccgcctcgtgtttgtagagcgatttatgggttttgaaagcactttcccttgtgttgtctgatttgcgtttgagtatctattaaacaagtgtttgcatatagcaggcagtgggaaccagctccaggcccttggggtgagggaaggggtggggctggacctgctcccctacagggctcacattcccatgaagcatctcagccacactccagagctgttggagagaacaagaggaaaggcggcgggggtggtgggggaggtctctgttgggggagtcctgagtgcagaccactggaatgatggacccagaaattgggcagaggctcacttgcagggggctggggagggactagatcaggcaggcactccaggtaggggacctcaattttgcttaggcttaagcaaatatgtcacaaagaaattttaggtactgttttgattatgttatgataaagccaagtgtgtgtaaatatattcataacattttctattcctggccatatatctgtggcatcttatgataaaattcatttaaaaagagggctctcggccatttggaatttcagtctggaaccagaggctgacagggctggtggcatccgtgatgcttcttcagcctcacagtaaagcccctgagcagctggactgggcttggtgctgcaccctgtcaaatccacagcctggcagcatttgaggagtgctggggcgctggcatggggcagaaggggggcccctacaaggtgcatcattggggacagcagcaaattgtcagcactgcacacgatgcttgtacgtgcatcagcccctgccccgaagatggtgaattctgacttcaggacaggagaggacagagctcttgtaggaagctgagaccatggtcctgtccctgtctggcccctgcaggttcaggggctgaggggaccccagaatctaggccctaggagcacccagagtgtgccacatgccaaggggtgctcccgcagccagtagctgacagcgtttggctgcacagtgctctgtgtatttatggacccataaaatattaaataatcatcatgcagcactttttctcctgaaaggcctttaaggtccgtatttcccccattcggaaggcagaacaaataaccattgaatcagccttcagctcccggcaggagaatccggcccttagaggagcgccagggcaggctggcggcccccgcccccagagcatgggtggaaggcccctctgcttacagggaggggatgcaggtgcaaggcagagagggaaggaccccacatgcatgtccacagccccctatatgtgcctcagggtgaccaggtgttgctccttagacaccttagcagagaacaaggacacagaatcccagagccatgatgggctcaggagtgagcactgagcttggagtcagcagacctggaagagaatctgcttggaacaagatcttgggaaaactagttcctagtcggcccttgtgtgggattcagggtggttggggccacctgtctgctgggaggggaactcagtgtcttgtggaagcattgggggtgggtgttttttactgtctctgctgtactatctctataatctctgcaagctggggatcatgtgccccagctcttgggagcattgaaaggaggacatttgagacttaggctagtaacacaaggcattcacaagatggggaagttcaggaggagatcagatttcaggtccttatggctccaggcacacaaagaatgtcagacagccaagggtgggaggtcaggtgcttctcattgcagcagggatgatgctggtctcaaaaatggtgatgggtgagtctccctaggacttggaccacagcatttggtacccactccagatctggagatactgactccagatcaaagagtcccttagagcaatagcaggtaaggacttgggccaaggggcaatacagcaatcctgtgtaattgtgtcggcgatattggctttattttagcaatagcatgattcctcctattctccaacacatgagaatttcaacaaatatttattttaaaccccaaccccagtactcttccactaattagtcttcttctggcagcagctgggaagtcagcccaatttggcctccatccttgactcccatccatccgctacagaaggtccaacaccagtcttaccccaccccattctagcacaatagttgttgcagggggttcctacttatccaattccaccctttaatagaaaacaatgctccaaaccctcacagtatgtctaggagctatcaccactctattcacagcaatctgcaccctgggtgtgaatgatgattttgtcccctcctgtggctatggggtggggagccacaggtggccaggtgtggttgccgtgcccatccgtggtcaggaggtgggattgtggtcagcagcctccaccggtaccaagaacaggaggatatgtgggggcagggggacccccacaggtggaggagcagtgctgcatgggacacatgctcgtgtttctgactgtgcaggttgaatggatcttcaaggtgccttcactccagccccacctggcatattttggggaactgctagagggaatttcctaggccttaggcttgcagctgggaagaagcagaaggggatggaaaatgcaccctgacctgcagcccagtactcttccacatccaccctgatagccttgcagctgggaagaagcagaagggggtgggctccctgacctgcagcccagtactcttctgcatccacctcgatattctggggctttcagcatttataggagcaaatattctcagagttggaaggggctctgaaggccacccgggcacattctgaaccatggcaacatcacttccgggggtgtcaaggggctggtggcctctgctccagaatccccgaatgacgatggccaggctcagctccctgaaggccatggggctgctgcttccctcccacatgctgccttccccactgggcagagcacctgcagccacatcttgggaagatttctcatttctcaggggtgtgtggttgtcgaagtttactctggtgcagttgtaaactttccatctctatccgattcagtaccagccactgcctgcacatgagtcagatgctcagggaccctggagtggagaggggatatggtccctgtgtgcaccttccttccccatccttggggtctacttcctcaggtaagggagggacagggggatgagggagaggggagaggagcagcagccagacacccaggtgcacacaggggacccagttctgctcagctcctgcccccatcctgagtgggcgcccaccctcgggttctttggtgctctgttcataatcatagtaggtgcttactaaagcactgtgtgtgccaggtcgatgcatgttcagggtgagatgtgatggaggctcacagggatgggaatgttgccagtaactccgagctgtgaagtaacgtgagtgagctaaggctctgcctggttagcagaaggtgctcccacctcacccctacagtctgttcttcaaacagcagccagcgtgatcccttgaaaatccactccagatgctcttctttggatcttacttgggggagatgagaagccccaggagagttttgagccaagttcttcccacagccacaggctccacatgatcttaacttggctggcattcctaggaggctctcttgccacagggcctttgcacctgccacttctctttccccaggtagctgcctggcttgctcccccactgccttcagggagatgacacagaagcgtcttcccttggtgtccctcccacacccacctctttccttggggagtgcagaattcctgctcctccttgtccaaggagcctctgctccagcattaattgcctttcggacagtaccactttgttctttgccgcatccccagacccaagaacatgttaggtgctcagtaaatattcctcaaatgaatgattgaggcagagaggttaagcaatttttttccccccagggttacacagctgagaattgatagggctgggatgggaagccaggcagtgctgccctggagccagaccctgttgtcttgcaggtactggggagccattgaaggcttttgagcaggggagtgtatctgtcgcacagtgcaggaggaagggcccaggagtgggagtagaccgggcatggaaagaccgcatccaggcatgtggctatctcaggggtgggtggtaaggtccacagtaggcaaggcagaggcagggacccagtgaggggcagcatgtgtgcaaggcacatcttggagtgactttaacccaacccgatgattctgattttgctaaatccttcctcattctacaccctcagtgtccacttgcagccagcccccaaatcaacgggtccaagctcatctctggagccaaccggtgccccaggcttcagggcttacataattaaatacacgcttctgacgcgccactcaggccaattttccagatctcatctacttgaaaatcctgtcattttccaccagctgagttacagtgaaaaaggataatttaaccggagtccatccatcttcagtgaaagtgagcaattctggcccgtctgtagttgaagttcctgagatatggaataaaaggtgtgggaggggaggccacggcgtcggggatggggagaaagctcctcggaggataaatattagctctgcattcttgggttgggtttagtttggttttgaaagagtgttcatagaaatgaattatgaaaatcaacagaagtaatttcttaggcgtccagtggctttcttcccctttgtatgctaagatgattacctgtcacagggaaaatgtaagctgcaggttaaaatccaggaaaggcagtggggggatgggaatgacaccccatccagcccagaggcttcactccagccctcatctgcccacggcacgtgtcattggcgtccggtgctacccagtgccagctgactctgcccataagagtccagaggcctggtggtgggctctttgagggcaggggccgcgtccttacccatctgtcagctggggaagaatttgctactggttaatcccacttgcaccaggctctaggccgagacacagctgctcagtgacggggctggcactgttgggttttatgatcaatagtcagggaccggcgagttcctgaatttgtatgctgggctagtggcccattctcagtccagagggacaggaggcaggctggagggccacgtcagggtgacgcggcagccatcaccatcttgcatgggttgttgcaatagtctcccctcattttaattgaggtagaatacgctttacaaaattaactattttaaagtgtacaatttggtggcatttaggacattcagtgtcttgcaaccatcacctctgtgtagttccaaaacaacatcttattttcggctccaaagtaataccccgtccccagtagcactcactcccattctctcctccccatcccctagcggccagtgatccactttctgtctctgtggatttgcctagggtggacatttcctatcaatggaatcctgtgctaggcaacctttcatgtgtggctttcttcactgagcattaggttttcgaggctcttccgtgttgcaatgtgtccgtacctctttcctttttatgatcacatgatattgcattgtagggataaaattccaggtcttatttgaaggagatgggttttttccacctttcagctagcgtgctgctatgcacattggtggacaagtgtgtgtttggctcctgttttccatttctttgggcatattcctaggaatgggattgctgggtcatgtggcaattctaggtttgaccttttgggaaaccaccacatgaccttccacagcagctgcgccattttcagtcctggggtagccacctgagagggggtaagggcggaacgggagacctgagaccttttaaggtggaagtgaagtcccttaggggctcagaactctggaagctccttgtctttctgagtgaaagccaaagcccttacgatggccctgagaccctgtggctgggtccctgtgacctccctgccatcaccgccacctcctttccagctgcacctggccatcctggcctctatgccctcttccatctggccagcatgcaggtaggtgtctcagggcctttgcatagctgtcccttaaccacaggggtcgctgcaggggaacatgccgcgtgcacgtctagccatctgtccttccatatcatttgttgttcatcatgctgggcatgcactgtctcccgccctgccccctcccacatgagaatctgagctgcacaaaggcaaagacctagttttgttcactaagaatcccacatgtctacagctgtgcctggcaaacagcaggtcctcatgggctgtttgttgaatggctgaatgaagatatggatggagtagcttctgccatagacctccaaccaaccacccccaggctcctggcaatggggagcctgggaccttcagagcttctctaccctggctcctccatgccttcttcccagttgccatcctgggcctgttccaccctgtggagtgctcccctaaaagcccatgctcacggagcccagcctgagcctctctgctcctgccttccagcctcagacctgcagagccccctgccgccaacagagggcgggagaggtcccttgtgtagggtctgggagcccagtgcccagatggacccagcccacctttgtgtgcactgcacaccccgccttgtgcacgagtttgggctggcggccagtgttaggacagggagccagggggccccattagagatgatagagcttcacacagtcattccttttggggagccacagctggctgcttattgtgttaaactgagaggtactggttggtgctctctatgtttctgctatgggtattttgaatccatttgtaggaattcatgtttgttatgacttatttcatcttgctagattcaggattttaaaagatttcaaaagcctggaaagatggccagaactttcatctaagataggatgcattcattcattcattcagtcagtcagcaaatagtccctggaatccctgtttttcccagcaataaaaacatggtacagtcctttagggcactgtccatttactggcgggttgtacctcactgcactgtgtaggagactgcttctgggtcattattccaagtcattgatgaaaagtattgctcgggtcaagtccaagatagagccctggggcttgcccctggaggcctccttccatgctgacctggccgctagaatctctgttctgcttatttatcaatgttcagaagccacggagctgactgtcatctgcccgtgatcacatgtcttctctacgggatactggaagagactcagaaatgaaggaatttggcaatgtgtccgttgttggtgttgggctttgcaaaatggaaccagcgcacagctggttggagaggaaggtggttccatgagctccaaagaagggtggtgcccacagtgtttcctgaggggtgtgaccttgtggctcctgctcacaggcagggcttcctggggaggtgacatctagttcagtctctgaacactggatccagttccaacttgacaagtagaggggcaaggagccttctgggaaagcaagccactggtcatggggtgagggagccagagagcacggaccctggggaagctgccatcatccccagggagtgtctgagcttgctgggaatgggtaagaacaggatgggtgtggggcactgggctaaggaggtggggtgccgtctcaatagtgttggagagtcttcgggtttgggcttctggcacaggcagggcagtgtctggtctgaggcttgggaagctccctcttgctgccctctgggtggaggccagagagcaggcaggaggaggggccaggcgatggtggattcctcctgtgcaccgcttggggccttgcacggggcaggtgctcaggatggatggctaattggctccaggtgccttgagagccttctggctgaagctctctgcaaaacaagcccatgccaggctgctggggcaggtgcagggctctagagtgtggggcatgggcaggagggaggggactgtcacctagcacctgctctgggccctgtgtcaggctcagggttttcaagagcaccttgtcttgtagacctttctgcagccctgtggggaggtggcaccggcctcaatgtacagacagggaagccgtgggctggagaaggtcccagttcttccactgcctgactatgccaacttcctctcctccctacctggaccctgaaggcccctccctgggccatgctgagggcaggtgggcatgggcaggcatgggtgggcagcctctgccgtctagaactgaatccttgagtctagtgggccttgggctccctgggccggtctgaacctttagaaggtgaagggatcctgaccccttcttgcaggtggggctgctggggccccgagatgatgaggtgccctgggtcttcctcgggcccacagcacctggagaatgcctcccagtgctccactctggactctggagcacttggtgggtgcccctgccacaaggggctgtggtctatggcttgcactctctttgttaattctgggacaacaaaagcctacacggtgcgggagggaagccatcccgtgcgtgggtctgacaccagcctagggcttctgcagccgcctcgcacctggtgctaacctcctgggggcttggttggctagcccatgtctgtctgcactgtgggcggggatgtggggggaggcacaaatagatcagagatggcagcagcctctggaacagggggtggacagctccgcgggggaggcagggctcttggcagaggtgcgctggcagtgccggggcccagcggaggtggccctgaagcccggtcagtgcctgagtgggcactgctgcaaggcatgctgggattgtagcagccagagggcagtgggaggctctggggaggggggacagggcaggagcaccccagggagcaggctgtctggtctggtcccatgctcctgagtggccctggttgcaaaaccacctgtgctacccaggtccaccgcgtgggctcctagaacctcactttcctcatctctgaattggaagaagtgacacccaccttagggtgtgaatctgagcctcagaacccactcagtgttcccagcctatgcagcgggagcccaccctgaaccacctctggctgaaaaaccctaccctggaatatggtttcagccgtgggctgtgatccattaatgggtcatgaaatcaagttagtgggtcacagctagaatattaaaaaatgaaacagaacagaatggaatcagataatagaagaggaaaaatgggagcccgctggaaggagaaatgttctgaggacgttggttgaatatccatggctgccgagacaggatgctaaggacatttcttgctctgggtcaggttcagcctgtctgtgtttggatgtccacactgcctcctacaagctgcggacactggttctttccacatcagttggacagggatgatggggacaataatggcacctacatcccacagtgcctggaaagcccttcctgcaatgggcttgagtctggcccttcctagcacagtaatcaaaccagagttatagttatttcagcaacagctaccagttcctgactgtgggtatcgtggcagaggtggggaccacaatcaccgccttcatggggcccggatctaggcagacaccaccccgggaccagagagctggattccagggcaggtgtgggaagagccccctcgactcccttccatggtgcagaggaagggggctgggggctgtggctcagctgaacctgcgggcctacctgaaggtggcggcggttgaaccagggcttgtagatgagggaagaggctttggccaggggtcctggggaggaatttcaggcacagactggagtaagcagaggcccctgagacccccatgcatctcaggggtggggtgggggctgccagcagcgtggttagacttgagccataggatgggaagccatgggcttgtccaggtgacagccgccaggggacacctgtgccctgctgagggccggcatcatggctgtagctgttgacccagtgccaagccctaggcccgccccttggcctgtgcacggtgaccttggcccaggagggaaatcttcaggatccggaacgctcctgtgtccctcagtccctgcagccccttccccagtgagtcctgggacccctggggttggtcttgctgcagctgagtcctgaagggagagggaggtttgatgtcatttcctccggggagccacctggaaccccccagtccgggtgaaggacgttggggaatagaaatggcttggagatccagacaggcgggggtcgcggccagcagagggtggagaccaatggtgggggctgttcagaggggacctggctcactggccttttgggttttaggctgtgactgagcctggtgctggtgtgcagcccctgctttgtggggcagtgatgggaatggaacaggggagtgagaatcccacttggcccatgaggaagcccacgtcctttgcaggctggtttattccttgcctggccaagggggtcaggcagggggaccacaggggctcatgggtcttggggcactgccttatcagatgcagaggctgggcctcggtggagggaggggtcctgagcgtggcaggggacaggagctatctgaccataggacacgagttcttttccttggccacctaccccaatcttgttctgccaacagctatgcttcctggggtttcctgagcagatgcaacaaaaacaccccctgctgctcaggttccccatgggggccgccactctccctggcatcccctcttccagaatttgctttagatggagccacacaaacagtactgtcccctcctgccctgacctgagcaggccctgtgggggctggagggcccatccacggctccttccccaggactgggtgcaggtctcaggagaagctgcagtggaagtggctgctccccactgaatccctgcatctgtgctctttgcctgggtgtgcccggccaggtgtgggaggaggagccttccagggcagtgcgtcctattttgactcgggggtttcaggatgacttcctgcgggcagcctccagggactgtccccttgccaggcagaagcaggatgtgtgggaaggcttgacattttttgtaaagcatgcatttattgcttttgagctcattaaaattgtggattgtttttgtttgaacaaacgagtgaatttaagtttttaattttattgctttggtgccatttccaagtttttctgtaggggtagaatcgtcttcgtgcaacgacctctggtcccagccatgttcttcacctctcccaagtctcagcagttgtcttcgaaggagccactacattcgcacaggctgctcttggtggggaatgaaatttagttgctttataattttaggtgggggaagcgctgcccctgtgtcacacatgtaacttgggattataggagtggctgaagtggctaacaggaggacacttcaaagtcccttctctgatgcagaaatctgttctagactatcttggatgagtatgcatctgtccctagcttgcatactcccagtcatggggagctccctacctcaccgggctatggctggctggctcctcttcctgagctgaggtggacatctgtatggcagagcctgagaggaggcctgtgcatcacagaagctgagctctgccagccaggcagcccttccagtgactactccctgagtgctcactctgtcttctgctggacaccagtgtggcccagtcctcagccacactgctgcagtgtcagggcagttgcattggactcaccagggaaagtcagctggtcctcccccaggagggcagccatgtagcgggcacggcagggacaagggctcctagggagaggaggctcagcgcagtcagtgaagaggtggcagcgaggtatcctggaaattgggtgtgtagcagaaagtgcggggggggcaggccagagcgctggggcagagcgggaggccaccagcttctggagaggcccaccgtgtgccacacctttgctgggcatgtgacagcaggctccggtcatcgacgctgtccaccctgttccacctccaaaacagcaatggtcatgatgcccatttcagggggctcaggactgctaaggagtgccaggacccagggccccaggtccctctagtcatctgtgctggcttgattgtctgggctgagccctatgtcctgccagggtgggctcttggctgcaggcgggagagcgctgggatgacttttaggagggcaggatgggagccccacagacagcagccccatgcggtgagggcaccctgagagtgggtgctgggtgcagctgcaaggtatgaatgagctgttcctgcagggtccgggcccagggttctcaccacagcacacaccgctacccccaaaagtacaggtccctgggcgtctggacccactggaaggcaccctggtcagagcctcagggatggagaggatagtgaacctgcctcacctcctcgtgccagaccgcttcttgatgccaggccctgggcagggcgattccctggtgatctcatttggtcctaagaaaccaataaaactgaaacacacatatgaaaataattcttaaaaacctgtgattcagcgataaatatgcttcctgactgatgcattcaataatgagagctaccggtgggcctggcacctccagtgagctccgagtgacggtgcacgtctgcaatgctcaagacgtctgcaaccgcagaacgtggcatgaaaatacagcttgtttctgtggatgacgcagcaacaagaaatgctaaatttcagccagagggcggtagaaatgaagatggtgggattttccccatccaggttcttggaccctcctgaatttcactcagagctgccaaggtttcaggagtcccgtccagggttgtccttggccagccccacagggcaagaggggttgtggttataggatgcacaggccctggtggcttggggcgcgggtatgtgactgggacacatcaaagaaagtacagtgctccatgctaggtgttctgatgctaatgagcaggggggctgtggagcccagcgaggaccccaacccaatctagggtggctaggggaggaccccagggctgttctcttgaagaaagtagtgtggggtgtcgcaggctgtgggaccagcacatccacatcccagcagccttactcaacttggttcatccttggaatgggagatgtacagtgcgtcaggggctcaggaggtattttggggtaggatgagaggcaggtaagtctggtggcagaccaggattctagtcacaagccctgccgctgatgtgccagagctgggatgctttacagatgggaaggtcgcatgcatcacggcctcagaacctcacagagcttagcatggtgcctggggtagagacagggcattttggctggggatggagagggccctgagcccaggaggcccaagatctatccgagcctggcctgggaggtcagggatgagccagggttgggtgtggtatgaagcaggtattggctcgccagggctgcttggcaggaagtggatggaggctagtatgggaaccaggcaggcccccactgtcactgggccctggccttcacagtggatgacatggatgacatctccatgatggggcagagctagggtccttagcgcatcttgcagaggcaggccctgagcccagagaggttaagggccagctgtgtagtggtgctggtcttcctagggctggcgcatgcccctgcagttagcacgtgggcaggctggggaggttgttctgggggcctcagcctggtccctgccatgaagtctgacactttagggaagctggggtcttgtcacccagagactgggcttcagaagcagcaggaggctgcaagtcctgacacgaatgtgctttttgagccttttcttgtgtcacatgtgggtctgccccttcgtcacatgccaagcccagactccagacccccagcgctgggctggggagccatggctactgcagggcaaatggctttgcaccccagtccttgtccttcatcagttccttggctcaggggactttctccagctgtgggcctgagtctccacgggtgctttgggacagagaagggagagagctaccctgtgttggtcactactccccgccagacagcgtgccaggcacacttgcaaaatgagcagatgcaggcagagcacccggggccacatcttggcgtcactacttgctagtggtctccaccttccatgcctccatttccacttctgcaaaatggggatgatgctggaactgtcccaggggattctggtgagcatcaatgggctgtttcacagagcgagtgctcggtgagtggtaacagctgatgctttatggatgaggaaggtggcacagctggctcctaggctccaaagctcaggttttgtccagaatctgtcagaggtggcagagactgcaggaaggggcggcgcaggagtgactgtggcaggtagcagtgaggggcacaggggttggctacggcctggcggtgtgggcctgggggagggtgggatgagggacatgggtaggaaaaaggcacgagaatggggatcagttggaggctgatgctggaggcccagcaggagttggactggtgaatgggagaaaggggcaactcaccagagagagctggtggactcgctccaggcctcctgcgttctcagctaattaaacaggcagagcggatgatgcctctatgtatcatgtgtttgggccggggaacctggggactcccagggaagccatcccacagcgggtgctgagccagctgatttgtaaggaaaactgctctcccagctgggactttgcccggccccagagcctgaggtgggtgcaggtgccctagattagaggcacccagggaggctggtagggactatccccagacaaagcagctggcacttggctcagggaaagtcaaagggacccagcgaagctccctgcttctggtcctgcagtagcctgtgtgcccctctcctcaccagccctgtttcctgctctggtttgagttgaatgcaaccatggaaggtgttgaacagtgaaggcatggcctaatcatggccagacaaatattctggaagaatggctcccccaccaagtcttccgtagctcctgttcattcatatagtcacctgtatttggcacctgctgggtgccagatcctttgctggtcattgggaattctgattgacataggcttggtaattcatgacctgtgtggtctcatcatctgcagctgtttgttttcatgtctgtaaatatgaaataaacggggacgtacaggtgaggagcaacttatccatgtcatgtcttcccacgttcctggagatggggacatttgggttgagttttgaaggatgaataaggagcttgatgtcttccctcgttctgccttgtctgcttgttagagagattccagctaacggtatggggatgtggtctaacatacttcctgttctcttattccacagatgaggacacaaacccatggaggtcacagcagtgagtgctcagtgagctcagggaatatgtttgacctgcacatgtgttggtactagcacagcttcctcacattctccctctgtctggccaaggctgggatgggaagaggggcatggaggaggcatcagtggcccagggaagtgtggggagtgcccaggggtgaggtctgctgctgggttcaggccttagacatattcatcacctcctgaagtttcctcccactccccttactattattgtgtgtgtgtgtgtgtgtgtgtgtagagtaggaatacttaagatctatccttttagcaaactttaagtattcaatacagtattgctagctgtaagcactgtgctatataacagatctccagaaggttttttgcataacaaactttgtatctttagactgtgacctccctgtttccctgccctttattaaccactattctctgcttccatgagtttgactgttttagatgacgtcatttagtatttgtctgtctctggctgattgcacttagcataatttcttccaggtttatctatttagtcacaaagagcaagattctcttcttcctctttttattttttaaatttctatctgtttacacttactctttggtgagccattggtctcacactttcctttaattcatcagacatggttcttttagtgctttgaacatccttatggcacttggtcaccttagtagttggctgatgactggacagatgtccttaaatgccttgcggtctctgccaaggaagcctatgtgtgttggggtatgcggtcagcactccgacatgcaggtcatgattctgtcttcaccttcccttcctgcttgggcacagtctcaaggtcagctggaggtgagatgttggggccatgtcaagtgcacatgccttgtacatgcacacagccttttaggctcccgggagtatgttgtagctttccaaagcctcctttgaatctcctattcccatttttcctttttgtcttttggtcagcctcttgttagacctaagtggtcatgtactttggacagctgctgtgttaaaacattgcctttgattgttttcaacaaatactgccctctcactgaatgagctctggggacagagcttccagacaggagtgacccttccatggccaccaggatgctgttttcacagctattgtgattgctgtgctatgggtgttccaggtcaccttggagctgaggcagggagataggacaagggcaggttcaaatgccataaacctttcttttcttcctgaaatttagtcatttttcttacgtaaacacttttccagttgttacaagacttcagctaacttccagaattcaaaaaagttgatttgatggttttgccagtgttctcattgcttttctggaagagttgagttcctgggggtcctcgctctgcccttctggaagttggctaaagttttcttctggaagttggctaaagttttgtgacctcagaaagcacttttagcattgggtcagcagcaggagctgagtctacctctgctgaaaggaaagggccatagggaagggaaaagaggttctgcatctggacaggcaaatggcttaaggagtgactctatccttggcagggggccggggtatggggactggcaggtcccattcatcccagcctggccatgaccatcaacacaccagcgtgagaacagctgaggtgctgggggtcagagaagagggcgggcatctcagtgtcaccacttgagaactgcgtgaactgtgacagggtacttagcctctctgagcattccttcatccaggagaatgacagccatcatctctagcagttgggcatgacatgagaagaagaatatcattggtgctgggccaataaaggctggtcttcatttttgaaactcctgcaatgcccagcccaaatcctggccaccatattggtttctggtctttgtacatggaatgaacagaattccaggggccagaaacagtgtgcttttggctaaaacataaacgggggtctaacagattccctatttagcctgttaaggtgaagacatgccacatctacttgaagcttatgaggaattaaaaatgtttatgaagaatttttattggcaatatgatagcacacacattttctgataagtagaaaaaaagcaggctctgttattacttctataccacctcctctcagccatagaggagaggtattcaggaaaaggactagcagggaatgtaagatgcttccaggctgcctcctgagtgggggggttgtgggtgattttttttcccctgcttctttagctttcttttgtgattctcttcagtgagcaagtattattcctatgatcagcaaattacaaaatagaaaaatctaaaaagtagaaaataaagacaggtggctgggagtccaggagataaattaatcaggcttatagcagcaggctttttccatttcttttctggttttgtgtttaggtctctcactctctgcaaggttaggtgacttgcccaaggtcaaatagctgatacatgaggtgggctcaccaggacccgggtcttccctgttatttcagagtaattatgaccataaaagtgtccctgtcctccttccggccctggtcccctccgctggccctttggggcagggctaggctctcctcaggggacagtgagcaacgctgctatgtcacatgtagaaaatctgactctgccctagcaacgcagacactcgggcctccgttttcttgttgatgatacgggatagtacctgaacctcctacagttactctgctgtttagaacagtgcctggcaccctaacattggttgtgctcttctgtttgctcatttatttgtttaaacaatttttgatgtggagctactatgtaccaggcagcggagctatgcatggcagtaaaacaggctctagaatgttctctgacaggactgcctgctcctgctcccggctggctgctcaccttacccttcaggggtcctcatgcagcaggggaacgacccagatggtgatctgtgagaatccactgatgctggccctagacgcctcgcaccacagctgtggaggtggctgcccccgcccgctcatcacccaggcaacacccttcagatgaagtcccagaagctctttgtaaaacacccaaggaggggccttgtcccctaacggaggctctcagggcaggcctcggctgatggctgttgtcttcctcctgctcccctcaagccaaggattccccttcccctcagtttcaatcaagggtaaatgatctcgggaggaggcacccgtgcgagcctcccatgtctagctgtttggggaacggttacctactaagtgccaggcctggccctggggacctggagacaaattggggtctgagccatcctcaaggctctcctgctgctctgggcaggacagtccatcccagcagggcagagctggccctgccctcatggagaatccaggcagcttccataaaaggggctcctgaaaagaggtgagcgcttgggggcatctcaggatggtgccatcctgcagggccagcaccagtggacctgcggattgagggcagtgggggctccaggaaaggtggattgggagggcagacaagaggctagggaggctgtggggcaccatggcccacccacaggtgcatctggatgcctgcctttcccatgaggggtaggttaggcctccctgagccatattccctcaagccagtaactggagctgcttgttggctgcccccttaggtgggcacaggatctcctcttcatcagggaatcaccttccccatgagtggcacttacctggtccctgaagccatttaaacttgagacccaacagcctaaggaaaccaagtagtaggggctccttgactcaggcccatgagtccaccgtgctaagctgtcccagccctgggttgagggacatgggagtgaaccagcaggcgaggtgtggtatgccaggaggactgctggtatatataaggcctgtatgcggcaggcacaaatgccctggggcggagagcagaagaaacaataagtggatgcttgggacaggctcgatgcgaatagttacagggcttctggggaaccaaagggcagattgaaaggctgcaggctccagggagaggcccccgcctttagggaggccattccccttgctttgtgtgtcgtcgtcttcacgctcgcagcaggcctcgggggaaggccctgtgtggtgttggttgtctaggatgggagaccaggacacaaggtactgaggctgcacagaccgagagcagctgggctgagctggtgagcctcgcgcagcctgggtttttccactctgctctgcagacttggagacacctcaggttgctgttatgtaagggagggcctgggagagccgggcctctgggctgcgtatgtacatgtctgagtgtgcctgttgagcgtatacgtgtgtctgagtgtgtgtgcatgcgtgcctgcagcattttcggaaggaggtcagcaccgtagttgtgcagcaatccaagactgccacctattagtcgtgtgtccttgggcaagggacttggctgaaatcatttgttcctcacagctccaggaggtcctcatgattgccatcgtttggccaacaaggatactgagtgactatgtgccaggcagcattctaggccttttacaagcattcacatttattgcatgtttactatagttagataaggagtgaggagggctttcaatcttcaggttaatcttgcttctcttataccttagctacatgcctcaggccagatgtgtgtgtgagcatatctgtatgtatgtaagcatgtcatgtgtatattcgtgtatgtgagcgtgtccatgtttctgtatacatgtgtgtgtttgagtgcctgtgtgtatgtacctgtgtctatgtgcacatggcctgtcagcgtcacacggcaggctgcaccctgccagatcgccccactgctactcgtgtccctgagccctcgttttctcacctgttccatggacgtgactgcaccaaaccgaggggttcttctcgcatgttgttgaacaataagcggggtgggcctgtctgtacgtctttgctctccaggttcaacttctgtgcttgtacagaatcatcttaagtacatgttatgagctaggtgcatagcagctgtacccccaaatgccattggcttcatgcatcacgggttactttttctcttgcatcacagccactgtttctcggcaggggctctgctctagctggtcactcagaacccaggctcctaacagctggaggcaccatcccaccttaggttctgaggcttctatctttagggagggagcggggggaatgggagcagggagagagaaacagaggcagagacagaaacagaaggtcagagagagaaaatcatacggcaggttttagtgggccaggcctggaaccctgctggccagcactgagtcacatggccatgtctacttgcgagggactctgtggcccagctgtgtgcccaggagcaggaggaggtcacatatgtgggtagacactgtctgtctctgctagaacccacctgcttctgttgcttcctgagaaaatgagcatccttccacgcgggaggccctggtggaagccagtttgctgccatcagactccagcgtgggctgactccgtcatcagtgtgcactgagttcagtgttaacagtgaaaacatgctgtgaacaaggcctggggcaccccacagatcttgcctgctcctgcttttttgaggccctttttttgcatgatgtggggtctgtggtgactcgtgtcaatgaggcacttgctagaaatgcagaggccccagccccctacctcccatgcagaatgggcgttgcggcaaatcccaggtgatcccattattaggaagcaatgctttagaagtcacacatgcaacatgtcttaccttcatttccactgtcaaacctcccaagaggcatcgggttttatggttctcatctggtctggtttgaccggaacttacagctcccagtaactcggcattcaaggctcttgctcttctgacccatagatccttccagggtgaactctgcctgttccctctcagaccctgcaaggtgaattagccctacatgagaatccagcagaaacaaaacaggaattaaagtttgatttgatttcacttttttttaaacaaaatatatcaattattacttacagagggtattaggacctagcttgattttcagttcttctaccatagacttttcaaaagtcagccacattttatatatatttttccctctgtactttgttttttaaatttaggcttgtttccccacattttcttgtagtatttctaaaaatttttttggagtgggagaggaattatttagtggtgggaagaaagagtagaacggaagggagtgaggagaattttgctggaaaggggtggaggcggccagcaggaaaatgcaggtttctctccagtgcctgaccaggtgtgggcgcccagcctgcagccagggccaggctctgagtgcagaggctgaagaccacatcaggctggcttgggggcttacaaaggcaacgtgctttgcgcagggctagggggcgttttctcacccgtgccacagagagaataccactgaccccgcaaagggtatccccttccccagaaccagtgggttgaggaagggaaaatatcttagcgcagtccccggcccagcgccagcccacagtatctggtagtcgttattgttaccattatttatcttttgtcaatgctgaaaggccactgatggatggcagcttctgagaaaacattcatcgcatgacatctcatctatgagaaagaaagattagcgacttttcccagatgattcctgcgttctggacgcagtcaccggaaaacgtgggcggccgaccccgcacccggggccgtgtccctgcagtcgcccgagtgcccgccagagggcgccgttgcctctccggtggccggcgctgcgcagagcccctcttgcagggagcggagcccctgaggcacaggctctccgtcctagcggaccattcggctccttcctggcaacactttctaggagcctctttcaaaagcagacttacttgggggatggatgacctccagcgtctcgcaagagtgtgattgcaggcttctgtgtttcccagcctttgatattctgggggactgagaagggggtgtgccttgaccgcagccttctccacccaccctgctgtcggcctcctgctcaggacacacgatgtgcagtgcgcttgtgtggccctttcataggagaaggccttctacgcacctgtcttcccctctgtgtctctgggcaggcccaagtccccggacctgagaggttcacctacaccctctccgagctgccaccccaaagccactccgcgggccttccattggcagatatggtgcaggctcaggcctgtgtctgcagcctgtgcctggaggctggagtgggtggaagggtgtgggtggctaagtgggaccagcgagcgtcggatgttgctgctgtgtggctctaggattaggggctggcccaggcctgcatcctccgggagagaggccccggggaggtgggggcggcggcggcggcagagcccaggactctgcagagcatttccaggccagtagcaagcccctgcgagcagacccgttccttccagcgcccacaaagcctcgcctccaccacttccttatcctctgaggctcagcttaagagttttaaagcttagaagcattaaaaataatgctttttcaaaattggggtaaaatgcgcgttgcaaaattccctctttcaaagagtatagttcagtgtacaatttagtgcaatgttgtacaaccactgggactgagttccgagccgttttctttatccccaaaagaaaccccttaccctttcgcgccgccccccacgcccgctccccccgcaacccctaggcaaccactaacctgctttctgtccccataggtgtccctgttctggtgttcgtggactcctacaatacttgttctttcatgactggcttctgtcactcagggttatggactgaactgtgccccccgaaattcacacattgaagccctaacttccaatgtgaccgtatttggagatggggcctttaggagaggtaattgaggttaaatggggtcacatgagtgaagccctcatccatcaggtttaggattcctgagaagagtaagggatatggggacactgtctctctctgcaccatctggggacacagcaggaaggtggccccctcaaagccccggagagcccccaccagaaactgcatcttccccccctttcattgtggagttctaggctccagaactgtggagaaatcagtgtcttttgctgacgcttcccagggctgtggtataatattttgttatggcagcccagcttgagctgactaaggtttatctgcactgtaatgcccgtcaggactgcatctctctttaaggctgaacacattccgttgtacacatggaccacgtttgtttaggcgtctatccactgatggacgtttggactgttaagctaggctgtgaatacatgggtacaaatacttgtttaggtttcagtgacacgcctagatgtgaagttgctaaaaatgctttaagaacagatttctttggtgtttgggtatgagccaggagtggagaacatcttggggcacgctgtgtaggcctttctgccctccccaggggcgcccccgcatgcatctcggccccagccagcagagggtgtttcctgatgccacctggtgaggtcgctgtggggactaaaggagaagcacatgtaactatgacagctgatgtgtatcgaggctcagccttccaatccatagaaaggggatgaagacgcttcatttaatctcggctgggtcctcataatgagaagggactggggcccatgggaggtgaagccacagagctggaaagtggccgactgcagtcggagccaggctggccaaggccactgcaagcggtgctgggtcagtgataaccatgggtcaaccagggacgagatgtccacccagtgcaaccctgggccaggcaacggggctccctgaggctggccttcctcaggaaggggccctagggctctcctgagggggcctcactcaaggccctacatggagcagaagaggagaaaggccttcgtgaatgttgttggaaatttgtgctttgcaagttcatatgttttagaaatatattttatatatttagtccatttccccccttaaggcatcaaatgaagggtaatcaaaaggcaactgaagttctttttggaaattaataataaatcatatgaggaaattgctttcattaaataaaacaccaaatctgccaagatttggtgccaagcctgagaataagccagttgccagggctctgagggcagctcagggctggggccttggaatcctggagcgtgggtcaatgtggaagacgagggggccatgccctgcctggtcggcatgaacaagggcctcagtgttcccatctgtggaaggggccagggcctggggctcaagttctccatggcgattgtgggaaggggccttagattacccagaacgaccgtgtttgccagggtatggggttcctcggcacgctgtgcagggcagggctgaactcagcccagtgctggaggtgcttctatgttgcctttgtttgtgcatctgtgaaatggatggagccaactgatgattcttgtccctggtggcctcaccatgagggaggaaaggcaaaggagatggagagccgtgtatgttgtgggtctcactgacccccactcgcctcactctcctgccgccctcctcccctacaaccccagctctcttctgttctcgctcttccttcttcaccatttctggagcatgtgtggcctccgtttgagacagatggtctgtttcatcttattttgtttggcctgtgccatgttttcaaatgtttaattggacactaattagataccacattttaaaaatccatattttcggcttctctttaaaactcagaattgagtcaccctggcccaccgtcctggggccaggatgggagcagctgctctttgagaggccctggcctgccagctggccattccctgctcacagccctgttaccttccagcccctctccccaggacatacatatcagaggtagcttctaagagaaaccacaagagacacaggggagtgtgaattgcaaagtgctttgttgacaaaactgttgtgggttatttgtagtctggctagggtattaggatgtatactccaggttgggtgttaatcacttacagtgaaacgctggctaaagccaacatatttacaggggaacagaatgaactgtctgtgagctgggctcactccgggtaggacaggcttagaggcagggtgaaacatctctgtacagcttcccatctctgagatcggggtcgggatgttatcttctgtggctgagttcatcctcctgatagtgaaatgactgcaggagctccagacctcaccccctggcaccctccagtctggcaggaaaaagccgaagcctttgagtcaccagtcaagccccaaaccctgaggcttttgctgaaaccatcagagtgcctacaaagtactgttcccttcttggattgaacaggagaccaagcctgtgtgtggtgcccagtagaaataggggttgtgttatattgcaagaggaggacttgacacaccaccactgataccccttatccatgagagaatgagttgggaaaagcattgtcaagtgtaaagtgctgtgccactggaggaggctgcttcattccatattgcccttgccagaagggaaggttaacgcttagaggatctaaggtgtcttgcccaaggtcatagtaagcaggagatggaaccagacccagactttgggacccactgattcctgcccaccctacgcgcgacccatgcatcactttgcttttggtgtttgcagacgcctgggtttaaatcatgccgagttcattccggggcctgagcggggccgaagctcatgggaggatgagtgggatgcttgccgcaggcttccgtgggagccaggtgggaagcctgaggcccaagggcagctctcttctccagcctgctcctcctccaagccaccctgagtcattctttaatggaatttgtggctgttttaattcttaccggcacaaactttgcatgtcctttataaatatttcattctcttccagcaggaaatttctcagtgcctaaatacttgtatggccatctccttccggtgctgggcagcctgtcccagggaactgtgggctgggggagacagccatgggtacccctcacctgcatgacagccgctccagctcctggaatagccaggctccctgggagactggggttgcagtgacagaagagaaagaggcccagggagggaggtgaccatccacagtccctccgagggcacggtcagggctcaaacctggactggcctgacaccaggggctgagctcctccactccaccccactgcagtgggaattcaaagctcagcttgatggcttctggtcaagggctcaggtaagcggggtaatggcctgggcattcccaagtggaaggaatgggggtagtaatgctgcagaggcaggaggtaaaggccctgctctgtctacctctcccctgaataagctccacagtggagggcagaggttttaccctttaagtctgtgaaggtcactcatggtcaggtgtggatgtacctagattgccaggggggacatggggagccacagacagctcttgagcgctggagtgcaggagcgaggctggtctgcagtccacctggcccaggctgccctatttgcctttttccagtggggacagcccactggatactttgagtgtctttaattaaaatatggagctcagaacaggtgcctcttatggtctaacctacgtgtatatagtatgcatcttgcactactatgtcccatgtgcttagagtatctttaagtgaaataatgctgttcagaacaggagaagctgggaagcttctggtacctggtggctgccatgacttctgggaaatcttgcaggagccactggggagtggcaggtgtcttgaagtgagtgctgccttctagccacagctggtttttcggggagctccagacccaatagaaatgattagttttattttccttgtcctctgcctctctcccctctgggaagatggagcctattcattttttttttttttttcctgttttgttagccagctgcagcagagagatgaaggctgcttctctgcaaagcctctcccaggacagatcaaagagacccactaagtatattaaagaggccatgaaaatcaggctgggtgatgctgtgtcttgggcaaagctgcccccagccaccttgggccctgggcttagggattggctgggatttccaggcaggcctgggaagatggaagtcacttgcacagcaaggagataccatgtgctgccttctcctccatgctgggctctgggatctgcacagctgagtcaggagtgggctctgctctcctcgggagctcacggtctggcccaaggtgacccaggctgtgactacccagcagggccagtcagggtctggataggtgaggagtacagcctgtgggtgctgtcctgggagcccccagccttccaccagggtccggggctgggagaggcacctagtaaccggctaagaaggccctgtggaagcaggcaggctgtcagttcccttgggcccagacgtccttggctacagatccacatgggcacttgggggctggaaggtctgacccccaagggctgcacgccagcctgaggtggggctcggctcagaggctgcatggcccagctctcggtgaggggacccatgaatttggccagttctgggaggggccaggtgagggggctgattctcattgtgctctgatgcacatcatctgccccatttcacagatgaggaagtagaggggtcctcccagggtgctcaggagtcatagtgcacagcgcagagtctgctcaggagtcacagtgcccaggacagagtcagcttttccaagtgggctttgacatttttacaatgactgtcccctttccagatctgtagggcaggaaccccgtcaccggcctgccctgtcgagttgggcatcaccggcccccgggtgtcagttgcctctgactgtggaggtgggccgggtgaactggaggttctcttctagggctggcttcacttagcaggtgacctaggatgctccagacccctgggtggggctgccactcgaggggttggttccatgtgctgggacatggggctgggctgagctgggggttttcctggatctccttcaccactcacatctacccaccctgcctggtcctgggcactaccacctgttggcaaagctgagcaggccaggggagggcaggtgggtgggcagagcaggaccctggagcctaaagcactgagtgatgcaggggccagccgggctgagaaagctgggacagccactcaactggaaccgactgtaagctccctccagggtccctgaacatgccggcatcctggaatcttgggaaggatggtgttggggatgctgctgctgtgtgagcagtgctggaaaccaaatttcaggctgtcagtgctgtctgtcaccagcaccactatggttaacctcacacccagaggcctgactccgtgtgaccatctggaccggtaccaggtcccaaaggcaggcgtgtctaactcagcatccccctagatgtcagcaaaacaggcggtgaagctctggagatgagcagcgtgggctggctgcgtcccttgtgtgcaggggctttgtaccctgtgtgtggtctttgcattcctcagttggtggggctctggcttagggccctgctgttggctgggtgcctgtagggggtgccaggcatcgggttaggtaaggatgatgtggcctcttgcggggcggttgtgggttggcaaccctcctgcagcctcatcttacacgtctgtgaagtggttcgagtgactgaggctgcttggctagatctcacccgcagtcggaggcgcccctctgggagtcctggtttcattatctctacctttagtgccctgtgtgtccctcctgaattttgtgcagatccatttcagaagtctcattgccaaagggataagtgacccctttatgatgagggaagcgtggccagtggtgggtgggacttctgagattctgccacctctgtggtcctcagagatggagaaggtcaccaccctgtagtgcctggagggtagggggagggggcggtagggtattgtaggagcctggagtcctagagggaaaatccacctgggcatgtgtggttcctgagctcacaggtggggtaggaggtaaccaggaacagacagcctaggggtcacctgtggcctttccacatccatgccccagcctctatccgcacctgctcgtgttgggcactgggcagggctcctggtacaggctggctggagccccttgggagatttccaggaaagaagtgtttgtggaatcccctgtgccaagagcaggtcccagggcacagtcaatggagatatctgaatgggtaatgtatgagtagatgaatgaatatatcttctgacccctgggcgggtgatgctgggatatgttcatttgcagatgggaaaaaaatggtttctcaggacttgagctgtcacacaggtgctgggggaatgtattagatttgtacctcattctcctcttgggaagagcttagaggccatcttgtgtcacgtgtccagcatacatgcattttctatgttctttattgtatcttctacatacaatctgtagacatggtgtgtactactaaaacgtgcagtctgcagcatatacataggtgtggcacatacacagcctgtgtcatgtgtgttctacaggcgcacacactgcatagacaatatttgctggtgaatatgggtgcgctgtagttatatgtgcctcttggtctaatctatctgtatatagtgtgctactatgtcacatgtgccgttattctacacattaggttccaagtgtacactgtgtgtactctgaagtcttcatagatgccatgtatgtgtgttctgtacaggtatttgggaacatctgacatgtggacttaatattcgcaggcctgtttgtacacagtacctgcagtgttctatcataagcacatttgttaagcagaccaggggaaaacagatagtgtaacagggtctctgcaggaaatagcactctcacactgaatgattaataaatgggctatttataaattcttctcgaacacgtaggcaggtttggggggaagcaatgaggggtatgtggagcaccagtggagagctattaacatgccaagggtgcagttcctggaacttgtagagagtagctgctgtaagcccgctgacagatgcggctagttgccgaagtcgccctcctcttcccttcctctgatctactggggctgtccattggatggacccaactggaaaccagagggcaaagggacccttgatgtagctcccagggtagagagcagggtgtggctgggaacgcctaaataggacagtggaggataccctgtaccaccttctttttcctagaaggccttgggagtcccgaaacttgtctctcacttgagagggaatggtcctgttccccagaccactgggaccacaggaaatgtgttaatggggaagacccctgaacctcagcgctgttcatctcccatactctctcatgcacgtgtcttaccaagggatgtcctcgatgcagtggaccagtgagaaacactatggtgtgtcaatgatcaagttctttcatgctgtagtaagacggcaggagaattgacataagcctgagacaggacataccagtgtactgctgtctaagccccgtgaaggcaaactgcttatttttactagcaggaacagaagtcagggtgggggaccctggcacctggtatgcagtttttgacccagaaaatgccatggtgatttcttccagtaaatatatcacatgtggaacattaccacttaataagaagtttccaacaacctcctgttattctccagcattccagctggctttttttgtatcagctctacaggtgagctatatggagatatagtaggattcccacccctgcatcttttatatttaccctacttgtttgccaagatgtgccttctttcctgaagacttaagtttccatatggtgtccttctccccagacagagcagccttcagtaatcttattgtgtagatatgctggtaatgaactctcttatagttttacttcatttgaaaatgtctttgttttgcctttcttgaaggataatttctctggatatggaattttcagtgagcagtcttagttctttacagccgtgcttccactgcttcctggcctctgttgcttatgtttagatgtaagcaatattatattattgttcccctgtatgtggtatattatttctctctggctactttcattatcttctctgactttaagcagcttgactctggcgtgtggttttctttgtatttgtcctgcctggggttcactgaatttcttgaatctataagtttgtgtctttcatcaaatttggctattttttttttttttttgagatggagtctcgctctgtcacccaggttggagtgcagtggcacaatcatggctcattgcaacctccaccacctgggttcaagtgattctcctgcctcagcctcctgtgtagttagggctacaggtgtgtgccaccacacctggctaatttttgtatttttacaaaattagtagagatggggtttcaccatgttggccaggctggtctcaaactcctggcctcaagtgatccatctgccttggcctcccaaagtgctgggattacaggtgtgaagcactgcacccaacctaaatttggctacttttggccattatttcttctttttgtctgattctctttccttctgggacaccttttgatattgccctacagctccccccaggctttattttcaatcttctttattcctctctgctcttcagattggataatttcaattgatatatctattatttcagcttctctgtttccccaccctgtcctttctggcctaactttgtcatatcatctcttctttcataaggactaaggggtttcagaggggtgtcagagctcagcgctagctgggattgagggccagagaggatggggggaaggccttctggaggcaaacatgtgatgtcatttttcaagtgagagtttggcccatgggggtaggtaggttatggcacatattcacaccaccggagacagacagactgagccacaggcaatgaagccctgatggagaagtgtgagctagagccgtcagaggcagcttcatgcaggaaggagcggcagaggatcctggggtctggtaggtccctactgtgtatcagactcttggctcggagctgtctgatctcggcggatccatacaacgccacctaagaacaattatgccatgtaacagataaagacacatgggtttgaaaaaacttatggaacccaaggtaaagcagcaagctaagtgaccatgaacatgtgacagggtcccatcagggaaatctatcttgatgggcaggattttagatgttggaagaccaggtacatccttcaaaatttctgtccaaaaaaacactgtccatgatccaggtttttattctgggtagtgttagtcccacagtttgaacctactgagtctcttgttccttctgccatattgggaagatcccatcctggctctgacattgtcactgaccagcttgggtgaccctgcagctgacttcacctattcaacatcattgccttcatttcgaatgtgaggaaatacagtcttgacttggattccctgcagcaaccacgcaatgaagttgcatcaagaatttcaaaagtgcttacacacataaggtctttaagggttgtttcctcatttctatccaggctccattcacagagtggtgcaaatttattcattcctttattaaataaatattttactttctaggtatgggggaatacagcagcgaacaaaacatttttaaaagtatgcatttgtggcatttacatctcactctacaattgcctctcttgattcaaagtctctgcttttgagcctcattcttggcagttgaaaactctgggctgaaatcccaactctgaagaaatcaagctaccctgctaactcagttttcttgtcagtggggttggaatcattatggttgtttagaggctagaattaggtgatgtatgtaagaggattcagcactgtgcctggcccatggcaggtatcattctttgaaaatccactcttcatgtcaatccatagtggacatagagaggtttctcccttgggcttggtacttttggagttctcttagtagtgaatctgcttttttctttttaaagcctttatgtggctctaagatggcattcgaatgttcctccatcccctctcagtggcatagtgcaagtgacattggttcttctttttctcttcccttccatcccagcacatcccaactccctccctactgaaatgttcctacccccctgccatcccctaacctcatgtgacttctgagaaagtggctctcctttgttctcctccctccaatatatggccacgcccctctaccctgcagaggaaattcccccagtaccaggtccctctgcattgcactgcactgcaccaagtcgaccctcccttcccccaacctctagacccctcctcacttgctctctctgttcttctcatccccttcccacaggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggtgtggggagggaaatgggacagaaaagtcatttgtcatagttggtgttaatttccattggtccaactcgtcttttcttatttatttattattattattgtcatcattattactttctctccttcctcctttcttggtctcttggtctcattttcccccacctttccagccagacagagcaggccaaagggaaatacaggcccatcctcctctgaaactcacatctgagcatgaagcatggatctcctccttccttcccagcagactatgccttacatttctcaccccacccaccccatcatctctgcagtggttttcccgggacagatgtgagaccaagaccacggagacagagctgagaggatacccaccccaaagctgcacatcacgctcagccttcaatcgcctacccttagtggtgtctctgacctaactcctttctcttttcctaaggactgagtgactgtgtgtgtgttgtgtgtgtgcttctgtgtgcacgtgtgtcgtgacaaaacgggaagtattaggtattccgttttctttcccatcacacatcatagcctgcttttggctgcttccaaacaaaacgggaagacaaaacccacaaggtttttgatttatcgtattttgccaaatcaagcatgtttcattaagcagttcttatccctgatgtgtcatggccatattttctaaatgctaggttctaaattatattaatgttttttaggggcgggtgggcaagacgacccaaaccatcttagcttgccagttcagacattttttaaaaagcatgcactttgttaaactggtatgcgctatcaacaaaaaaactagaaatggaataatccaaagccaataacattaacttataaaagacatttttaattttgtcacctccagttccaacaatttaccatgcaactggaattgtcaggggaaacgggaaaattgttggaaccccagagtatctatttccctcttattgatgattttgtgcagcacctaccctgcataaataagaattatagtgttggaatgcttgggtgagaatgggtattagtatgtggctgtggttccttttcctcatgaaaattgacagggcattcctcattaaaaatacatatctatttcaagaaatatcgtctctaattgcatttgatttgtaaatagggtaaagttcacattggtctcaggaagagtttagaggcaaggagctatgtcttggcctactgggaacttgccaatctcaggggaaaattttgtctgagtagtgtagaaattcctccctactctcaataggggatgaccccaaagggaagacctgctatcctcttgggggaggtggtggggtagttcaggctgtagaatatggcacagtggaggctcttacagtaacaggcttaaaggacagtttgacctccagattcactgaggggactttaatttccctcattaccatccctgccattttctaaaaatcacccattcatccatcctcccattcctcttttgtaaatgaagttcatggctcttgcatggaaatggaccttggctatactcagaaggaacacggtttactggcctgtctcaaggccccaacgagatctcccagaaaggaggctttgctccctagaaagagtagacctacaggatttcttaaaggagacaacacctgaatgccaccagtcccaagcatttgggccaatgggctgaaacactggagcattcaagactcctctgaaaaggctgtgcatgtactttaatgctacatcccatgttgaaatttccccttcgtccaggacacagggccttcgaaggagtctgcgaacctcagattctctaggccaaagttgacagttctcaaccttcaaggtctttattgattcacttgttttaagattttgtttaatgggaggccctacttggggctctaaaatctgtccagagaatagcagcagttcaattttttttttcctcttggatgagattgttgactctagg

SEQ ID NO: 13503 - DNA, 34047 bp, Human
  misc_feature (1)...(34047): n = A,T,C or G
ttggtgaagtaatacccgcaagatttatccattgtaaaggtaccctttcctcttcatgagacttggagactatgtcaatattctctcatatatttacgtgttttaatatatgtaaacctttcactgaatggtgttagaatccactcattagtgacatttccaattagagaaaacacagtacatctataaagacctactgatggtgatctgcagtgggaagttgtgatacttaacctttcttaaatatgtagaggcaaactgaatagaaaactgtgtacaaaaatgaacactctatacatgagcatttttttttttttttttttttgagacggagtcttgctctgtcacccaggctggagtgcagtggcacgatctcggctcactgcaagctccgcctcccaggttcacaccattctcctgcctcagcctccccagcagctgggactacaggcgcccgccaccacgcccagctaatttttctgtatttttagtagagatgaggtttcaccgtgttagccaggatggtctcgatctcctgacctcgtgatccgcccacctcggcctcccaaagtgctgggattacaggcgtgagccacggcgcccggcctatacatgagcatttgtgaagcttgtctaagatttgtacatttgattgcgtggatattttgccttaaaaagaactgtaaatgaataatgtgtgctgatgtgttcatgggtgtagagtactaaggtctgcattaaaaagataagatggtttgatggaagaacaggtggatagcaatatagcaaaatgttaacaattgggtcgatatgtgtccactgtacaagtcttcccacttttctgtaagtttgtaagttttcataatacaaatttggatttaaaaacaccccaacattgcaagagtgtcaccaaagtgtttgaaaagcaggattctagggggggcattcgctgacgactcagagaaaccgtccatgccacccaccacccctacgcactcaaaagaagccctcgctaggcagcccggccctccgagccctggtatcgaggggctctccgcctctcccctgccgcggccgcctcctgcttgcccggcctcagtctgttctcagaacatactccatcacctggttcccagaactcagattgcgcagtggtctcgtcatcatcggccaggactcacagtgcccgcggagaggcctccctagacctccctcccgtccagcctcacccgctgcctactctcctcacgcccctgctccaggtcccctggccccatttcgctcgccacgttttcataatcctctcaggctccgggcaagcggcgccgcccgcaatgggacctgatcatataaggaaaatactgcgggctcatccgggggctgcaatggggacccgaaagcgccctagcctactacaatcaccgcaccccaactgccgcccacctctctgccctgcccccagtacagtacccaaaaccggtccgggtccagctcggcggcccaagcctctgcccagcggactgcgcacccgcccgccccagccaatcccgccgccgccgccgcgccccgcccacaggacgttcggtcccgcccccagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgagcgcagccccctcctcctctcctcgcccctcggggtcctgccctccccaggccaggcctccgcttccggccgccgcggagagtcggggtcgtggggtgaagttcactcaacctcctcggttttggagcggacgtgataaaaacccagcccgaaaggcttgtttgggttaaggagaaaacccttacttgtaaggcgctagcgacagcgatttcggtgcaatttcctgtttagttgagaccaaagtttgcttgcatgtgaccttggaggtcattcctttcttcgcctaacagtgaccccactagttcgagtccaagtattagaaaaaatggggcggcgccataggccgcgggcgcctgctgcggggcagctgcgcacaggagcccgccgctcggcctcggtggtcagggctccccgggtgaatcgatggagaggcctgcagaaatggtagctggtgttctgctggaagacctgccctgctcccatttcccttctgttgctttagattagagcggtcactctatacctaagttctagggttatgaacttgtttaaaacaactgtgtaataaactcccttttcaaaacaagtgggcacagtcaatggaatcttactttaaggatgtacgagtcgaagaacattgaggtggaatacatatcgaggccctgagacaggaaaaagcttggcaggatctaagaaccaagcattttggtgctccagggccctgtgggctctgtaagaaggtggggttttgttccaaattcagtggaaggcaatacagggatttaaagcggggtaatgacaggatctgatttccactctgtccgaatttggggcggtctgtgtaatggcgaagagaccatttaaggatctattgtagaggtccagggagcagcaaatgatggctttgactcgtgtggggcagtgtaattggggagaaaaggggagggatgagttgagatagatttggaggtggatttgatagaaagtggattggatgtggtggagtaaatataagaaggaaatgtcgagaatgatgaaaagtgtctggtttgatgaaccgtgttcatgatgatgccacttacagagtgaggaaaattgggaaaggaatagatgtggaaagaaggattgagaattcagttttaggcagaaaactttttggtgcctgtgaagcagccaagtggagatgccagctaagcattggttagggggatctgaaagtgagaagaaccaaagtggcatgggaacaaatcaagggaaaaatccgtattctgggaccaaatgcagtgtttacagtttcctgcaacgtggatttcatttgccagtgcccttcctgactgaatttactacatttacttcataaagcagcgtggtgaattttttttagacgaggcatttacacttcatttaaaaggtgcattgtcatgagctatcttctaaaaaaggaaataatatttttactgatatcattttaatattttatcagtggttcttaccctttcttataatacagacctgtttgaaaatttcacaaatactataaacccaaaaaggaaaaaaatgcacattgacacctgtattaaggaagtataaagtttataaatttctggtacaatttactgtagtgttagagctagtgattgtatttttttccatttccttattgtagcaattaggaggacactcatgtcgagagaggtaaagtggttgtgtataataacacaggtagttagtggctgtgactagaacccaagctttgagcttgaaatagtgatgttacaggccagctagaatcattaaagataaacttctctcaagcagcataccaagtgtttgcaggatgggtgggaagaaagaagagcatgtgactgattatagggaaaaggacacatttgagttaaattttgttaaggattaacattaatttgtcagatttcagtcaacaagaagaaccggctcctaggtttttattagcacccatcccagtacttggcaggaggttttcgctcgacagatcatagctctcctactgctcctagctttgttgggaatgtttgtgtattttttcaaggcaagtagacagggctgctaaattaccttaatcttgaaacaactggatgccaccgcagctttccttaatttgccctcgttgctgcctgaagttgctctaagtgaatatttacctaacaatgtgatagaaaggtagtgctcctgtttctttcctagtggtgcttttcctgtattgtcaactcagcacatctttccagggcctttcttggagctacttggactcactacactctgggttaataggtctcttcactgtctttcagttttgggaaatttttagcctctgaattttcagggtgttcaaatgagatttcagtttggtgttaaagattgttaagttttagaccttttagtatccacgtaaaattgacatcaaatgaaaattgacatggtatacaatttatgaaattaaaaaaaaaaaactttaaacctttatagtctatctgcacatcccagattatttgttaaaatgaagatttaaaataataataacaaattattttttaaaatagagaaacccagtctctacaaaaaatacaaaaattagccaagcatggtggcactcgcctgtagtcccagctactcgggaggctgtggtggaggattgcttgagcccaggaggttgaggctgcagtgagccaagatcacactaccgcacttcagcctgggtgacagagtgaaaccctgcctccaaacaaacaaacaaaaaaaacccaaaccaaaaatatatgattgagaacattttctctgttcaaaataattgttttagttcagttaaggtcttacttgagctaacctttacagtctgggagcatcaaataagaagtaatataggtaaaggggaggtttttttttgtttttattttcccatgcacaccctttcctttgtagatattgcatatttcactactagcactgccctatcaaatgctttcttagaatatgagacataggggagaagttcataaaaggaactttgtagagagacaaatgaaattaggctctattgtttctgagaagtgaggggtcatttccatgtgtgcaatatgtcatttttatttctggatgctttatatatttttgttatctttggatttcaaaagtttgacaatgatgtgccaagctgcaggagaacggggtgtggagtgttacgtgtggtgtttattagagttgaggtttaccaagctttaatatacaaatttatgttttttatcaaatttggaaatttcttctttattatttctgcaaatgtttttttaaatccattctctgtcctctcctatgactgtaacttgttagtccttgaggttctgcccgtgtttttttactatccgactttaaagaaaaaatttacaaactttgtttttgagcagatttaggttttacaaaaaaattgagcagaaagtacggagtattaccatgtgctcccttgcccggtccgtttcccctattattaacattttgcattagtgtggtacatttgttacaattgatgagctaacattgatatattattattcactgaagttcatattttgcattcaagttcattcattgtattgtatagttctatgggttttgacaaatgtgcaaatgaccgatgtcagtattatagtgtcatgcagattaatttcaccaccctaaacatcatctgtgattcacttatttatccctgtctctgaacccctggcaagcactgatctttttactgtctccatagctttgccttttccagatatcatgtagttggaatcatacagtatatggcctttccagactggcttctttcacttagcgacatgcatttaagattccttccttttatggcttgatagctcacttctttttattgctgaataatattccattgtatggctgcaccacagtttgtttatccattcacctgttgaaggacattgttgtgggaagtcagggaccctgaatggagggaccggctagagctgtggcagaggaacataaattgtgaagatttcatggacatttatcacttccctaataatactcttaacgcctgtcttactttaatctcttaatcccgttatcttcgtaagctgaggatgtacgtcacctcaggtccactgtgatgattgtgttaactgtacaaattgattgtaaaacgtgtgtttgagcaatatgaaatcagtgcaccttgaacagaataacagcgatttttagggaacaagggaagataaccataaggtctttactgcctgcggggtcgggcagtaggagccatatttttcttcttgcagagagcctataaacggatatgcaagtaggagagatatcactaaattcttttcctagcaaggaatgttaagaccctaggaaaagaattgtattcctggggggaggtctataaatggccgctctgggagtgtctgtcttatgcggttgagataaggactgaaataccccctggtctcctgcagtaccctcaggcttattagggtggggaaaaaacgcttcttggtaaatttgaggtcagaccagttctctgctattgaacactgttttctgttgtttaagatgtttatcaagacaatatgtgcacagctgaacataggcccttatcaggagtttttgattttgccctttgccttgtgatctttgctttgtcctttgccttgtgatctttattggcctcagaagcatgtgatctttgttctcctttttgccctttgaagcatatgatctttgtgacctactccctgttcgtacacctgctccccttttgaaatccttaataaaaacctgctggttttgtggttcaggtgggcatcctggacctaccgatatgtgatgtcacccccggcggcccagctgtaaaattcctctctttgtactctttctgtttctcagaccggccgacacttaaggaaaatagaacctacactgaaatattggggggcgggttcccatgataggacatcgtggttgccttcaagttttaacaattaggaataaacatttgtttgcaggtttttgtttgaacataagttttcaaatcatttaggtaaatacaaggaacctgattgctgtatcatacatatggttaggtgtgtttagttttataagaaactgccaaagtgtcttccaagctggccataccatttgcattcccaccagcagtgaatgaatttctgttgttccacatcctcaccagtgtttggtgttgtcagtgtttgggattttagcctttctaaaatccaaaagactaatagttgtgtagtagtatctcattgttttaatttgcaattccctaatgacatacaatgttgagcatcttttcatatgcttatttgccatctgtatatcttctttagtaaggtatctgttcagatcttttgcccatttttaaattgggttgcatgggtttttttttttttttttaattgctgagctgtaagaacactttgtatgttttggataccagtcccttatcagttaggtgtttttataaatattttctcctagtctgtcgcttgtcttttcattctcttaacagcatcttttgcagagcagaggttatttattcatttgtttttagagggtcccgctctgtcacccaggctggagtacagtggtgtgaacacggccactgtagccttgacctcctgggctctagcagtccccttgcctcagcctcccaagtggctaggaccacaagcacacaccaccatgcttggctgatttcttaattttttatagagacagggtcccatcatgtctcccaggctggtctcaaactcctgggctcaagcagtcctcccaccttggccttccaaaatgctgggattataggcatgagccactgcacacagccagaagttttctattttaatgaagtccaacctaagttttcccttcatggatcctgcttttggtgttagatctaaaaaattatcaccaaacccaaagccatgtagatttttctcgtatgttctaagagttttgcattttatatttaagtctatgatctctttgtttttgtttctgtttttttagataagagatctcactctgtcacccaggctggagtgcagtgacttgattgtagcccacggtagccttgaactcagcctcctgaatagctgggactacaggcacatgccactatgcccaactaattttttacattttttagagatggggatctcgctatgttgcctaggctggtttcaaactcctatcctgacacagtcctcccacctcagcctcttgagtagctgagattataggcttgagccacagtgcccagcccactatcaaagttgacgcatttttgcctggattcattttgtttggtatatagatgttttgttgttccagcactgtttgttggaaagacgatcctttttccagtgaattgcctttcctcctttgtcagaccttgaggttctggctttgttttttaatcttttttttttcatctgttcttcagattggttaatttctatttatctatcttcaaagtcgctgaatttttctcctttcatttctattttgctgttaagcccatccagggaattttttatttcaggtattttccagttttggaatttccattttggatttttatagtatgtatttctttactgagatgtcctatgttttattaggagcatattttcctctacatccttgagcatagttgtaatagaatgctattttaaaatccttgtctgctaatttcagtgtctgggtcttcttgggattggtctctgttgattgtcatattttttgtttcctcatatgtggattaactttgaattgtattatgaatattgcagatggaacattgtggagactggattctgttataatcctgcagacagaactgacttattgattggttggctatttattttttgtagacagttactttgcctacaaaatcacccccatgcacccccgtgataaactatgtctccccttgtagtgggcagcagcttaaatctaagttcagttttttaaggcttggcttaggtgcttgtggtctgacctacacatgaatggctaaggagtcagccaaatatttgggcagagtttatatgtgaaatttggaatctcgctctatggtgctcctctttcccagattctcattcactttctagtggctgtgcttaccatgaattttattctctgattcttcaagccagtaagactgtttctgagttctagccattccatgcatcatggactgttagtcttcaagttagttgctataaataaattggacacttaccctgttctgttcccttcctctaagtatcaactcttctccttacctgtctagttttgttcatttccaagaccgtcaggtagtagttgttcttatatattgtctggagtttttcattgttatctgttggagggttggtcagataggagcatagtaggccatgaccagaagcagaactaatgaaattaggaagaaggcatggaaagaggaaagaagaatgaaataaagcaaccactgataggccaggtgcagtagctcatgcctataatcctagcagtttgggaggccaaggtgggaggattgcttgagcccaggagttcgagaccagcctgggaaacatagcaagaccccatctctacaaaaaaaaaaaagaaaaaaaggtaaaaattagccaggtgtggtggcacatgcctgtagtcctacctacttgggaggctgaggcagggggatcacttgagttgggaaagtcgaggctgcagaggtcgaggctgcagggagctgtgatcacatcactgcactctagcctgggcacagagcaagactgtctcaaaaaaaaaagaaaacactgatataaaaataggcagagactgttaaggaaggaggatgaaaggaaacttgaaaagattcaggaaggcatcatggtacagaataaccaatttaccagaacaaaacgtttgtaatgcactcgactagtatttatggccttttgtaactatctgaatttgtatctgtaaaaaactgagtggatctgttctaaattatagttatatatattgctcctaatattcctttaaactgcaaatttctcaaaataggaatgaaaagagaggttgaaatagaaatattttaggctaggcttggtttgtttgatgaaagagatcataaactggaagattatacttagataccagtagtggtataatgcttgaatagtctcatttgtagatcagtatcttatcacaaacccattgccgaaagtcccataatttcttgacaagatgtggaaatgtgagcttagattgtcttggagagaataaagttagtatatgcaaagtgctagcatgaagtctattccatagtaagtgtcccctctatgttagctataatatttaccttgcagagttgctgggaagattagcttttgtgtggaaagtgataaaatgtctagtatttagtagacacctaatgaatgtcaatatgatgaaatggctataactgatgctgcttactgatatgccggttttgcactgtacagctctaatgatgatgagtgggtaccactcacatcataatcatatatttgtatagtcacaagtttttttttggcagatggtagtaggtgattgggaaggggtgatttttatttatttgtacaaggacaccgatttaactaatagtgatgctgcaaatttatagtcttagtttgtattagtagatgtatagataattcctctattctttgtgattagataaaatgcatgctatttttgttatattcttatattctaagggacacattttaataggatgttggcaaactacagtgtctttagaggaaagcagtcagaattaatgtcaaataaaaaactattgaaagaatgcctttaatttacctgagatgagagtcactaggtttggggacttacaggttagctgacttcagatactggaggtgggggatacacatgtagaaggtaacctgttttgcccattttttttctaagagtaaaagataatagttcaggttatttatttgaagtctgtaacttgagtcatcctgtgactctagaaccggtagcagcatatattctagaaactacatctctatctgtgttggtgcttttggagagaactagaattggtggatggaagactttgtaagctgagttagttcaatataaagaaatatcattcgttggggccgggagtgggtgactcacgcctgtaattctagcactttgggaggctgaggtgggtggatcccctgaggtcaggagttcaagaccagcctggccaacatggtgaaaccccgtctctactaaaaatacaaaaattagccgggcctggtggtgggtgtctgtagtcccagctactcgggaggctgaggcaggagaatcacttgaacccgggaggcggaggttgcagtgagccgaaatcgcaccactgcgctccagcctgggcgacaagagcaaaactctgtctccaaaaaaaaaaaaaaaaagcaatatcattagtttatgttgtccatgaccagcacactgtttcatgcagtagagtatgccctcttactgaaagtttcctggcagaggtttagagagaaccttttgtcaggaatttttagaggtagttcttatagagtgagtggttgacctcagacaaccctaaggcaccttctagtttggagattcttttattctaatactaggcaatatactccagcacatagaagaaggattttagttctcaacatatgtttctagcattgtgaagcatcagagaacaagaaagttgtctaaccagaatggctttacatcacagtgtagcaggacgagccacagtcaaaactcctcagacactggattaaagaaggaagaggctttatttggcttggagcatccaccaacttgcgtcttaagagccgagctccctcaaaaagaaattcttggcccttttaagggcttacaactctaaggggtccacctgaaaggatggtgatagatcaagcaagtgtggggaacgtgactgggggctacatgcattagcttacagagcagaaagttttgcaatgctttttcatacaatgtctggaaattacagataacacaagtagtttaggtcagggattgatattattattattattattattattattattattattattattattattttaactaccagggccgggtggtggcaccaggccatctggctatttatcttacttctgtttctttttaactttttgcttttttcttttcctcctgttttataaactaggcaaggggggcggggtgcgcaggagaagtggtggtcttcttccttaacagcatgcagtgcagttcttggtacctgcatgtaggtaaagatcaaactgtcaaactggtagtccttaagactctgcttccatgggtatgacttgttctaggtattattgcctaacagaaatttccattatctaattttaaattgtgtaaggtttcacagtgagattattcgaagcatttagaggtatttactaacctgtgatggcttacaaatctcttcttgttgcaataggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcaggttagtagagtaaaggaaggtgttcactcctattgcttctttgatcagtttctaaaaataattcctttaacatatcataatggtaaacaagttaataatagttatagactttttttttttttttttgagatggagtctcgctctgccgccaggctggagtatggtggtgcgatcttggctcgctgcaacttccgcctcccgggttcaagcaattctcctgcctcagcctcccgagtagctgggattacaggcgtgtgccaccaagcccagctaatttttgtgtttttaatagagacagggttttaccacattggccaggatggtctcgatctcttgacctcgtgattctcctgtctcggccccccaaagtgctgggatgacaggcgtgagccaccactcccagccaatagttacagactttatacgtttgtaatttgagtaattctgtgactccagaatcaacagcatgcataattcaaagcatcatatgttctagaaactgtatgtctgacttgggatgcatttcagtgcttcctaaatagcagattgacttccttggcttacttgaagttaattgatcttctctatatgccaccttagtaaacccaagccattacagcacacctcccctaattttcttacacattgtaggagcttgatcagtgtttgttgtaagaaataagatgcttccttaccctctgtcttgctatgtgtgatgtacaaaatcaatcattcatatgcaggtaattgaaaattcagaattcctttaaagtatacaaacatttgttggatacctagttagaggctattataggtgctatggcacccaaggtggaccaaaaggaggtaataatctaatgaaaaagataagatatatatatatatatatatatatatatatgatcagtttctgtgatatatcttatgtatcatatatacacacacaaatatatatatgatacatatatttaaagatgtcaatgatgtgatcattgctaaaggaaagagaatgacaatggacacagaaatcactaggccttgcatttgaacttgatgctgttcatcttgccgttgtgtatcttcacatccagaaaaagcagtgacttttttcctttggcagttatgtctgttgaacctaaaatattttcataaagaattctcaatattgtcttttgttctttttattttattttgtaacttttacctctgacctaagaaggcattagaacagattgaatagaaattggatacttccgttttttgcgttttctagaattttgaaggaaaaatatttttttcccagcatgtattctctcaaactttataacacaaagtcactataaatagtatcagtttcattgtgtttgtgcctctgttcctaaagacagtttttcttgtgttaagttttctgtcaggccaagatagagttttcttgtaaggatgttaagtgcttaacataaatatttggggttaggcctttatggttaagagagaacagaatatgcttcgaataacatttgacaaataccacaaagctgcttttctaattgagttttatattattaaatatcacttggaataaatgagttttacttatttcataggaaacaatgaaatccaatgtggattctttttatttctttttcttccctaattgccctggctagaatctccaatgttgaatagaagttataagaaatggatatctttgtcttattcctgattatagggggaaagcatctggcctttcaactttacatatgatgatagctgtggatttttttttttttttttttattgatcattcttgggtgtttctcgcagagggggatttggcccacaggacaatagtggagggaaggtcagcagacaaacaagtgaacaaaggtctctggttttcctaggcagaggaccctgcggccttctgcagtgtttgtgtccctgggtacttgagattagggagtggtgatgactcttaacaagcatgctgcctttcaagcatctgtttaacaaagcacatcttgcaccgcccttaatccatttaaccttgagtggacacagcacatgtttcagagagcacggggttgggggtaaggtcacagatcaacaggatccacaaggcagaagaatttttcttagtacaaaacaaaatgaaaagtctcccatgtctacttctttccacacagacacgcaaccatccgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggggcggctggccgggcggggggctgacccccacctccctcccggacggggcggctggcctggtgggggctgacccccacctccctcccggatggcgtggttgccgggcggagacgctcctcacttcccagacagggtggctgccaggcggaggggctcctcacttctcagatggggtggctgccgggcggaggggctcctcacttagacggggcggttgccgggcagagggtctcctcacttctcagatggggcagccgggcagagacgctcctcacctcccagatggggtcgcggccgggcagaggcgctcctcacatcccagacggggcggcggggcagaggcgctccccacatcccagatgatgggcggccgggcagagacgctcctcacctcctagacgggatggcggctgggaagaggcgcccctcacttcctagatgggatggcggccaggcagagacgctcctcactttccagactgggcagccaggcagaggggctccccacatcccagacgatgggtggccaggcagagacgctcctcacttcccagacggggtggcagccgggcagaggctgcaatctcggcactttgggaggccaaggcaggcggctgggaggtggaggttgcagcgagcagagaccacgccactgcactccagcctgggcactattgagcactgagtgaacaagactccgtccgcaatcccagcaccccgggaggccgaggctggcggatcactcgcggttaggagctggagaccagccaggccaacacagcgaaaccccgtctccaccaaaaaaatacgaaaaccagtcaggcgtggcggcgcgtgcctgcaatcgcaggcactcagcaggctgaggcaggagaatcaggcagggaggttgcagtgagccgagatggcagcagtacagtccagcttcagctaggcatcagagggagaccgtggggagagggggaggaggagggggagagggagagctgtggattttttatagattccctttgtcagattgagaaagttgccatctgttcctagtttgttcagtgtttttgtcatgaaagggtgttgtattttgtcaaatactttttctgttgactttttgtgttgaaatccacattggatttcattgtttcctaagaaataagtaaaactcatttattccaagtgatatttaataatattaaactcaattagaaaagcagctttgtggtatttgtcaaatgttattcgaagcatattctgttctctcttaaccataaaggcctaaccccaaatatttatctgttaataatttacacgagatgatcgtgtaaattttttttattctgttgatatgtgatatttgacaaaccttggcaaaagaatatccattggccaagaatttttttaatgacattaatttgtaaaataagataatttcatctcagtcaacagatgaaacatttagttagtagattaattgatgttatactgagttcctcccagttccatctgcattcaaaacccttaacttataaatgtgccgaatttgtcaagttttgaaaaacttgaaacctacacaaaagttaaaagaatagtacaatgaacatcctaaaaccccgtaccttgatagaccaatgttttacattttgtcaaacttgcttttgctcttgctaacagcctccaaaacaggctgttaatgtttttggttgttgttggttttttttttttaagtcattctttttattcaaagtgtggttcttggactagcaacatcagcttcaccagggaaatggttagaaatgcagaatctccggcagacctagacctgttgattcagaacttacattttattataacaagacgcccccatatgcattttaaagttttgggagtggtggtctactcctacctcttactctcctgaccaatcattcatctgtcttctccctaagtatgcagtcctcagcctgttttacattagaattacttgggatgctttttaaaagtgactactgatgcccaggccccacctccagcctttctggtttaattgatttgcttaggaacttaagcatgagtatgttaataaagcttcctaggttattccagcctgcaaccaaggttgagaaccacagcctccgatacttcctctgttaaggagcatactactttaggatagcgtattccatttttaaataactctaattgttataaatttctgtcttatattaaggacttaatgggatttctctaagtagcaattatctttaatatatttgaaaaccaattgactgtggttacacaacattatgaatgtatttaaataataccattgaactatacacttaaaaatggttacaatgatacattttgttatgtgtattttgccccaataaaaaaatagaaaaaaacccaattgactgtagtttttattcaaattgtaaacacatattagatataatatgctgtacttagatgcattttgtcctaccttagagccatatagtttatcatttttgatagattgccaacatttccatgtatttcgtgcttgttcttaattagtagatttatagagaaaattatttttcttttccttctctcttctagagttcttcagatgctatatatttggcaaggcatgttggtttgcgtgtgggaatcccaaaggagaccccagctctcacgattaataggctctgtggttctggttttcagtccattgtgaatggatgtcaggtatggacaacatttttttaaattctctgaaaatatgttaatagttactagaagaaatgtcccactgcaatataacactttagctttagggaggattgcttgagccctggaggtcaagtaaaccatgatcataccactgcactccagccatgggcaacagagtgagaccttggctccaaaaaaaagaaaaaaaaaaaaaagctaataatgaacctgaaagtggaataagcctgtcataaaaggacaaatactgtatgtttctacttctttgagatacctagcgtagtcaaattcatagagacagaaagtagaatggtgttcccagggactggtgagggaaagttagtgtttaatggatatggagtttcagttttgcaagatgaaaagcgttctggagatgggtgatggtaatggttgcatcacactatgaatacacttaaactactgagctgtatacttaaaaatggttaaaatggtaagtattatatatatatatatacttcaatatttttaaaagctagtatgttcatcattctttcgagtgcttcctacatgctaggcaccctgctagatttacattcaatatctcatttaatcttacaaccatcctatgaagcaagaactattattattattcccattttacaggcaaggaaactgattaaagccattaaggttactcagtcatagaatttgaacccaggtctgtgagtgttacctgtgaggcactgaataaagaccgtgaggcaagcaggaaatctcaagaatttaggagaggataaggaaatgtattttatttcaaaggaagtgaatgatgctgttagtagaagtacaaactagtttgacctttttaaaggacagttggttaaatacatttgtttctttgagcacagagaagaaagtgaaatccaatttcatttgtaaaagtcttcattttattacaaacaaaataagagccagaggcgtattttaataaaacaattttcacattaatttgtttctataacgatatatcttaaatagtgacctcggttttcctagtaataattttaagaaccatcaggttcatagaggctcattatttgctccttttctgagaaaggcaaacagtggaaagtgttggaagaatgaagtggtttcctttttatgagtcacctagattgaactagttcttgtaaatctctgttcttgttcagatacatccattaatgggataaatttttcttttgcctttttaaagggtatgtcctttattatctgctgtacatttatgccaggtattaatatctgttgattttcaagatttatattgtgttaagaattactattcttagccacatgtaggtagggcctgttactcaggcaaacatgattgaaaccttttagttttctcctcctacatcttggtaatggatactttagcatttgctttacagttactttaaaagcatttccttttgagacactgtaagctacagtacaatatttgtttgatttaccattaatttgtaaaatcagtgtgtttcttaatacattgtttgggtacggtaaaaggagtttttattactgtttgtttttaaataggaaatttgtgttaaagaagctgaagttgttttatgtggaggaaccgaaagcatgagccaagctccctactgtgtcagaaatgtgcgttttggaaccaagcttggatcagatatcaaggttggaaccataaaaatttaaaagaattagttcttattagcattatataagtacttttaataacatacctttttatgggagagaaaactaattttgaagccaatttcgttgatgaggattggcaagatatgaatgattagaagtttgtaaactatttcaaaactctattttggtggttagttttgacattttaacccatatgaaattagattctatctatctcagcagacctctagtagtataattatcctgtgtaagtggccataggcatgggagagatggaggaagggaagaagtggattaaaaagatagacaaaagagtgaattaatctcactactaaacaattagtaatctgagtaattaaatctttaacgtgacttatagaagttttatttctgggacagtctcagaatagatttcttcatcatcacagaaaacatctttgaatacagattatattgtcccaaatcaaacaaaaactgattcttttatctttgagagctacaacttgagaatgatggtacagtactgataaagaatgatgttttcttctcattcccatgtgaaagggctactgacattttatattttttagcattttctatagtaatgtttgactcacactgttcacccagtttctcacctggcctttttggaagttgaaaggaatgggacttaagagaatctatgcggattttagccaccaaacacatttgagatatcttttatgaagacaggtcagtgagttaaatgttgatgaggcagcaaagtggggcacacttaccagagactaactacttgaataataattaacaacctttctgtaactctgggaacctgtcccaagatcttttcagcctcatagtaaccgatagaaccagctattcctgtcactgaggcgcaggatgaaaaagaaaaacagataatactgtttattacagagctcagggctggtttacaaagatggctataagaaaacattgcatgaagactcattgtcaggttttctacaaaatatgaccttgaggatttaatttttgatcgtagggtaacttctgtgatctcaccatgcacgtctagtcctgttagctgttcttagacccccacatttagagagggacagagaatgtgtgcattttattttgtgacattgaatgttttcaaaaacattgcatgtttttaaaaaatatcccataactgaatatgaatagtggttatcagaaagtcttaattttacttttgtttattggaagtgttgattatttaaagaaattataacatattacttttaaaaggaaatgccttaacaagtcactttattaatgtcttttaatagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctggtgagtgaaactggaaagtatcagtatctatagaataaatatctataggaaatattttcatcatttctattatggttatataatatttacaaatcatacctttaagaattattacatcttttcattattcctttgtctttagatgatcagatattttattaattattgcaaaattaactaggaatttctcttttgaaaaagttagtactacttaaaaagtggtattgctacttgaccctagatggacccttgagttttgtgctgaactggtcctgttgtcagtagaacatgatgaggaatacgatacgttctgtcagaggtgatagctcactgtggcaactggaatatagaggatgtcctctcccacaagccatatcataatcataagaaggggtaatgtatttggaaaagacccactgggtcttttatgctttccttctgccactcctaattaagaatcattgtacctaactcagagacttagaactagtccgagactctagttagagtgccctggtgtagcacagcaggttgctatagagccggtccaaaacaggcaaatgtgacagcagttcttttagcagtgcagcaagttgaagaaatgtgatatttaaaaaattaaactgttaaagcaagtggaaactcttatttaggaatattaaatgcttgaagtaatgaggataaagtccatcttagcatttcagaaggataagtggaatagagctgatgccatctaactcgtgtgtttttttacttatatgttcatagtggaagaggattggtctagaagtcaagagttatcagttctgtttctacttctaccacgcacaagttatcaagctcagtcatatcatttattcactgaacctctgtaagatagagataacaatatttgccttccctatttatctaataaggttgttttaaaaccaaataagggcatataaggaaagtattttgccaattgtaaagtgatatgaaaattaaggttagtattattcctgaccctatttccaaagctatagattactacagtacattctagtcagtggaggtcaaagtaggtaagatgttttacttataattgtattagtgattgctcccataatttcttcaggttgcctatcactattaagtttcagttagattactttgtggcatagacaacttggtaactttttaattgcttatctcaccaaaagaagtttaaaaggggtattaagtccatttattgccattacatctatagcaaacagacagatgctgctaacagtcttagcagtacctggtgaaaaaaaattgtggttaaaaaaatataatttttaaaaatataatttttaaaagatgcaaaatgcatctacataaacacatgacagtatcgtaaatcctccaatacggaaggtaagttgtgtaagtaaatagtaaagactctataatttttaaaagatgcaaaatgcaactacataaacacatgatggtatcgtaaatcctccaatacggaaggtaagttgtgtaagtaaatagtaaagactcaggctgagcgtggtggctcatatctgtaatcccagcactttgggaggtcaaggagggtggatcacgaggtggtgagttcgaggctagcatggccaacatggagaaaccccatctctactaaaaatataaaaaaaattagccgggcatggtggtgggcacctataatcccagctactggggaggctgaggcaggagaatcacttgaacccgggaggcagaggttgcagtgagccgagactgtgccgttgcactccagcccaggcgacaatgtgagactccatctcaaaaattaataaagactcaatattaaagtagactgtgaggaaaaggtagatcagaaattaaattgaataatatgtttgatttattttcatgtttctctcttttattcttatgatagtctctctactatttttcagctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcggttggtatcaccacacagattagcttgaattcttcctggtgtgttcaacaaaagtaatcatgaagtatcttgtaaatactttttatgccagtctttagttgtttagcttaaactaatagtgttcatattcaattaatttaggttttcatagacccacacaaaatcttttcatatttatttatataatactcttctgatttcttaattttttcagaactaagaaatttcagaaacaaatctatctggcttattttggttttcaaacttttttttttctcatgcatacagtttatcgtatttcttcttacatctactcacatctagataaaagtttttccttgacacccttttccttgttctttagtaaagttgtattctgtgccttaaaaaatctccttcatccaccacagtaccacttttctaattgtatctcacactgtgcactggcttcctatgtactgccatattcctaatactactagtccattagttcaaactttgattaactggattattttagcctttagttaatctagtatttttattttcaagggtgtagctgatggtgctggagctgttatcatagctagtgaagatgctgttaagaaacataacttcacaccactggcaagaattgtgggctactttgtatctggatgtgatccctctatcatgggtattggtaagtttatagtaaaacaaactggttctataatatttctggaggtaagtcttctttggcattcagagtcctgaaaaagtggccaaaccaaggtcacctgtagagaaaagaagattggtaatcagtttaaataaaaaatctttatgaagaactgtcctagacacaatagaaaaaccaagaccgtgtaaactccatggaggaagtaatcatatcttagtgtccatttgagatttaaaaaatcaacacacagtaattatatcttattgttcctttgagagtttagaaatcaacacagaaaataacagaagaattacgtgatcctgacaagataaaagaaattatgagatgggagaaatcctggggtgaaacagagaaggctgtatggagaaggtggtatcgcagctccttgctggttgttttacacacattcagtcttcccacgtctccagtaagggagacttctttgtgaatgagaaaattgaggcttagggaggttgtcttacaaggttccaaatcagtaagtgacagccagggtgtgaatccaagtctctctgaaatcaagtgctctcttcactgtgagttaaacgcatagtctcaggaagtcaaattaatattcctcttgctcaggtgagtattagcaaaataaagacttataattagattggtaaaatgctagatggaaaaaatttggaagtccataaacatgtatagtcttggcttaaaatatttgatttagaagtagaacaaagagctttttgctggatgcactcctaggaaccacacacgatgctgaattttaatagttcctgtcattctctgggggaacagggaaccaattaggtgccttacttagaaaaataaaatttggtgctcagtaactttgatatatcccacctacatataacctcccactgtaaggaaaagcctgccctagggtatagatttcagattgtttagcccttttttgaataactaaattgttttctgaggtgggttccaagagaggaggaggaggataacctgttactgacctgccatctcagagatccttcagtgtaagcctacaggttctactcaaacaataccacttacactgacttgggattaatactcaaccatatttgctgccatgtccctcagagaagacatatctctgtatagagttcctaagaaaaaaagctggcatgttcatattttgtcatctttcactatgtgtctcaaatttatgtcagcaagaactgcaagatattttgacacatatgaaaagtcaatcttaagcttattagcttttggctatccactattggcaaaagataacttttgtcttagaaatggaaggtggtggaaaaattaaacatccgtatgttgttatggcatttattattttgatatctagggtagtggttcccaacctcagatgattgtcagaatccactcataacccccacacccttagattttgtttcagtaagtccagagtggagcccaagagcagagttggttttgttttttgtttttgacacagagtctcgctttgtcacccaggctggagtgcagtggcgtgatctcagctcactgcaacctcattcttcccagtagctgggattacaggtgcccgcccccacgcctggctaatttttgtatttttagcagagacagggtttttccacgttggccaggctgatctcaaactactgacctcaggtgatccgcccacctcagcctcccaaagtgctaggattacaggcgtgagccaccatgcccagcccaagagcagagttggtttttttcctgcatacacctagatgcttttgatgatcaaacaaatgtatgtgacatgggttggctattttatactcctttttcagtttaactttatttaataggttctggtagattagcatagccagtgaaccaagaaagcgttgttttccttccttctgttcctgggcctgaatatttgccctaaagtacaaagaatgctcctgtggtaggattgtcatttttcctcggggcttgaacagagctgtacattccagatgtcccacagtatcagctgcccccttcatctagaagtttggctgtcacttgtatatagtgatgggattaaacaaagtaactcgttgaagcatcccagatgaataagtggggagaataagttattaagtatctagtgggaactggtttgttaatctaacttacaagaatagtggttctcagttctatgattacctaatgactagcaatccttagccctgcagaatagctgcagaccaaaaaaaaacggggaaagccatgacttgaaaagaatagtactggttctgaggaaatacacagctatagaaagacagcactccctggaactcctcaggggtggcaatggtagaggttggtgggtggaactttgagcctcttcagctggagcagtctggcattatctattacttggcatcatatgcaaaaagaattctgatgcttaaagagaaaaaggtggaaaacccattcagagtgctattgatgagtagcttgttgcccagagagatgcacaaagtcgcacagctattagtgacaggaaccaggactagaaataaggtctccttttcctaacaagaatactaaaccttcctgaagtcccagtaaataacagtggtctgggaagagtcctttaaaaatcgagttatggcctagcatattgttacggtggattctgagttaaagtgaaagtacgagtcatgcttgctgtgttgtttatgcagacaaggaagtgtgtacagtggtctgaacattgtccaccttttatgtgtctgtcaccactgttggctacttcatcccctcaccaggctggataactgatgctttactactgactacccatctcattttcatgatttcatgctttagacatacaaagagaatctggaatcagatcctgtagtaaatcagtagctgtagtaaatcagtagccacatgaaactggcattttaaattgaagtgcattaactggatagtcctaatcaataagcacgtggtttgttgtccaaagagtattttaactacgtgacaaaataaatattatatttaggtttcattatgcctttcttgtaaagactgattttccattttataaggtaaaatgcttgtgaaacttgatgcagaatatttgactacttgaattcagcagaacatactacatatttttctttgtagacatttttggcagtttcattctttaagaacaagtcgagaagtagataatcttctctacccaaattttttaccttttgagaaaaaatatggatttaaattatgagcaatattaaactctcattacatcatcagaaatctgggagctaaagtttatttcagaagtcttattagatggagttgcatttcttaaattaggagttatgttttatttaaatttcctgcctacccttggagttgtaaacatcaccttacttcataaaaccttccctgaagtgcctcgtagtttcccatctctctgtgcccatgtggagatactgctatttcttgtcttttatccaaatgggcctgaaaattcagagtgtagccacagtaacttctgtgctgtgaatgcatatggcttggatcccaagtagagcactcagtctgccttgctctttgatatcaattataatctattaacataactaaaatcccatatatggactcctttggctgttttcaatcttaaagccgtttatggtagaacttttcatgtaattctcttatctgcagtttgaatgtataaacaacttttcaccttggttccattttatttttattattattttttttcttttttagagatggggtcttgctgtgttgcccaggaggctaaagtgatcctcccacttcagcctcccaaagtactgagattacaggcatgagccaccatgcctgggccctttttctgcctctttatggtcacttcatttaataggtacggtcaaggtagtaagatttgtggctactaataactgccgcattatttcttccttacttggaaagaaggagaagcttgatacgtaaatataagatgacatttatttctatatttttatagaagatttttattattatataggtcctgtccctgctatcagtggggcactgaagaaagcaggactgagtcttaaggacatggatttggtagaggtaagtgttttttttttttttttttttttaacaacatgaataaaccatgtacttttatagcataaatgactttaatttggtctcattgctctttgaatttcattgtagttagcctttccaaatgatgtacatctaaataaatagtaccttcattagatgccttgtgttgatacttttccccacctggttaacatgctttatttatatttgaatattcaaactgcctgatttctcttactcaagtataaattcctgggaatttcttactactttataaaactgttacattttagactattaacatgcctgttgaatattaaagtgaaaaaatatatgtaaaataattgacataatagaaaagcaatatttagtgccaaatctacaagtttcttgcccttctcgccagatagagccccctcccttaaatgtatctttggcttttatacgatagttgtagcttgatttgggatgcacctatcataatttttgacactggaacttaaatttattgagtgatttctttttaaatgttagtattagaactaaagtgtcttaagcataattaaaagaagaggtggagaaacatttaaagatggttatatacattccacacttttggaatatttatttgaaaattttaggtgattaagcatgtgatgcctggcactgggaaataactaatagaacaaaggaaatctatttaacttgatagcgaaggggtaggcacaggtgtgatttcctctatgataatctctcacacaggaaaccatgatttcagacaaatggtttatctttaaatctcttccacttttagcagatcacagttcagagcctcaaagaggctgtttaatttattatatttgtgtcagcaaataggtaccactaaatttctcactttagacctcacatttaaaactattaaactatatcaactttgggaagttgttcataatcatttggaaatgtatacattctcaaggacataactcagaccatagttttcctaggttcaaaagcctagtttcactacctattctaggtctcttagtacctccttgaagatggctctgtatatagagtagaaagataatggtggatctaagcacatatgaggcaccatcttgagagaccacaaagtatagtaggaaagagcacaagactgaattttatcccaactctgcaaaagttacctttcttagaatgagtttccttatctataaaattcctgaattaagatcatatgataatacagtactgtaaacttgaagtaaggtaattgccagtttgtgtaagtataacataatatacttttcagttctgccacatttcaacatagtaactgttccctttatgtacgtggctttgaaggtttattctttgttgtgtgtcagcttcttggaaggatagctcctagtactgcataataataataatacttgcaaccacttattgagtacttgccatgtttcaggtaacacactggacacttaatactcatgattttatctaactgtgacagtgactcttagcatgataccacagtcacattttcacacgcggaaacgtgaatttaaagagtttaaagaatatgcataaggtcacaccctaacaaatggtatagccaatatttgaaccatccatccagttctaaaacctgtgggctttctacagtatcccactgtgtctggtatgtgtcaatttatgggattactgagaattgcctctaagggatgcatttgactaaaagtattatttagtaaatatacacattttaaacctgatagctttatgcagaatgattgtagataaaataactttgcgaggtaatttaaataggaagaaacagcagacttagctgttgataggactggaccattctcatttaaaaattagtttgtgagtaaggatttttgttagtgctctaatttttgttttaaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggtatttgctagaaatagctgcatttcagatttgctgttttttatagaaatgcatggatttaggcttccccagaacactccaacatttttcattcttcttcatgtctcctgcactggctgttaccaggaacaagttacttgggcagtgcttttcatctggtctcatagatgagtcagtcaccttgttagtggctttgcacttaagaaccaagctcttcctctgtgtgtccagtctctgtgcactgtgtgccccactcagcttgtgttcactgcatgagcagataatgaggccctgcttctcatggcacttgtattttagtgccagttacaggagtaaaataaatctattttagaaaaaaaaagtactgagtgagtactgatctagatgccataatttatgaaatctaagcaaactgacatttgggtctaagtttttcttttcactgcttgcagggttccaggaggaaccttttgggtgtttggtgcttttcagttttgatagatagtaccagaaggaggagctcttctatttttggaatattttgctctgtagaaaaattgcaaacaaaaccaagtaagtcaggctgaaaaattactctgactccctgttaggccaggggaaatgtgactcttatttcacttaatgattccctgagttgaaataggtgattgccacatacaaaagtaattcctggataattttctcgaagtcatcatattaggagtgaggagtactttaaaagagtctaatttttatgaaagggacatggatagtttctaaattatctgccctttcatagggacaaactttattaattacatttcttctaaggtgccatgaggctctcacactatataaatcaaatatataaatcaaaggagcttaatgttcatccccttccccagcttcccatttatccagttacctcctcttctcactcctttcccgtaacacacacaagcttctgtatgtgtttcatataccctaaatctactctataaccctaaatccactcatctcctttttagtttgcctccctcttctggtgtttgtttttgttttttgttttttgttttttttgattaaaaactttcagctttccaaagtctgttgcctgttgtaattataccaaaattgaggactggggaaaagattgagcagatgagctgaataaggatgagtaatgcagatgtgatgttattagttctatttcattaatctgattttttattagagtagatttcagtcactgctttctttttcaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttttttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctttcgtgactggcttattttactttactttatataatgttctcaagattcatccaccttatggtgtagcatgtgtcagaatttccttctttttaaaggctgaataatattctgctgtgtgtataaaccttacttccttcttcccagcttaaaggccatctttcatcctttattttctccctttaaaatgcccccacaacacttccattgctttatttgtctgttctaagactggatatctagtagggcaaggccctattcttgttaacttcatcaaagagccactggaaattttaattaagattaaattgaatttatgggttatacatttattggggggaaatttttttttttttttttgagacagagtctcgctctgtcctccaggctggagtgcagtggcgcgatctcagcttactgcaagctccgcctcctgggttcatgccattctcctgcctcagcctccccagtagctgggactacaggcgcctgccactacgcccggctaattttttgtatttttagtagagatggggtttcaccgtgttagccaggatggtctcgatctcctgacctcgtgatccacccgcctcggcctcccaaagaagtgctgggattacaggcgtgagccactgcacccggccttttttttttttttttgagatagcatcttgctctgtcacccaggcagaattgcagtggcacagtcatggctcactgaataatagatgttaaataatactagatgttaaataatagtatcataagtacctacactgtttcctcaaccctttgcttatatggtttccttcatttgattaaaaagctgaagtggcacatacatccccctttctgtcatagagaggcagatgacaagcggcctacccacggtttgggataatggactagtggcaacaggcaagtccagcttttattgtttgggatccttactgagaagcagcaggcttcctctactgtcataaaaatattaaaaagtaagagccctgtataatttctcataataaaacaatgttttgcagaacattttgttttttacatattcttcgtttgttgtaacttataataaactttctctgggatgaaatgaccaaggccacatgttaccatcttctagaaacactagtgatagtttatcaagcctatgaatttccagatgaagaaggaattgtcgccaatagctgaagcaatccgcttcccagggcatctcctggcacaggccttggtaaaggtttatcgcttttccccataaaggtcttgtgtagttttgttatccaactgagacctttttcctattttcttttacatttgattattgctaatgaatagcttttggatattatatatctagccagcttgtggaacccttttattaatttgaatcatgcagatagtatctcatttatttttattgcctttttgccttgtgctgagaccactggcgcagtactggaggaaataaaatgtggtaatgctcatattcgttcctcactaagttgatgcttacagtaggtttctgatagataatgctttatcaaggtcaggaagtttccttctattcttagttttcttaaggactttatgagtggttcattcattcttcactctaatcttacttggctgccaccacttaagc

SEQ ID NO: 13504 - DNA, 59519 bp, Human
ctgacgcctaaagcaaaatcagatggtgtttctttgtgtacctgtaatcccccttgcaatttctcttaattgtcatgtgtattttaatcatggcagtcttcttcactagtcattgaccatcctgagaagagggaatatttaaaaaaaaaaattattcttccatgtggtgcaaaccaaaataatggaattatggagaggttagagcaggaatgcagtttgtgtacattggaaatgaatcttagcatataatctatgaaaattagccatgttctttgatgggaaataaatttgcatcttgtgttaggatcttctttaacgttaagaatatgtgcaaagtgtgcttaaaaactgtttttttcctttaaaaatgttttatccagttttttgtacacacatacacaaaaacatacacaatggccatatcattcagcctttttcatcttttcacccccttttctgcatattggtatatctgcaacccatattaatatcctagatttttgtttatacacgtataatccagttactagttgtaacacgtggcacattgccagattacttagaataaagctgtcacatttgaccttttcaccagcaatgtggaatgataacaatttcttcacatcttctccagcagtaggtattttaattaattcaatttttgccagctagattgggcatgaaatgatgccttattattattttaacttgtacttcctcctctacgtttaaaaactattgtctgatcattatgataattaaggaacaaactaatgaaaatgtaagcatcattgttttcttaaagatacactttgaaaactacaatttcagtatttggggtgtgtgatgtaaagactacagacctctttactttctaaaaaggatgccttttgggaactttattaaatatggcaaattgaacacattcattttcctttttcctatatctcactaaaattgaaggcaaaggaaagaaaagcgtaagagctaagatattaagagcttctggagcgaaacaatttttaaaccccaattaaaggatcaggaataaaagttatgtgggacttaccagtatcagtagtggagtctagaaaattgaggggacagtgctttctaaattctgtgtgaactgataaggaatgacctacagggaattaagcaaaaaaataaaaataaaaaaataatttcaagatatacaaaataaggaatattatgctacttttgtacagcaataaggtgggaatgtggttagttgtatgtatacatgtttatatttgtaaaatgacgctgaatagacaaaacagcttaataaaaatgattcctatggaagagaaaagacaaggtacaattccttaaattgggaagagaaactatctgactttactcactatgcaaattgttatttagatgaaaatgaaaaaaactgtgttaaaaaatttctctcaagagcaggtgaaaccggactacagcttttctccacggactctgtttgccatgtttatttctttattcttgattacttcacactttacgcattttcccttcttgtaactgtagattttgcctcctattagttatgaaagtttaaaacccgggggagagtgggcttacaaattttcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttcattgcctacatttgtatgttatcctcatttccgtgattgaatgatacttgaataaagaattgaagctttttctatcactaacatagtagcaacctacagttttctcctcctttagtcaaaactttcatcaggggtgaaaagaggctgctcactttttaatgaattttatatggtttttctttgcgttgcagcattgcttccaagaaagaatagtgtgttaggtggcttcttaattgttgtaggcattagtcagaacctgtcttaaagacctgcctcttaggttaggaggacctgttactttaaaagtctgaagttttctgaggataaatttaatcatttacagataagtaccactgtcataagtattgttttttaattaagtgacaggtgttttaaagtgtgttttactacttgtgtacattacagattttggggagattgttaaatgtaagaattctctaaaatgatagtttgcagtgtcataccgtgggctagcatatagcatgtgaaaccattctacttgactttgaactttgagaagtacacttttgatgcttatagataacagatcccaataacaccagtgcagcctgtctagttgcaaatactaacagtagaatgtttcttgccttgtttggtagaccatccatttctttcccttacttgttttatgtatatcttaaaggttgcttttttggtttgttgatttgttttacaaatgcttattgagtgtttgctatgtagaaggcactgtttctagacatatgaggataacagtgattaacaaaacacaaaactcctgccttcctaagggatagaaatacacgataaacaagtaaacaaattaattataatttgatatggtaatgagtgcaaagaagacaaccaaatgcagtgatatgatagaatgaagaattaaaaagctgctttgggtcggattgtgatgcttgcgtggagcttggagaagcagcagccaactgagggaagagtcttctaggcagagggaagagccagagtgaagacactgaggtgagcttcttgtattagaatatttaaaaggagcccagtgtagatggaggacaagacttgcccaaagcttatacagggcatcctagagtgtggtgagagtttgaatgttagtctgaatataacaggatgcaagtaagtttattctgatggattttaaagaggatcttacatatttttacaaagatttttctggctgcgggagagtggtatgtgtgtagtagggtagatggaagcaggaaaattaggaggctgtgaggaatctaaatgcaagacgatagaggctggactggcgtggtggctgtgctagcacacgaagtaaacagatttggcatgggttttagaagtggaactgaggacttcctggtgaatgggctgagaagtcaagctatatttcattcttcattgtgtagtgcttgggatttcagttaggtaaccatttatcatatgcccactatgtgcctggtgtgctcttcctcactggagttaagatacagtgtttgcttttaaactacttacttcctagtaagggagataaacttagaaaaagatggtttcatgaggcttggtagatgttataaaagaagtatgcttggggctatatccagaggaggcttgtggaaagtttccttctggaggaatactggtgattttgagttgagcggggtaaaggaggaattaggagaagcctgtttcatcacatgtagtgcggtggtgtggagattgggaggtgggggaggattggtgaagcgttccaaacaagttgggtatccttagagtataaagtaaggggtggcaaatggccatagtgtgtataggtagtaaggagtcacttcatgctgtgccagtgttcacacttaacctgagggtgacgggtgaggttggggccgtttaagtgccgtagggtctgaaggctcagaagtcagattaatttcaagtgcaacgtgggttgcagcgagaaaactccttgaggctgtcaagaatggaggccgggagactggtatcacttgattgaagggagctgtgtgatacagcagagatagagccatgtttttgcacaacttcaacaaggctcaagttgccattgcagtgaggttatccagagcagagcctgagagagtctaatcttttagggaggtacagcagtactaaaattggccattgctggtatttaacctgtggaggaggtcaccttagtcatagctcttttccttatttcccattctttttacagcctcttttggagatagagatctctgagagctcatattctggagctgcttcatcattaaaaacatttttttctgccctctcacctgattaatgaagttgaagtgataattgtccattatcttgtttttcactattgaagtttccttgaagcgtagaaatttgcctaatttggtggtttttttagatgttgcaaaaatggagatttgttattattgatcatggtctatcaaaaaaattttaactttttacacactgtagcttagtgccatatattttataaagcttgtttttagtagtagaacaattaaattgtgtcaggttattagtcatttcttaacaactaaatattcttaaatgtaagaaatttagttggaattcagggaactcatttatatgtagagtgtaaaagatgggaagtgggatggaaaagatttgttatggctaaatccaaaccttagcttaaacagaattattcaaaatgtgatacacaatggatttgtaagcacgtttactcagaatttcaagtaaaatgttagtaaagtgcctttatggttttataagccaaaaaatacaactaagttcagctgatgaagaacgggaaacaaattgcttaattttaagaaatggcaaatgttttctgttgaaatgtttactgaacagttcctcctctctactttcagccccttaatattagagtggggttaaagttagggcagaaacatagtcctggctttgtgtccctcccactcccctcatctcattactcttgttgcctctggcagtttaaaagctgtagttatagatacgtcactgtcgctcccttcccaccattttctgtggtgacacagagtaatttataggtagagcttaacctcaataaaagctgcagtgagctaaataataaaaaatttcaggaagctttttcatctcaaacatttttgagtccgagggatgggagacaacttggtcgtgaaatcagaatggcaattgatatttagataaagaatcagacataaggaaaaagctttcaatatattattatccacagtaaagcaaaattgaaattgcagtggggatggaggtctgtaaagttaaaagtaaggactatggggtctaaaatggctattttataatattgattatacataaatgtataggaatgcaaaatttattttcataagcataaattaaaaggactttcctaaggtggtactctgaccatgtaatcacatttttgatctttcatcccaaggaaataatcagaatattgtcaaagattcctgatgtttgtttcagtatcattttttccaccagtccattggaatctgtattgtttttaatatgaattagaaaaaacccagtcctaacctttagtttctaataaagaacacttaagcttattttataccacaattaaacaagaatagcgaaagaaaagtttatgccactctttataaacatagatgcaaaagtcataaataaaatatcagaaactagaattcagtggtttattaaaaacaaaaccacaaaaacataactaggcatggtggctcacgcctgtaatcctagcactttgggaggccgaggcaggcagatcacctgaggtcaggagtttcagactagcctggccaacatagtgaaacccggtctctactgaaaatacaaaaactagctgggtgtggtggcatgtgcctgtaatcccagctactcgggaggctgaggcaggagaattgcttgaacccaggaggcacaggttgcggtgagcccagattgagccactgcactgcagcttgggcgatgagcaaaattccgtctcaaaaaaaaagaaaaaaaaatgtctaggtaatgtttattgtcattcaaggatgactcaactacaggaaatctattagtataagataccacataatcatatttaagaagcactttatgatcatcatggatccagaaagggctttctataaaatttgctattcatattaacaaattagaaataagagttttcttagcttgataaagcatacttctaaaaatgttaacacttaattatgaacttttagagattaattgaccaaatttttagtaatgagtatgggtgacccagaaaagtcctgtatttttttttctagtatttatatataaaagtatatcacttttatagtcagcacaattaaatgtttaaataggacttttgggcaatttaattcgtgtctatttatgacaagactattcttgtcttttttctttgaagtcagttttttctgttaaaaggcaattctattttttttagcattctgatatttgtatgtttatgactgtttttgccttcaaaaagtgtatttctagccagacgtggcagcattcacctgtagtcccagctgcttgggaggttgaggcaggagggtcacttgagcccagaaattccaggctagtgtgcagtgatcacatctgtgaacagccactgcactccataccgggcaacatagtgagagtctgtccctttaaaaaaaaaaaaaagttacttaaaaacataaagtagcatgtacataactgaaaaatcaaccatgattatacggtggaaaaatcagtctccctcccacccctgttttttcatcacccagttttcctctgtagtgaacgttgtattactagttcctcatgtgtccttccaggatgtttctttttaatgctgccattaacatttggattttgttttgcctcttagaaacgagacagagttttgctcttactgcccaggctgcggtgcagtggcgggatctcggctcactgcaacttccgcctcccaggttcaagcgattcacctgcctcagcctcccaagtagctgggattataggcatgcgccaccatgcctgtctaattttgtattttttagtagagacagggtttctccatgttggtcaggctggtttcgaactcctgacctcaggtgacccgcccgcctcggcctcccaaagtgctgggattacaggcatgagccaccatgcccggccacctcttacagacttttaaacatcagagtaattagtaactttatgcagactgtcttggaatagagcagttgtcattaaaaaaactgtcatcttttatttctaacctcatgttcatacccttttgcttctctaggtaaccaggaatagctaaagagaagtctttttgaacccaaactgtagtattcttccattcttaagcaactgctttttcataataggataattctttcttcccattcatacataggcatgtgcgtgtgtctgtctgtatcgtaatatgtatgaaacactatggtggagggaactctgaatttcaagtttgataacctgtttttgtgtcagcttctttagtattgatgaatgtagatcctagggaatatgactgtactttttttactgttcacagctgtgaaaggcagtagtgctatctgagtactttcacagtatgacttttgggtccattgaaataatgtaaatgagcttcataagctataaaacattatagctaggaatatgatttattggaaatattcagatattctaggtcttcgttctctatttttgtttttcaggagaactcacattaaattgtagacattaaaatgtattgtctctgcttagaaaaagtttttgccaggcaacattgcatgatgtataatttagtttattaaatgtataaaatttgttgataaagtcagagcaataaaactttataaatatgaattagaactttgaggttatggggaatagggaccttttatcagccttatcatccagtttgtcatatacagtttataaatgtgaaagcacttgtgatgaggtcaagtatcacgtgaaacacactttggaaggcactttgctaagccctggaccttatctggtgcctacatttacagttaggtattttgagggggctcctgctccaggacctggtattcaaagtcccttgtgtatatggtatattcttgcatggggcatttttatcacttaccttatcagggaaaatacctacctgccctaggacctttgtccctttataaaaattactgaaattatacctaaattaatcatttctgtaattttatcatgtaacacctgatgcaatgaacaatataccctcttttcttgtcctgtttaacatattagcttcaggaaagagtcaacctagctaaaataggcatttaaaaaattacagtaatcttttgttttcccaacatccttggtctgtttccagtccttttttttttttttgagatggagtctcgctctgtcacccaggctggagtgcagtggcgtgatgtcggctcactgcaagctctgcctcccggattcacgccattctcctgcctcagcctcctgagtagctgggactacaggcgcctgccaccatgcctggctaattttttgtatttttagtagagacggagtttcaccgtgttagccaggatggtctcgatctcctgacctcgtgatccgcccacctcggcctcccaaagtgctgggattacaggtgtgagccaccgcgcccgactgtttccagtcttacctggaaccattctaggctacccaggcctttttttttttaaagtatttaccatccagcccaaaatgtcatacccaggacattcttatgtgactacattctgggaaaaaccatactgtttactccttccccttcctgtcttgtagtagagtccttccaggcctgtgtggtcctcactggcaatataagtaaatgtatcactatccaaagtgcctgagatagacaatacccacacatggactatggagagaggtgagataatagtaaaacagcagtttaggatatcttgctttaaatcttctgttgtacttgggctaaaatcagaacgtctcttacagttctgttgttttcatttccttttttttctttttctctttttcaatttagatattttctgttgatctacttttgagtttactgatcctgtttttgtgctgtattcagtctgttaagcctacgtaagttcttaatttcaaatatatccttcagttatagtatgttcctttgatattatagaccccaaatctgttgaaattctccattttgtctatttccttaatatatttataatagttactttaaagtcttctgtgtggcagttctaatgtctggatcatctgttggtctgcttctgttattgtccattcttttctttctcaaattttcctgcattttcatgtcatacagcttttattgtatgccatatgttttgtacattatgtaaaattcactcataaagatcttgcaaataatgctctccccagagtatttgacctttcctacctttaccaggtagatagagagaagctccccttaatctaattagcgattgagctgggtggggctagactgccattttaatttggtttagtctgccactggattatacctttcctgcaaacagcgctccagggattttgattgaaagtttgttagactgtcacctaacccctgaaacactgggagattcacttctactttttcgaagtatgaggtgactttgaaagtatgagctctttagcctcagctttaagatctgataagcgtcttgagggggaatactcatgtgactgtcaaaagttctactgttttattcctcagagcttcttttctcagaccaagcctttagcctgcacctagaatctacacgtgactccaggggaggaagtgataggcatttgtcagttcacctagaaagctgctttgctgcagttttagttcatctggatctcattagtttgatagctctccattgtcttttgagcaagttttttttttttcccttttttcccctctagtaagaacattggactgctgtgacctgcttatattttacctggagttggaactatagcagaatgttataataggaaatgttctggtatttaccaaatctggtatttaccccaaatctgagaacagtagattgccagtaacctgcattcaaaattgaggtgctatagtgttcatgcagaacatgcagaaaagacaccctgagtcaagcattgctacagttaaaacctgttactcacctgtaggctgtataaagatcgtgagttcaagagaaggaccccatagtgaaaagatttttggcgagagtagtatatgttaaggtatttctcccttttgttaatccaatttgaaggacttgacgagaacttctcagtttgacatgtgtctgctgaggtttgagagataaatagactggtacttgacttctatctgaaaaagcctaaaaagtgagataaaggctggagctgcccctgtatcggtagaatgaagaaagggcacaatgggagtgggccagcactttgtcagagtttgatgggtcaaaggtggaagaattacccccatggacaaagtagacgttagtaagacataatagttgaagttggcttaccttgaaaggatcaagaggccatacttggttgaagggtcacagtgatccaagcagacaagcctgagaagttcctgcatcaggaactaactataggtgagagtctgcatttggacttccaacctccacaggactccatcacacattactgtcacatcagattacagtccagccagccacttaagatcgtgccccttttctctcagactccctcttcctgctatttcagaaccgggaggggccttaaaaataatagctggagagtactggaagaggtagcgtgaaaagaattaatgagatagtaagattttggctttgctgtggctggattttaatttctgaagacatttattgttaatacaaatatctggatatgactaggaagtgttgaaatctttttgggattttgtgcagacaggataaaagcagcttgggaagagcttgttggagagcaatgactagagtggtggtggaagggagctcactaagtctagtttgtttcatgagctgtctgtatcctctttttgaaaattgagaattccaaatttagtggttgctggggacaggaagaatatgtggggagaaaagagggatgttacgtgtgtctacgtgaaatacatgccattttaacaaaagccttttctttttttttttttttgcatataatcatgatactggttaaattagccagtgatgctttattttcaaagaaatgttacaactacagttttcttctattatcatcatcgttttccttgaagcggtaggttagtctttactctcaaaatccaacttttaactctgactttgggttatgatgggaagcgctatgaaatggtcttggtgctcttatgaaactgtgatcactaataatacttaaattagaactgaaatatataaggagacttctcactaactccttcaccccagccttttgtcttttagaactttgcttatctttatggttagatagatagatagatagatagatagatagatagatagatagatagatggatagatatagatatagtttctctgaaatttgctaggacaacggggtttgggggcaatgaaagaaggttttatatttatgtttaggatgatagggacattgagagatactgaacacaaatttataatgaagttaagtaatttaaaagggttttcctgtaatttttatatgatgccttatataatttgcatccacaggtataaaacattaatctatgtgcttaaacatttgcctaaacattttaacatgttatctaaacataacctctatgcataaaagcagtttatcacattcagagtgctatacagatttgagttgatttttattttgtgggatgctaattgtcaaaaattgtcagattataaaaacttttacaatcaaagtcaagcattataaaactgtataacttaaaaagttgaatttcatggaatcacattctgtattgtaatcattgttttatggttgatgtaaagtcatcccttggtatccttgggataccccatatctccaaaatttggagacgctcaagtctcttatataaaatggcatagtattcgcatataacctatgtacatcccccaccatatactttgttttggaggcagtggggagacagcgtctggctctgtcgtccaggctggagtgcagtagtgcagtgttggcttactgcaacctctgcttcctgggctccggtgatcctcccacctcagcctcttgaatacctgggattacaattgtgtgccaccatgctaggctaatttttgtatttttggtagagacagggtttcatcatgttgcctagtctgatctcgaactcctgggctcaagcgatctgcctgcctcagcctcccaaagtgctgggattacaagtgtgagtcaccatgcccagcctgtattcttcattgttgtattgttattttatctagtttttcctctagtattttctgtccatggatgtggagcccacatatacagagaccaaccatgtattccagattttatgcacttattttaagattagaataacatgtacttatattttatatttattttgtcatttatgttactatttttctttttaattgttaaaaacagtatatattggccagacacggtggctcatgcctttaatcccagcactttgggaggctgaggcaggtgggtcacttgaggtcatgagttcgagaccagcctggccaacatagtgaaatcctgtgtctattaaacatataaaaattagctgggccaagtgtcataattccagctatctgagaggctgaggcatgagaattgcttgaacccaggaggcggaggttgcagtgagccaagattgtgccactgcactccagcctgggtgacagagactgtcttggggggggagggtatatgtgtgtgtgtgtgtgtgtgtgtgtgtgtgtgtgtgtgtgtgtgtatatatgactaaatctagaaaatcgataagctatgttattaaagtaaatgtacctgaaccctttcagtgttagcttttgttttctttaagtaaaaagtttgtatttggaagggcttgaaatacttcaaccatttttagaattgatatttaaatcttttcagtagtagagactattttgtgtgtgggagatactttgttttttcaggggcagcagaaatatcaaacggtatctcagagtagagtttttaataacagcatttggaggtggaggtggaaaatattgagaaagtttttttcaatcatcacctggtccttcttctaagaaaggctatactatatcaaagatgagtagaagtgtcaattttattcttataggactgtgtgacttacaggagtgtgattatggaagttctgttgtctccgcctattttttatttagttattaatatttggaaacctaagctgcttattttaatttggaaggggctttctcaatttacttgtccaaagaaattttctttcctgagaaaatgtctcttacagtgaaatcttcagtttttataattaaacatgttgtgtaaatgttttacatacctgggatattataccagttttattgttttagctttgatttgctatgtttatattacttgtttctttttagtaactatatatggggcggaataatgttaataattaaaaatgtggcctctgtctcttccacttgctggctgtaggaccttagacgtgttactttgtgtttccattacctcatttgtcaaatggggacaacagtgcctgattcatggcactgttgaaggattaagcggtttaatatgtgtaagagcttggtacatagttggtgcttaataagtgtgaactatatgtgggatgggattttatatataaaatttgattttgaagtgaaactgatgatgtcacttatattacatgcaccaagagggcatgaaaaggtttattactcacataatgatgctgtctgagtagagcatggcaggcttccaagttggtccaaaaatgacttgagagagcagtgataggagactggcttggggttttatggtgattagggaatggggctgtgggctggtttttacactgtacatatgctgagacttgcctggtttgaaatttctctaatatcaacaggtggagcacctgggctttcttaccagcttgcccagattcgaggcagaaggggaagaggaaatggtggggcttgaaacctatcagcagtcaagtatcagaaatggagttggatttcttattcaacacaaacaggataaataaaaagaaaaccacacttagatatatcatggtcaaactcatgaaagaggaaatcttaaagcagctggtgaaaaatggcacgcagcatacaaatgacaggtgatcagcaacagagaagattgtaaagtgatatatctaaatcaccaacatcagggagtcataacaataaattgtatctgcttaataaaggaacttaaaaatacatgcagcaaaactgggtagaattaatgggacagaatcacaaatccacaattggagagttcaattagaacaaaaaaatcagtaaagacatagaagttttaagttacattattaagttacattattaactacctacgtgatatttatagaatactaaacccaacatgagtagaaatacaagcgtttcaagtgttcatggtaacttcaccaggaaagactgtttacagggcacaagtctcaatcaattttaaaagattgaaatccaaagtatgttctctgccaccaatagaataagaaattaataccaataagacatctgttaagaattggaaattaaaccttaaaattctgacttatgggttattcaggggaaaaatgaggtaaaatatatttcaaaccaaattataatgaaaatacagcatatcacatatgtgggatgtagctgaaagagtgcctaatggaaaattttatagttttaaataatctgctaggaaagaaagttacctaaaaagataaaatagaaagtaagtagaaagaagaaataataaaattaagagtagaaatcagaaagccaaaagcgagttctttggagagataaacgcttgttagactgatcaagaaaaagacagagagcccacaatcacaaatgacctatattggtactgaaagagggattgtcatggtaggtcctacagacagtaaaaagattataagcaaatattataaacaattttatgccattaaatttgatgactaactgtaatgatgaaatttaggttacccccagctgatgcatgaagaaatacaagatctgggtagccctataacaatgaaagaatttgacttcataatcaaaagctttcctgcaaaggaaacttcaggcccacatggttttactggtaaatttaagcatttgtgcaacaaatatcaccaatcttatagacaataaactcagaaaaatgttgttttatgaggctcacataaccctgaaaccaaaacctgacaaagatgcaactaaaagaaaagttaaagattaatatatcactaacatacatgagaaaagaatacatcataattgagttctattccaacaaggttagtttataactttcaaaaagtaatcagtgtaagccagccgcagcggctcatacctgtaatcccagcactttgggaggccaaggcaggaggattgcttaagcctaggagttcaagaccagcctggtcaacaaagcaagaccccatttctatagacagataaaattacccacccaggcatggtggcatgcccctgtggtttcagctactcagaggctgaggcaggaggatcactcgagcccaggggttcaaggctgaagtgagctatgattgcaccagtgcactccagcctgcatgagacattgggaccttgtcccccacccccgaaaaaagaaaaattaatcaggtcagatgcgatggcttatgcctctaatcccagcactttgggaggccaacgcagtaggattgcttgagagttaaggagtttgaaaccagcctaggcaacataagactctgtctccccaaaaaaaaaaaaaaaaaaaaaaaaaaagccaagcgtggtagtacattcctgtggtttcagttatttggaaggctgaggtgggagggttacttggacccaggaagttgaacctgcagtgagcagtgatcacgccaccacattccagtttgggtgacagagcaagaccctgtcgggcaaaacaaacaaacaaacaaaaaaactatgtaatttactgcattaaccaaggagggaaactataagatcacctcacttggtcaaaagcatttgacaaaattcatcatccattcatgataagcattcccagcaaatgagaaacaaagagactttctcagtctgataaaaggtatttaagaaacactaacagctaaggatttacttaatcatgaaatactgtgttttccctcaagaacaagacagggatgtctactcttgtgtccttattattttaatagaagacctagcaagcgcaatgagtcaggaaaacaaaatataaaaggtttaaagatctgaaggaatgtttcaaaattctgtttgtagatgacatgcttatttatgtaggaaatcctaaagaatctataaatatagccactaaaacaaatgagtaaatttagcaaggctgcactttatagattcagtgtctaaaaatcaattgtatttttgtaaatactagcagcagacaaataggggtgttaagaaaattcatgaatagtagcatcagtactaaatacttaggaatacattaaacacacacacacaatgacctctgcttaaaatgctgaaaccttgctgagagaagttaaacaaatgaagagggagttgtgattctcatatggccaggtatgctcttaccagactgacactccctcaataacaaactgcacaaaattctaaaaataacatgaagtactggagaataaacaaaaataggcatgttttagaggggattgacactcggaagaaggaaatggcttttctgttttacagcttttgtccatgcaaagtgtgcagggtaggtaaaattccaacacaaaaccaagtctttctggccttgaagcaccataggtaagacttgggagaatcacaactattggagagtgaggagtgaatatcagcaaggagagtttcagaaagagagccctggattctgcctacaaactttgccaaaatcacctgctgatcccacatgtgtacggtagacagtacagccagataatcagcctgatttgaattgctccaggacagagtttgtggtttgaatgcaaccaggttagttgtctggtgaaacaaaaatgaagacttttggaagattgtaacagaacctctaactaccatcagataaaattcacaatgtctagcatacaatcctaaattacctaacatacaaagaacaaagaaaatgtgaccctttataatgaggagaccaaccctagaagacctacatgttggaattaccatgcagtaaactgatggatacacttgtgaattggaaaactcagtaataagttagagtacttaaattaccctgacttcaagactcaccttgaagccatagtaatctgtatagtgtgatactgacataaaaacagataagatagccccacatagataaacactgtgtgcctatatgattttcaacaaagttgccaaagcaacccagtagggaaaggaaagtctttcaacaaatggtgctggaacagctgaatatccatgtggaagaatgaacatgactccaccttacaccagtgaaaacaaaatatttctggataaattgtagtctaattaaagctaaaactataaagcttttataagaaaatataggagaatatttatgacttgggggtaaacagagaattgttcaaagtatatagaaagcagtgaccatgaaagctgctaagttagactccattggtatacaaaacatattattaaaatacattgttaaaaaataagtcagagtgggagaaaatatttgcaaaacatttctgaaaggattgaatctagaatttataaagatttctataactcagtaatgtaaagatagcctaattttaaaatggacagtagttggctacttcactgaagataaaggtccagtaaagaaatggaaaaatgtgtaatatcggtaggcttcaggaaaatgacaattgaaaccacaatgaaataccactgcacaatcatcagactacctgtaatttaaagactgaccacaccaaatgttgatgaggctttggaataaccaggagctctctctcatacattgaaagagggaggactgtaaaatcgtactctggaaaatgatctggcaatttattgaaaagctaaacatgcatctatccactgactcaagattttcacttctaggtgtttacccgagaaaaaaagaaatcatatttctatataatgatatgtactttcttgaatgttcatgacaactttattcacaataattaaaacctggcaacaggtcaggtgtctatcagtataagaatgactaaataaatcatgcttgttcaagtaatggaaaacgactccacacaccacacacacacacacacacacacacacacacacacgtcatatacattaacatggatgaatctcaaaatcatgctgagtcaaaaaagacccaaaagaatatgtaccatattccattcatacatagactttccagaagacacgacacctatggtgaaaagatcagattagtggttgcctctggggatgagcgcatggatgccagacattgagaaatggacatgggtgatgatcttgacagggttgagaagtgtacaatgtatgcatctgagaaaactcaaatggtaccattaagatgtgtgtttcatgctgtgtaaatttaacctaaagaaaaaaagaacagcgaactctagttatgtgcattcttaagtgtctagatttgtgttatctgcagcttttatttttctctctgagacagggtctagctctgtcattcaagatggagtgagtgcagtggtgcagtctcactgcagcctccacctactgggctcaagtctcggcctcctgaatactaggagcataggtgtgcaccagcacacccagctaatattttgtatttttgatagagatggggtttcaccatgttgcccaggctgcccacatacacccttatttttaatgttccaaaaagtaagggatggatagagaggttaagtagatacatgagagagcaaaagaaaacaaatccaaattacagaatttagctgatcaatgtgtagggtgcttactcgtaactttaatggatgtttgaaattttttatcatacagaactcaggagaagatggaaagcttgttcatggaagtatctgagaagttggaataaatacttagaaactgttgagtttttcttttctgagatattcctctccaaaagtttgcttgattctttcgttttgttttgttttttaagatgggatctcacggttacccaggctggagtgcagtagtgcgtcatagctcactgtggcctcaaactcctgaactcaaactatcctcctgcctcagcctcccaaatagctgggactgcaggcacatgccaccatgcctggctaattttttaattattttgtagagatggggtctcactttgttgcacaggctgtttgcttgattcttaagaacgtatagggatccagctgtacagagctttctgcagtcttttgtaatagaattagttgttaaaattgtacttattacatgagcatcaaagaccttggaataaagctattcctcacatatctggacattatttggacttactatgttaccgattaggaagacttggtattagtttattttttaaaattctgtttcatgtgtgttcttataaaattatacaaataacagtaccacaccattgtgtggtgagctctacttagagctctgtacagcttgggtatctggaatgtagacatgctctgttctgatttgaaacttagaatgaaaccctgacataccggaatgcacatttggtgactgtttgtttttgaatggttactatttcattgctacaagataaaatcgaaaaacattttctacacagagtgaaggtttaagccagttaaggaccctgttaaactgtctccagatttaattactgcccaattatgccttaattatgaaggaatgtgagcacttattagctattgttgatgattcaacctttttgaaataaatttcttaatatatttcttttatattttcaatttttattcaggaatatctcaaattttcaagagatacagttttttgcatctgtaatgcagcaacttaaaaaatcatttgcacctacttatttctcaatcaggattgtctacattttgcaaataaaatatggggaagagactggattctgaggcaaataaaaggctatcattcttaatcattgattaaaaatttaagtttaatcaaagtagtcacattgttttcagtgatgtgataaatgacatttaaacatttgtaattgaatactacaatctattttgtgtctttcaattatatttgtagtcaagataaaatatacagccacacatagtacttgtaattatggagacttaaaaaaattattacagtgattaactcttcattcctgagctgtttaaatctaaacttttagtcttaagtcacatataaaaatgaaaggattattttaagtagaaataattatggatgcatagttacagattactcccctagaagtctgtattaaatgagtagatcagtaatcaagagctggagccttaggaaagttccttttgttgataatattctgctaattgactaattttactgagtgttcagcatgcttttaatcttaccaaggtggcaacttaggttgttatcccttttgatttgttaaaaaaaaaaaaaaatacactgtttaggcaagaagatcatgaaaaataataaattagtaaaacagtggggtttattacttttgttattggttgtctaactgcagcagtaaatcttgcagatatggtaggaacagtaaaactggtttaaagggttaccagattctgtgatgcgagccaccttttgcccaaagttggtagtgttttcttcaacttaattttcactgcttctcttttctttctccataacaaagatgtgaataaatatctatatccttaacgcaaaaaaagtagtaaattgaccaaacataatatctggataattggaacaaagtgcaaaatgttaatttagatgtgtatatatgtaggcgagtgtatactttgtaaattgtacactagatattaaattttaatttcagttttcaaaagtcagcttattcttagatgaagaaaatctttgatgtgttttactgaaatacttattgtaaaagttattactagggaaatttgataaggatttctattaggtttattaccaagtcatcctgttagtttagtgattaatatactgtatgccaacaaaggtagttgctatattagtatgtttatgactttaatagctgttttgcctctcctccccacctctttttaatttaagctagatatataagcaagaacattacacagttgatgggggataatctgtctttaagaaactgttccatgcaaagaactttgggactttgcgtgagataacatacgtatgcttgttcatctgtatattgatgcagggacatcattgtagttagttaatggtctgctacatcttatttcaacatattgtaatatttcacattaatttgttagtaaacagtatcaaatttgttcaggcagaatttatgagaccaatttttgctgatatttttcaatacatgagagttttaagaatatcctgaagttagatggtcaaataaatttaggaaatgttgagccaatgtgtttgggatattgctatcattgttataataacttaataatctctttaggatatgttgattttacatagcaagtagtcttagtttaacattttcagacctattttctatccttagtactttgtaaacagcttgatgttgtacaggtttctgtttttcacatttgagtaatgtacagacatttcttgtggacttcctttaatattatttaaatgtatagaaacatacttaagtgcaaacttaacgctaaccaaaagacaaatttatactcagttatataacccacaaaattccaattaacatcaatttaataggtgatggatactatttttacataacttgcaggttactttgaggtccctaatccatttagtcttacacagtgcttgatataaagtagctagcttatgaagacaattgtcattaaatatttgtttgtaagatgcacatttttttcactttgagatgccccttataaataaaattgaaagaggattttcaagtgttacacaaataatgttgcattttaaagtagataatcttagattagtgaaatttattgaatgtgtaaaaagctttttatatagttgttataatcagtgctacttctctaaaatttttcctgcatttgtttcttttaatattttttagaaactggccatacctagaagttataacttacactttttattaacaaaatgaaaacctgggagatacagtttttccccagtgttatttaggatgttatgatttaatgtgataaggaatattataatccacttttgtactatgaaaataccagttgggtcaccaaatatgttgtttgctgggtggtacacaaagggctttgggagctcagggtgttgttgggaaatacattgtggttagacagaatctttaaggaagagtgggtgattaaaactgcctcattaaaacctaccaaaggcatcttaaaaattgacctcgtttgttagacttattaaagaattagtagtaaagttaaaaggtggctaggaaggggcagttaacataaattgcacatggaagaaaattggtaccaaaggttcatgtgagacagaaaggacattgtgtgagaaaagaatgatcagggctcaggctggcatgttattatttgtctcttatagtaatgcccaaactgcgctttaaatgatgcagtataggaagtaatgtgcctctaatgttttagaaccatatctttttatagaagtgtcaagatgacattgacttgcattttattctctggcaatattttcttctgttttatttttacaattttggtgaaaggcaatatacattcacatggctcaaaaatacgtatgtttatgtatgtatacacatacaagcatgcatatacacatacattggaacctctcccttcccactctgcacctcaagtaactactgtccatgatgtatgtgtgtctttatgcatatattagtgagtaattacagatctttttacctgtccttttttaatacagggagtagcatattttagacctttccatatcagttcatagggtgccttcatcatatgctaaattgttctatgaattttttgttgggactttttctgttttggtttttacttttctttgcattcttttgtgtttttccttttttcaggtaaattttttataggtgaagtgcacaaatcatatattcagtttagttagattcaacaaatgcatataccagtgttttaagataaagaaatttcaatcatccagaaagttctttcatactctttcctagcggttcttctggaaacaattactgttgtttttcactttgaatttgttctgccacttctagagcttcgtataagtggagtcattcagtgtagatactttagtgttcagcttctcttgatcagaatattcccaagattcatccatgggtcagtaattctttttcaagattgttttgctattcaagatccttagtatttccatatacattttatatcagcttgtcagttgctacaaaaatatttttgctgaaatggtcactgtaatagatataaaacaaataggcaacaatcattagggaattaggtcagatggacatcttaatattgactcatctgtgaatatgctgtatctctatatacttagcttttaaaaaatatctttgagcaaagttgagtttgggcagagttcacagtcacattgttgatgtttttcccttgtgcctctttctttacagggtatcttccttcttttttcaaactctctggcagccccaaatgtgtcctctgattctaggtcagtaaaactgcagttttctaaaaacaacccccctgcagtgttctgtttgaattctagttgccctgcctagctgtggctggggagtgcccttgggtacacagccacagaaatgcagctctcatccagtacagtttgcagctttgacagttggacctcccttcagcttttgtctgtttttgatctgtgtctgctattttcaaatagttgattattttgttcagagtttatcattgttatatgaaggaaagttagcctaattgaggctgctctgccattactggaattagaacctccattctgttttgtgtattcttttactaattgcatactgttttaattattgagaatttattatgtgcttcagaatctggtaggacaggtctttactatttgttagaattttctggtcatacttatttgttttggcttattacagtatttggactaatacctggatttttaaaacatttatttttattgagattgcatcaaatatataaatttggtagagttaatacctctatgatggtatcttcctgtgtagggacgtatgtttttcttttttgctcagtgcacttttgtgttctttagttatgtttaaaatgtttctttgtatagtttgacacagttttaattacatttatctagatgctgcttatacaactctcactatctaagggggattggttctaggatttcccactcataccagaattagtggatgctcaagttctgataaaaaatggcattgtaagcctgggcacgttgacttacttctgtaatcccagcattttgggaggctgaggtgagaggatcacttgagtccaggactcaagagactttgtctctacaaaaagtgttaaaattagccaatcgtggtgacacacgcctatagtcccagctactcaggaggctgaggctggagaactacttgaggctgggaggtcaaggccgcagtaagccttattttaaaaataaaatggcattgtatttgcatataacctatgcacattttctcatactttaaatcggctgttcccaaccgttttggcaccaggagacagagtcatgaaaggcaagttttccactgaccgtggtggtgcggcaatggttttgggataaagacgttccacctcagtcatcaggcattagttagattctcttaaggagtgcccagcctaaagccctcgcatgtgcagttcacaatagggttcttgctcctatgagaatctaatgccactgctgatcttccaggaggcagagctcaggtggtaatggtctctcccctgctgctcaccttctgctgtgtgtcctggttcctaacaggccgtggaccggtatcagtctgtggcctctgagactcctgctttaagtcatctctatattatgcataatatgtaatacattgtaaatgctgtgtaaatagttgttataccatattgtttttaaattttgtatttttcaattgttgtattttttagttttaaaaatttacttattttttctactttttgatccacggttggttgaatccaaggatgtggaacccttggatacagagggctctatgttttattataaattggcttattttaaaaaatattttttattatgtaaacaggcaatgattttactagctagaagcaaatttaatgttttaaaataaaccttccaattttgttaggcatgataatgatggaactgaggcttaaatataccctatggcagcagttggaaagtggccgaattagggttggggtctagatctgtctgcctctagattgattgcaagttcttaacaattactgtttattcttctctgattcctttcaaggattaaataaagtacaatgtaaacttcatgctctattttagattctggttctcatgtgagtcccagaataacttgagtgaaatgttctgatacagagcagaatagcctcttgtgctacacttttgttaattattttcaaagaatagtctcctgtataccatttctttaataaactcagactcagaagtctgtagaattgaggtgattctgttgtgatttaaactacatcatgctatatgtttccaatagatatttgaaaatatcttttaaataaaccattaatgtcatggtttttaaatcagtatatctttggaaaaaagggaaaggtctaagccttaatttacctggctttttctggcttttatagtctggtaaattttgcagcctgaaaaagcaagagaatctataaaatacttgaatgagatgctggaaaatttcagaacaggttttgttttgaactgtcgggtcactgtagcccccaaagcagggcatgatgtgttcctgcagcctgatagctatgtgacagcacctgtagtactaaagccaaggatgccaggtggttctgttgcctggccacaggaagccagcgcttctcaccattgccctttgaactgttgatccagttaagctcactaacaatgtgtaaatatgaaatttaatcaattgcttgattcattttcaaaagatgttttgaaatactcctttatccgcattgaagttttgatgattttgtaatatgtaagaaatggacttttcagaaaagtacaacttagtacttgagacattggctgtcaaagttccattccaaaacttccttttaagctctctttcccttctctcactgaccagaagttactatgaaatgaaataaaggtagggaaaaagggagaattatctctgagctgcccatattctggagagaaatgtgggagaaaatttttaaggtggtatactaaattagaatgacttcaaagtctatttctttatttattctagagatgagaacaaaataattttcagtaaaacttaaaaatatcatgaccagataacctgaaaatcttaactgtggatgcatgtctatttttattgggatttttttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaatgtttcagctgatgttttaatcaatgcaattctagtttgaatcttctttaaattactgtatcccctaaagaataataattttgataactatatatttattttagcttgagatcagattataatctgttgttggcctaatttttaagtagatacatgatgagttttgctaaatttcttgttatcagaatctcatctttatactaataaaatacatacttaatgaaccccttatatcacaattaacagtaggttaactcatttttatgttactttttttaatcacttcattttcttttttgcgtatatggtatttgttcatttcatctcatcatattcatcaccatccacatttatttgtgaactacataaatatacctcagttctcaaaacagtcacaactgggtaaagagttgcagtagtctgaggaagttactatcacatcattgttggtatttatcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcactttttttttttttttttaaagttccctcctttcttttccccttgcttcccaacaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccctgctgcagtaacattttcaagcattttgcacttggagtgcttttagaagtactttaatgacatcatttgtatgtacaccgtttagtaaagcttgtaacaagacttttcatttagttagctgtctacctgaaactattaaaaaatatagcagtagctgcgtttttggaaaatttcctatatctgattttacagataaagacaatgttaagttttgcaatggggatttatgaacttttatggtaatataatattaccaggatcacattgttcccaaaagtttgagataaattagaacttggaaatttggataatagactacctaagttagagccataatcagatttgtcattttctcagtaactagtatatatcgagtaggtggaccctagctttaaaaattaagctacaacttctcttcttgttgaaaactttaaaaaaggttcccccactcccctttgctctttgccattaacttggatttcttgaactttttcagttttgcctccagtattagtgccccgacacaccgagatcctaacagaacttccgcctctggatgactatactcactccattccagaaaacactaacttcccagcaggaattgagccacagagtaattatattccaggtatttttgccttctgaatctcctaaaacttggatagatacaaattttgttcataagcattcaagttttagtaaattgtggtttcacttttttaaaaatgcttttgagtttttaatagaaaaattggattcgttgggtgattattttgtgaaatgtataagcctagtacattaaacagttttgtttggagaagagttttactttatatttcattttcttttgcagtgactttaatcaaagtactgtgagaagcagaaaagaaaagatcttagtaagtttgtcttagttgttgaagctaagcgagatgcagaatgtaagcaaaacaaatggtgtaggagaaaagtaccccccaaacacatgtaactgaatatccacccaatgatcactttttcttagataacttggtaatatttaacagaaatataacatttctataagaaatataatacttagttctatagacatagcaacacttacatattataacccgaacgtcagaaaacctcctttaattatgtttcgtctgcatctcagtaatttctgatgaaaattgaattcagctacatggttctcaaattttgttctgatgtattatgtgatccagtaatactccacgatatgatatctggccttttcgttttttatggtttcttttttttttttttggagaacaactaatactttgttacttttcttgtatgttttcctttttgtttggttgatttttctccctagcagaaacagcatgatgttaggatgaggattaagctgtagtgtctcgatttctttcttccttttgtaatattcttttattccactcttattttatacactaaaaatatgtaaggaacttaagagcatttacaaaattcttaaaatacagttttagtacatttaaacaattatttctttcatgtatccatcatggaaataatgcttattcattgaagataattttttaaatgtaaggaagaaaaaaaagaaaagataactaagaaagataagttttttttttaaatagctggttttacaaatgggaagtggtttttgattgttttaatgtatatttctttgattactgttttattccagaagaggatttaaagctgctttatgggttgctaggaaatacaaacttactgaagttaagagagggagagggtgggatgtagtatgataacactaggaggagggaaaacccgggactatgaaacagggcaattgctaggtagaaaagggagtggagttgtgtgaacgttggtgtggggaaggggaggcattttaagtcgttagtgtgggaattactgttattcagccagcaatactaaccttaggtataaacatgcagtcttagggacaacacgcatatccagtaattatttggaaggctattcaccagaatgtttagtggctttcacttgtgaagatgttcgggctcatttttcctttcttttttattcctttaattattgagatttgagtattttataaagtagaaaatcagaagtggattatacccatttgcttttctggacagtggggctttatccggtttcaagcaacagcaaaaccaaagggttcacattttattccacttaaaagaaattttaacattttctcaaaaatgctaatagctttattatttattacaataatggaaaaaataaacacagtaagataacgtattttaaggttcagcatttctttctgattagatctttgaaatacaggttaaactcaaaaagcttagcgccgtttaactttattagctttaacttttaaaatatgcataatatgtacccttatttttatgttctttgagtatatgaagataatttattcttagaatttttgttttaaaaatttgggggtactgacacttaaatgaaaagtttgatacttaaagtttgtggttagtttattgaatagatattgtaaaaggttattgaaggagacccttaacctgtatcttctcttcctctttttttttttttttttttttttttgagacggtgttttgctcttgttgcccaggctggagtacaatggtgtgatctcggctcaccgcagcctccacctcctgggttcaaatgattctcctgcctcagcctccctagtaactggaattatagggatgcaccaccatgcccggctaattttgtgtttttagtagagatggggtttctccatgtttgtcaggctggtctcgaactccccacctcaggtgatctgcctgcctcggcctcccaaagtgctgggattacaggcataagccaccgcgcctggcctcgttcttttgataattttaaaattgtttggatatgtgtctttgttatcttgaatcgctcaaaactgttcagtgtaaatgtaaaactgatgaaagtcttctgaacttatttttcctccctggaattacagttgattaaattgtatacatgtttttattttacatgcagtttattcagctattcagatacctttctgaacataagtgttttattcagacaacatgttggaaataatatattagaatcctaatggttattttcagggagcattttacctctttatacagtagtctatatttgaattgaattttctgcttcaaacacttagactttaccagttaggaatccttggagaaacacactttttagatagaattcagcctggaccaatccggaaccatactctaccatattttaccctatagaacttagtgtaagttgtaagcctgtattatttaatacttttataatccaaaatcttgtgtgttttttaattttctaagtactcataaaataacgatgttcattagattaaacaacaacaacaaaaaattgtagttactgatggttttgcagcctactgattcagatctgaggcatttttaaagttacgtttttggctcttgccccagaatatgtacatataggaatgagcaagatacgtacataatgtgtatgtccagagagtaggattttattaaaagtggatgttaaggattcactgcaaaatttggacaagatcctgaattatacaccctcagtatgcaatattactttttataatattatataacattattatttgttatttggagtgattcattggttatctctggtagctgagagaaaaggtagtgagattatgttgcagctgtgcttgatttgttttaaacttttgtagaaacgccacctcctggatatatcagtgaagatggagaaacaagtgaccaacagttgaatcaaagtatggacacaggtaaaaaaaatgtctttgaaaattcctcagttattagatatacatttcttgtattgtttgaaattcacaaaagatgttactcttaaatttagagaagttgagacgcataccaaaaaagatgatcttctatcttgatttaacatatctgaactaccaaagaggtccatgttgtcactgaaaaattataacgtatgctactctgcagaataattgttattttttattagagtaaatgaaaatttgaaaacatgcacatacttttatttctttttaagtatttgcttctgttgaaaattttagtaaccctatgactaagtatctctctgtgataaaaaaccataattactcaaataacagattttcagaggaatttgggggtgaaggatggggatcagcttttcactgcttttttaacctaatagtgagttttgaattatagtagattaatttcttatgcttagctatcaactccaaaaagtgatgaagaaaaaaattaaagctttaaatcacgtcttacgtaataaaatgtataactcagcagaactaataaactaccagtgaaatcactttgatgtcattgtaattgtccagtttgattcattttacctgtctgtatcttaactgttggacaccttaatatcacaacctgacaaattataccatcagtctttctccacatcttaacactaatgcattcttggttatgataatctaaattatttttaagtggattaacattggtgggggagggaggggttacaataattctcttgtttaaatccgtttttttggactcccaggtaaagaagtttctgctgtagctaatcatacatttgggtgtttaggagtaccagataactaagaaaggtagataatctaatgaacgttggaaataacgtgttatacatcttaatgcaaataatatttgactttccacatatgttttactaaaattagatgacactcttcttgaagcaataatattcttttttgcctgtgatggacagctgttactgtgacatttaaaagtgaatgatgggaaaagatactgaacgtcataaaccacagtgagatactacctcacacctactagatgctataatcaaaaaaggacaataacaaatgttggtgaggatgtggagaaattggagtcctcatatatcgctagtaggaatgttaaatggttcaacactttggaaaagtttcctgttcctcaaaaagttaaatacagagttaacatattgtggccagctatgtatccaagtgaactgaaaacatgtctactcaaaaacttgtacatgaccatttatgcaggcattattcttaatattcaaagttagaaacaactcagatgtccatcaaatgatgaatggatgaataaaatgaggtatgtttctgcaatggaattattcaaccatgtaaaggaatgacagtatagcatgacgtgtggcaacatggatggaccttgaaagcagtatgttaagtgaaataagccagaaaaaaaaggctgcagggattctaatttagtgcacagacacctattcagcaatataactgaaacacaggaggagcaataatacaagtattcgttatgtatgataaatgaatcaaagtacaaaagtggagaataagctgaatcagccagctaaaataattgcagtgttggggctaactttgaacccaacctaatatttctgtttcagtggagcagtgttactggctttctgaatgacaggtttaaaattactgtatggcaatgggaatatgtgattcatgagatgccaacagttagtttggctgccagcctcttacccaatatcagtttctctcttggggccatggcaagaaacaattctgactgatgcagggctccaatttagaacaaagttggccacctctctaactctggttcataccttccagaaggaaggacataattaaattcatctttcataacctgctgttaaaaataatgaattgaaattttttaaaagggcaaccagaggataaattaggcataataagtaagtgtacgaacaagcacttgttacttttttctttttttttttgatttagattttgctggtcaagactttattcttcctttatagtggatattagagatcaggctggacatcgtaagaaatttataagttcgattaacctttgtagtattgtataatcagtcccttttcaagtcatgatttttatgaacatatttgttcaaacaggtatatagagaaatagaatataatagatcataagatgtggatttcataactcacaattcagttttgtatcttctacatacactgtgcttggtccaagatacacaaagagacttaaagggttttttaatctgcctgtgtcccagaagataaaatgaggtgctaacctccaatacctcagaatgtggccttgtttgggagtagcatctttgtaaatgtagttgtttaagatgaagtcatactgaagtacgatgggccctaattctatatgactggtgtctttataagatagggaggaatgtgctatatgaagatggaggcaggtaactggagttagcacctgcaagctgagcaattcctaggattgttgggaaacccaaaagcttaagagaaaggcatggaacagattctccccttgagcctttgagagagcatggctttgctgacaccttgtcttgggacttaggtccttcaaagctctgaaaaaataaatttctgttgttttaagccacccagtttgtggtattttgttagagcaagccctaggaagctaatacagtgagtattaagattttgagagtatcctactaatatgtacacttaattatttgtaagttatatacaggtacttcaagtacatttaaaaatatatacaaaaattagaaattgaaggatgagattaaataaatagaaaatacattttaattttttcttcttgtaaactactagttttttgtactcctagacagttttcccatacactccacttacaagacttaatcctcttaactaaatgcatataatcaaaatagcatagtgagactctgagctagactatctgagtttgaaatgttcctcttacatatgctagctaggtaacctagtttttaaatctgtaaaatagggacaataatagcatttaactcatagagtattaataggactgatatttataaggcatctatgtgttctaacctgtaataagcactgtatgaaggtagttaaaatgttaagaggagttaaccattaagaaaaaggaagatagtggattgcacaaagatgtgaaggaaagtgaagaattgagatccagacacagaagcacttgatttttgtggtttaggatcagctctataaaataggaaagtaagatttttgtcaaaaatgaggggtcaggtttgacaacttcaggataatagtcttataacaatgccttttctctgccatgtgttaaacagtttttgatgtagatgtatagcatgtctttcattagataaattttttagtattttatacttttagtgctgttatacgtttttgtttttacattttattttccagttgttcctaggatatgggaaatacttgatttttgtatattcttttctcctgcattcttgttaaattgactttttggttctagaattctgtagattcttgaggttttctgcatacacagccatgtcatctgttgataaggacagtttttttttgtttgattgttttttgagaaggagtttcactcttgttgcccaggctagagtgcaatggcatgatctcagctcactgtaacctgaacctcctgagtagctgggtttacaggcatgcactaccacgcccagcttatttttcgtattttagtagagacggagtttctccacgttggtcaggctggtctcgaactcccaacctcaggtgatccacccgcctcggcctcccaaagtgctgggattacagccgtgagccactgtgcccggctgacagtttttctttttttccccagtcttcatgcttttttctttttctgtcctaactaagacctacaataaactgttgaagctataagaatggacatttttgcattgttctgattataggaagaacacatttcacaattccccctttaagtatgatgttaattgtggatattttggagattgtatctgattgaggaagttctttttcctttttgttcttaatgttctaattgtgttttataaatggctgttgaattttgtcaaattttttttctgcgtttataaagaggatcatatagtttcatggatttgaattgttttatttttgagaatttttccatctatgtttatgagagattggtctgtagggttttttcccttgtaatgtgtttattagttttaatatcataaaatgtgttggaaagggctttctcctgttttctcgaagagtttctttaaggttggcattatttctttcttaaatttttgatagggctgggcatggtagttcttgcctgtaatcctagcattttaggaggccaatgctggagaattgcttgagcacaggaggtcaagaccaacctaggcaacaaagcaagaccccgtctctacaaaaaaaaatttttttttttttaaattagccaggggtagtggcattcacctgtggtcccagctacttaagaggctaaggtgggagggtcacttgagcccaggaggtggaggttgcattgagccatgtttgcgccgctgcactccagcctgggcaacagcgagaccttgtattcaaaacaaagtttgatttttccagagaaaccatctcttgtaggaaaaggttttttaaattgagaattatttacatttttaattttgtgtatgtgtttgataaacttggattttgttagaaatgtgttcatttcatttaagtcataggattgattaattgagacaggatctcacttcgttgcccaggctggagtgcagtggcctggttggctcacggcagcctcaacctcccaggctcaggcaatcttccccactttagcctctcgaggagctgggaccacaggtacatgctactgcacctggctaatttttgtgttttatttagagataggatttcaccaggttgccaaggctggagaatgtattgatataaagttatttctgatatttgttattcctttcatatatgtgagatccattttaaaatttataatgttagtaatttgactttttaattttttattagaatgtcttgtaatggattaatcagtagtctttgttgtctttgtctcttttctgttttgtttgtattcatctttttgtctgcttacttttcatttaatctggtcttttctagcctcctgtggtgtacatttagatcattgatttgtttataatgtacacatttaaagctataaatttccctctaagctttatgttagctctatattacaaattttatgttgtttttaaattatcacttattttctaattcttcttgattcatgagttatttagaagtttgggtttttcttaggagtgtgaggattttctagatacttcatcaatttctaatttaattctgttaacagtccagcatatagtgtgtgtgactttagtccttggaaatttatgaaaattattttatgctataacttgtaacttatcttgataagagttccatatatagttggaaagaatgtatatactatagtgttccaaatgtcatttaggtcagggtggttgatagtgtttacatcttcttaattctttatgattttttaaaatctccttattttgtcagttatgataagtgttaaaattttcagctctgattttagagtcatctgtttgtgcctttagtcctgtcagtttttgcttcgtgtgtctttaacctctgttattagatgatacacatttggaattatacatcttccaaattaatttgccctaattataaaatgcatttcatattaacatcaccatatcttctttcttacctctggttacatgatatatttttaattgtttcagtctatccgaatctttatatttatggtgtgtttcttgtggacagcatatttttggttttatttaatctaacaatttttgtcttttagttggaaaatttagtccgcttatatttagagggattattgatactggctttaggctaccattttgcaattgtttgtctatttgttctctctggtttttatctgtttgttttcctgccttttagactaatcaaataatttttgtttcattctgtttactctcttggccttttaccagtaacacttagtattattttctcagttggcattctcgtgattacattgtacttatgttatacctagaagtttatttaagttgtaatattttacaacgtcatgtaaaatttaagaactttacaccactctagtttcattcatctacttctgttgtttgtactattattgacatgtattttacttaataaaaatatataaaccccaaagttcagtgttattttttgcttttgatatcaagttgatttttaaaggaaattagaagggataaaaagaagtattttatattcacctacatatttaccagtttggctcctttttgctgctttttattcctttactacagacatttctttcagttgttttagcaccattttgcagagacattcctttctccattgatttacattggctcctttgttgaaaatcaagtgataatatgtatgtgaccctgactttgagtctgctcttaatccaattaaatgaatttttcatttcagatcctttattttttagctatataatttccattttaaagtcttcgataatttgtgtccagttaatatgtaacatggcctgcttttgttgactgttttatctcttgattatggggtcatttttttccccctccatctttgaatatctcttgttttttaattggatagtgggtgttgtatatataataatattagagattaaaatagataacactttctttggaaagaccaactcttttctctatttgccaagttgaggagctgatcctttccctgcccttaggatttgagttggaaaggtgataatttggtgctttaatgtcacatcactcaggtttcagggagggtcagttccctaccttatcagaactttcagatacaaatatggcaagactgcatattcttatttctttccagccttgcccaggacttcctatgctaacatgtactcagctaaagacatgtattaaaactgactggtgaagaggagctctgtgcttgcagcttcttcgattcctgtcgtctgtgcatggccattgaaattttagttggcttctcctttggcaagctcagtcctttgtctgtgtcctgacttggcagatgctgtcagtagtgaaagtgattaccactctctgttaactggggaggagctcatccctctctgtaaattagttcctatggacttatttggatctatatctgtgtgataactttaaagaaaaatagaatttttctttgtttatccactgttttcttactgctatttcagaagcaaaggttttccccaatcttctacatactaactataaggggaactctgtaggagtttctaataaaaacaaaagcagccttttttctcattatgaacagaattatgctctcatagaaaaattggaaatatgtaaaacctaagatgctatcgcactggggattaagttttttaaaacaagaaatgaaaaaatgatcattcatgcattatatatttcataagctgaatttgatgattataatgttgtatcactttggcagggaagcttaatctcttatttctaccattattctgtgtcagataaaagttaaacagtgttctacacataagattatgatacagcatttcaaattatacaacaaatggatgttcattataaaaaattagcatagtcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaaaaattagcatagttaggcaaaataggaaaacttaagcattatatgtaattgcatctagcaaaaaattaaaattttaaaaggttcaacttttaccagaaattaaaaaacaatgctgtaatgaacctcattaaaaaatagctagaaaatgacagagaaattcagtaggatgtcagattctagagttcctgttcttgtttattacactatatgtctggctggttttaggtgacatgggggagaagtgggtgcttttgatacatattgctgaggcttagaatatgactagtgatcatatttgggttaaggttgaagaagcaacccaggatgattcccagttttctggaaggtttgtgaacactttagtctgtattcagtaaattagactttttaaagcatacatttttattgtatatgtttaaggtatataacatgatatttggtgtatgtagtgaaatggttgctgtagtcaactaaatccatcatctcacatagtcacctttttatgtgtgtgataagagcacctaaaattgacttactaaatttccagtatacaacacaatattgtaactgtagtcctcaggttgtacattagatctctgggcatatcttacatatctgcaactgtataccctttgacctataatctccctattttccccccaacctgtaatcaccattttattatgtttctatgtatttggcttaaaaaaaaaaaaccccacatatgagattatgccatgtgtctttctatgtccacctaatttccttggcataatgtcttccagattcatccatgccaaaagtggtaggatctccctttttaaggcaggataacattcaattgtgtgtataaccctccatttctttatttattcatctgttgatgggacacttgggttgtcttctgtatctttgctattgtgaataaaagcagcaagagtaaaagcaacgtgccacataacaagggagtcttcattagacaatcagctttttcagcagaaagtttgcaggccaggagagatgggtggtgtatttaaagtgctgaaagaattaaaaaacaaaactgaaattagccgggtgtgttggtacacacctgtggtcccagctactcaggaggccaaggtgagaaaattgcttgagcctaggaggtggaggttgtagtgagccaagattgtgacactgccctccaacctgggtgacagagtgagaccccatctgaaaaaaagaaaaaagtacccctgccaaccaagaatactataaccagtaaagctgtccttcagaaatgaaggagaaataaaaaatttttcagacaaaagctgagggagttcatcagtgctggtgtggtgaggatggggagcaacaggcacactcatttattactggtcagaatgaaaaatggtatagccactttggaagacagtttggtgatttctcacaaaactaactatattcttaccatatggtttagcagtcttgcttctccttggtatttacccaaatgaattgaaaacttaggtctacacaaaaacctgcagattgatgttcatagcagctttatttataatttccaaaacttggaagcaaccaagatgttttaataggtgactagataaataaactgatatatccaattaatgtacaacaggtcctcaagtaataatgtcatttcgttacagtgttgatgattggggaatgttggttttgttgtacaattattttgcttaagtcagtttccaaaaacctatggaagatgttaaatgaagacttactatatatgacattctggagaaggcagaactatggaagcagtagaaagataagtggttactgaggctttgtgggaggtaaagaggactaggtggagcacagggcatttttagggcagtgaaactactctgtttgaaactgtaaatggatacacgtcattatacatttgtcaaaacccagagaatgtataacatagccctaatgtaaattatggactttcagtgataatgatgtatcagtgtaggttcattattataacaaatggaccattgtggtttgcggatgttatagggaatttggggaagcagggcaggggtcatatgggagctttttgtactttctgttcagttttgctgtgatcttgaaactactctaaaaaaaaagtcttttttaaattaaaacaatttaatgtcaccttaaaagatataacagattttttttaaaaaaaaacctgggtgaatatttgcaaatagatgacaagtctaagaactgatttttaagtttaaaaacttacaaatcaagaagaaaaagatagttaatagaattggctaaaagaacagaaatacactgtttacaacaaaaacaagaaattaaaaaattgctccttttaaacctatcatattggcagatgtcaacatgtagtgacacggtgtgaagaaacactagcttataaattcttagtgagatgaaacatttttgagagggtattttggcacttataaaagtttaacacattttatttgacatttgttaatttgtcaaaggtttgacgaatgtatcctacaaatatatgtgaatttgtatgcgaagatacatgcacagggatttctgtagatggtttagctgtaagtagacactgctaattcacactggatctcaaataggatatttataatattctaagtggaagacctgtggtaggtgagactccaatagcagcatttatgtatgaataattcataggctaatcatcagttcgttgcctctggtttttttttttttaaaggcttctattaattgttagcttattttaagtttttaaaatttgtcttttttgtaatctgtaattctaacctgtcacatctgactgaacgcctgttaatttaaatgatcctactggtcatttctaagtatttaatagaggagtaaacagttaaaagatatgaatagttgggcagtttcctccatttctaatagtggctttgtttattttatgttggtttcaggaaacagcagtgaattttagctcattgttccaaatatgttttgacctatcttagttgtacctgttgtgacttgccagcagatttgtgacttgccagcagatttgtgacttgccagcagatttttcaaactgagaaaaaaggaacataacttaattatgttgtggaagaccgtactgtcttctaaaaactaagcatcccttctctgattcatttatttatctaggggctaccatttcacctttattgcctggtattttatgtcatggttataatagtgtgtggtagggaggaggtgtgtaagatggtctgacctatcttactcttttttttttttccctctcgagacagagtcttgctctgtcgcccaggctggagtgcagtgggatgccctcagctcactgcaacctccgcctcctggattcaagcgaggcgacctgcgaccttccttgactttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccattcttctgccttagccttccgagtagctgggattacaggtgtatgccaccatgcccgactaagttttgtgttttcagtagagatggggtttcactatgttggccaggctggtctctaactcctgacctcgtgatccacccacctcagtctcccaaagtgctgggattacaggcatgagccaccatgcccagcctgacctatcttattctacaattatgctcttggtatacatttgaagcttgggtcatgctcttttaggtaactgtgcctaaacgtgtagagaatgatgatcataaaagaaaatatattttatatttttaataagattatttaacaatgcttatagcaaatgtgttttaaaattgagttgcatggaactgagcagactagttgcgccatgatttttcatatgttgtctgtggtggttcttattttgtatgtttgtgcccccttattttcttgattagatttagcctgtttacccaaaagaagaaacagatcattttctaagaaagtgtaatttaccagaactgactccagaaaatagagctatctgaacaagtcacccttcatagaataatgtctcgtagtaaaccctagaaagttactaactataatttcacagaagaattctaccaaacttttaaagaatatgctgttataatactatttaaacctttgcagaggataaagctgctagattgtcataacattgaccacagagccttacaaacatagcactcatgtaaatcttcaggcttgtattgcttgagactattgatgcaaaaatcctaaataaatattttattactgttagcctgaaagccaatgccatgcttaatgggaaaatggtagaaacattaccctaaaagtcaagagtaagatatccaccgtcatcactgttttatcccaaagtgtgacgctaacccaaagatgattgataaatcttgtagaagggcttttattttagtgctacatgatcaaaattaggattaagagtcaaaagaccaatgattaaatatttgtagctcataccataagaagacttacatccctaatacacataaagagctttcaaacaatcagtaagaaaatgatcaacatcgcaaaagaaaagaacagactatcacaggaaggaaatataatataaacatgtgtaaagctactcaaaattaaaactgtacttgtgaccatgttttcatctagaagcaataacacctcaagcatccctttactatgttgtgactgggaatgtaaactggtacaaccttgatgaatgataattttacccaaatctatcaaaattgcaaatacacaaacctttcgacctggcagtttcttgaagaatgtatctttcagatgtgattggaagcgtgcaaaacggtcaagattagttattgcaatctcaaagcattggttcttatagcaaaagattgaaaatagcttgaatatccatcaatatgggatcgcgatgttatgtgactaattgatatgtagatagacaaataaggaaacacattgtgaacaatctgatagaataatatagaagatgaaaaacggttaccacttgtatatgaaaagaaaggacacagaacaaaaatgtatttgcttatgtggttcatagagtattttggaaagatacccaaggaaccgtcaatattagatatctttgggaagatgaactgttgggctagaagccaaaactgttgcaccttttatactggaacccccccttctcttcccccgaccccccacaaattaaactaaatttaagcacttacatattctgaattcttggtatttaaattatctttgtattattgttgataattataaccagataaagctagttttatgattacttgatcagaagttctggaaatacttcatttatttttaaatccttttgttttaggctctccagcagaactatctcctactactctttcccctgttaatcatagcttgggtaagttgcacatatgttcccctcatcatttttatactgtatcacctacttaataataaaaatcatctctaggagttattttttatatatccgagaaagggatcctaatgaatagccaaataattatgtatgtggttaaagtagtgctttttaaaaagaatattgacaccatccctcaaaattattaagtcttttctgctggcacatataagaaataggtataatctatttattattgaaatcatattcctcatagaaaattatataacctgttatggctagatttttatggttatgtttattttatgatgtaattaataaaaggtatgtgtattacatatatacacattgacataaatatgtatacatgtatacgtagtatggggatttatatatattatacataatatatataatatatatataatatataatatatattatacataatatatataatatatatataatatataatatatattatacataatatatataatatatatataatatataatatatattatacataatatatataatatatatataatatataatatatattatacataatatatataatatatatataatatataatatatattatacataatatatataatatatatataatatataatatatattatacataatatatataatatatatatagtatataatatatattatacataatatatatgaatatatatatagtatataatatatattatacataatatatataatatatatataatatataatatatattatacataatatatataatatatatataatatataatatatattatacataatatataatatatattatataatatatataatatatattatacatattatgtataatatatataacatatattatacataatatgtatataacatacataatatatattatacataatatatataatatataatatatattatacataatatatataatatataatatataatatatattatacatatatataataatatatatatactatatataatatatatatgagagtgtgcacatatatgtacaaatgtgtatgtgtatggtcccttcataaccatgagttcagcatctgcagattcaaccaactgcagattgaaaataatcgggaaaaaatgaaaataacaatacgacagtaaaaactaatacaaattgtatttatttttatttattttttgagacagagtcttgctctgtcgcccaggctagagtgcagtggcgcaatctcggctcactgcaacctctgcctcctgggttcaagcaattctctgcctcagcctcctgagtagctgggactacaggtgcatgccaccacacccagctaatttttgtatttttagtagagatggggtttcactatgttgcccaggctggtctcaaactcctggcctcaaacgaatcacccaccttgacctcctaaagtgctgggattacaggcgtgagccatcgtgctgggcccaaattttaaaatacagtataacaaatatttgtatagcatttatattattaggtattataagtaatctagagattatttaaagtatacaggatgacgtgaatttaagttacatggaaatactacacccttttatgtcagggacttgaacatctaagggtttttagttagggggagccggtcctagaaccaatcccctgtaaatgccaagggatgactatatatatatatatacatacatttctgtattactattattatttttgccctcattttaccctatttcacaatttctcttcggttgttatatgtttggaatttattctacaaaattgtgaggtttttttcttttgcagtattccttatgatatgttttagtcaaactgcagaagctaaatatatagttttccagtgaaataagtagtcttttgactctatggtctgtttctacttgcatgatctttgtgtgttactgctttctggttcttatgtatgagtgggttttctctttttgtagctagggtatctcaccaagagtttgatgttaaaatagacaaatgtcaaaaatatgtcatattttgtatccttttattattactgtttttctttgtgtggcttttgactcattaatctttgctctggctttatcttaccccactttagcttttttatgtgctttagaaatgcaccaagtatggcaagttgactgactttgcctatgattgttttgtatttgaacaggagctagactaaaactactggtaaaacaaagaatccaacataaagtgatttaatgacatgggagaaatttgaaaaaatctggtatgatctatgaaactggagttttgtgtgaaaaatactgaaaatctggtatcatctgtggaaaccgatacagatactatgtctacttcctgagcttttgccagtgcaggctggcatagagcatgtaaagatgattatattaaatctatttttggcttgaattgttcacgcatttcttccttttattatttttttatttttttctttttcagatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggtatgttttattttccttgttgtgaaaaataaatgctgtatactcataatgtaggcattgcatggtgtgccacatcaagagcttgtgtgcagtaaaaccagctttctctctggtggtttaagtgccgacacatttaagtgcacaggcttcactgcttctaatagatcctggtgatgcttcagctgcaaactcttcaacttttatttggcacccttggtactggaaagttcttcaataaatatgtgttaagataagtttaatttgctgagtctctaccagtcataaaattgccatgttcagatttgggggttaatacttttttataaatcatgtttttttgttttgttttgtttttgttttttttcagtttctttatatagctcccaggttttttccccctttggtgagtttatatattaaatgaaatctgcttgctgttcatctgaaatgagatatctaaaacaagaactgcatttaatatagttcaaaatataattcagggacatctcaaaatgtggtctggggacttctggtagtcccagaaaccctttcagctagtttgtgaggtcagagctattttcatagtagtactgagatgctgtttgccatttctactctcatactctcatgactgtacagtggagtattccagagcctacatgcatatgattttgcaagagatgaaatgtagatttgataatgagactccaattctgttacactagacatgaatgttgaaatgttgccactctattttttttttgctttggaaatatagttgtttttcatagacaaaaatggtgaaatgttgccactctatttttttttttttgctttggaaatacagttgttttttataaacattgttaatatgtaatggatttgatttttaaatgaattttttaaatctcagtttttatatctaatatggtcattttccataatattcacataaacaaaagctctttggggtcctcagtatttccttaacgatgaagtgaaaaagtgtgagaaccattcataattgaacagcattctcatcaccttaaagtaacttcttttaacagtagtttgcttctgttttttttctaattaaccattacctcttgtgagaagtaatgctggttatcaaagtgtgattttgatactgcaaaatgatagtgactagaagatctattacttggttccaagtggaagttctcaaatcttgcttgatgtataaatttggataatcttattaagatacccagtgtcgctgtaggtgctttaactaaaatagttttttgtttttgtgacttaattggggttctgcaaaaaaatttaatgggttttctctgccttattctcttctccctccaaagttttagattgctgtcgttattggatttttttaaattttttatttctagttttataggtgatattgatcagggaatatagcctgaaaaatctctactttttggacttagtgttttcccaatgaccacgtgcatgactgttttacagatattccatagtcttaacagaaccaccgtaccaggttctgtattaaatctggagtgttagttgtttgattagttttcttttgctgtgtaacaaattaccacaaactcagtggcctaaaacatcagttttttacctcacggtttctgtgggtcaggagtccagacatgggttaggcggtcttttcagggtttaacaaggccaaaattgaggtatcagctggcttgtgttcttatctggagcttgaggtcctcttctaaacccacatggttgtggcagaattcagctcctagatgcctcctgaattccttgtcacatggtgccatccatcttcaaagtcagcaatggagaatgtctcttgtgttgaatacctttcatgctttgaatcacttagcctatgacagtctagtcccttttaaaggattgcctgattaaggttaactgatttgctgccttaattacatctgaaaaaatccttaacagcagcacctagtgtttgattaacagagaatgtatgtgcacctcagggctgagactcttaggtgtcatgttagaactctgcttctcacaattttttttttaattcttatatctcatattattttgcatctgtgatctctcagattctgaaagaagtatattaaaaatctcccagtagaattttttctcacctaatcatgcttatacatctagaggttgggtttccaccataatatatagtttttaaaatggcaaatgactttttgatgtttttacatcttttttcttaacattaagtgggatctctaagaaactacagttgtaatgaagatatatttctccaaacattagtgaattccttcaaaattaactcaatcttttacttatcttaatatatatcatttgtatgaaactattttactatgtgtactttttctacattgtttaaatactttcagtcagtacacatgtattttaaaatcaataaaattattgttagaaaatacttgggagaaatatacagtagtatatttaaagttagacttcagaaagacattatctgtgaaaaagatcctggaaataccttatatcattttagaatttttccaagaaaatgcttccaaagtcacactgaaatagtaaatgttacaaaactaatctcatttgtattttgtttcaggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggtatggattcaataatgtacataaacctatcatgtcaacttgcttagtttttcttgttgctaattttaggaatcagtagatgattgcatgctcatattctaaaacttgtaacccttttaaaattactttttaataatgatactcttttgacaatttcttttaccttttttaatcataggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattcaaaactgttgcaaattactgagctgccattatggaagatattaaaacatacacaggcgtgcattttaacgtaattcagagtgttaaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagtttggagaatagaaaaataaggctggacaattaaattgagacaaactagatgtaggttaagaggaggaacttcattcagaagtagaaggaatacttgctaatgtgccaggcactgtgctgttttaagtgtagtatctaaaaattattatttctgttgtcaattcattctttgtaaggttgaaatatatgaaattgccatcgttgcaggtaacacatggttcaaactaatacatatttggaaatagacatagaaagctgataatttgcccaaggttacattataagtggttgagatgggactggaagatagttctcctggactctttacctcttttataaggatagtagtaacaattatgtttaagttttacaaaaactaatttgtcatcagtggataagatagtctagattattgatgaattaaacaatagattggatttcacatcaaagagagagaagacttcttgaccatatttaagagtaggaattaagtaaaatacttagtctttcttcaattcgtattgcttactccatatgcctgcttaagaaatattcatgtaatatagtgattgtattcctgcttcttccagcaatttagtcccttccaaatttatttgttttggacttgcttgtctatcttaagttttgtcagaaatctgatttgagattgtgcaatgtgaggtctacttgttgaatacatttaaaaatatatggtatatatttgtatcagagaatgaagacttgtcactatttttttctgagttatattggtagaataattcattttgtgattttgctgtagttctgttttgattattacccttttgagatgttgttacctgttaagaatgctgaatgccgttttttaaaattagacttgacctgagttgatagcaaaattagatttaaattatattgtctaataagatttcaggtcagacttttttttgttcttcagaaggttagaataatgcaaaatatggtaggaatttagtggaagtaagagtgaattacagagagaattccatgtgtatctatagatctgctaagaacagttttacttggtaaagatactgcccttcttcattcactgtggactctgctgttctttaactcacagataaagtaaaatctgtaattacagaagcagtaatatgcagtatgtttttatgagtattgggagtcaggtacatctgactttggaaaatcaagtagtttcctgtaacatttacaaatcaaaatggcaaatatccatctatctgtggatatgtgggtagctaccaggaacttactgtctgtaatcattctggagctgaggaaatagacctaatgtttaggtttctaaaactattttttttaaatttccttaatgtcatcttggttgttagcacaaaaatgaggaaatgtagtaaacaggaaatttagatgtatgaagaatttgtatttaatcgagtggcagccttcttaaacctactccccttgggtgacctggattatggattattctagaaagggaagtgggacaggggagaacagggcagccaggaccattgttaagccatctaccagagtgggtgggtcactagaactgacacccttggggaaactctaggaaacagtaaacagtctacagaattatcctacccaggggaacagaagtgctgggcatgtaaatgtcaatttctgtttccttggttgagggctgctcctggggatgcttctttcctggcacctctagcctttttgggtatatcagagaagttcctgggcacagaaatgcagatacctgcagttggaagttgtctagagcacactgaaaaatccaaagggtacagtggggcactgataccatctgcctcagaaagtgacatccttggaagtacagttttaaattacattgaacatgtgttgcttggagatgaagagttgataatgggcttttctcatatttgaagggctgttagtttgtagaagcaagtggatttattgactttattctgtatagcaaataagatggaactaaaatcagcgcatggaagtgacaggatgtcattgaataatttgtaattctcttagagttgccccttttgttgaagcactattaaaagcccgaatggtgttgctaagagggatgttcattggctttggcagggaaagttgaattccagcttttaacactctctgtggtgtgggtttagcttgggccaaaattttgtttttgctttggtatacttttacttagattctgtttgatatttgagtatctactattctgtggttgatttggtaagtacagttactttatgtcttggtttgcttggacaatcctgattcacgtgtctccttttggcctgatttttttctgccccccaccccgagacagagtctcactctgtcgccaggctagagtgcagtggcatgatctcggctcactgcagcctctgcctcttgggttcaagtgactctcctgtctcagcctcccgagtagctgggactacaggcacacaccaccacgcccagctaatttttatatttttagtagagacggggtttcaccatgttggccaggatggtctcaatctcttgaccttgtgatccgcctgcctcggcctcccaaagtgctgggcttacaggtgtgagccaccacgcctggccctggcctgatattaatagtatctacattctctctcaggtgttccattttggatgatggtgaataataagatcaccttattaattttagtgcgatgagaaaaagatgttcttgtaaatcacttctaaaacaaggtcatcagaagtactttgactttgaggatcaaccattttgcggaataatcgtgtccaaaattatatacacaaccttttaatttctgtaaatttttaatgcagtgtacctaaacatagccattttccctgcctgtggacttgaatttcataatcattttcctgtattcttttaaacagaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcct

SEQ ID NO: 13505 - DNA, 35675 bp, Human
  misc_feature (1)...(35675): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgcccggcccctgagcccctgagtgcggcgcggcgagcccctggcggcggcagaaggaccggagcgccaggagagggcggaccggggacaaggaggctcccgggcgcgacgaggagagtctcggaggaggaggcgccgagaggacaccggggcctcctgccgccgcagctgggtcgaggcgagcagcccatgcggggagcctcggcggccagccgcggccaggggaaaggacatcggcggcccctgcactagcaagcagcttgtgcccggggggggcgagaacgcgcgacccgtctggggccctccgccgccgccgcgccaccctcccccgcgctgtcagccccgccgggctcagccgccgccgcagcatcttctgcccctgcgcccgcgccagcctcgaggaagtccccgccgaggacctgggcccccaggagcgcagggggaaagaccagagactcccctaaaccacccagatgcgcaggattgaagcggtctagccaaagctttctgtggattaaaaaaatacacgatttttttttttttggcagaagaaaaggagaggaagaccagcggggctttgcaaggaaacggggggatgtaactcgtggatacatttttccacccatcaaacatcttgttatactttgtaaacattttctttttttaaaccccagttccagccggacgcccccagacctctgaggttcgaggaggtggtggttttcatttggggctttgcatatttggttgttaggttttgcgagagccttcttattttgccagacgtctcatgcggggtgaagtccactcggccccctcccctgagtcttcgtgtgcgcggaattcgaggagatccggttactaaggatatagaggaaaaaaataaatcgcttgcttttttttttttaattgcctgcttctccccacccccaaattaagttgcttagcaagggggaaagaggctttttccttcttccaacagcccagccgaacgcctttcgttttttgcccccgcggaccttccatgtaggaagccgaggctggcgagcccgacattcgggagccactgcgggggggcctcttttgggggaggcgccgacgggggcaggctcggccgtccccagggaagcggcggccgggttcctccggggcgcgccggggccggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactaggtgagaagttgtccccctacccccaacattttccggagcgccagtgctggaagaaaagcccctagggcagtgcgtttgtgcagccatccctccagggggagtgtgcataccctcctgggagagtgtgcataccctcctgggagagtgtgcataccctcctgggaagagactgggggctgaaagtagagaagggacaaggggaaactcaaagggcattccctgggggttcccttccaggttttctcctgtgttgccccgaaggggtctacgggcactgctcctgcagtctgcggttaaaaattagacgccttcatttccggatcaacaagggggtgcagagggaggtgggggggtcacgcctccccgcacccggaaagacgttgaggtgtgtggccgagttggatttggtccaggcccgccaaggaaggctgggagaggcgtgctataaaggctggaaggtctccgtatttactcctttagtaaatacggagaatcacgtcgaacaccagtggcccagatactgtcgtggccgcgcacctttggagttttggggcaaagagagttggatggaaggccgaactgggtatctgtctcctttcaactctgccagccccagggtgcagaggaacaaacaggcaggagaagttgggtgtcccctactttttccttccttccgcacagataagtctgtagattagtggggccccggcgcctcagtgacgttgtcgcctcttactgcgctggggcctgggcttctcggctgagaccctgaaactcctttccttttatcctctcagctttctccattccttcctttactctacgtctctgtacacagagtgtgatgtgagggttcaccccgggcgcccgcagatcccccacgttccccagcacgcttgggatgcatctcccgagtgcgctaggaatgggcagccccgtgtcccccgcgcgagtgccgagcggaccggcgggggcagaggtgaattgcacgcctggggggcgggccggggcggggagccgaggttgctgggagctgggtctggagtccgaggacggggagggggcatggtcgccccccgccctgtgaactgtgaagtgcgcggctccggccgagccggtggtttccagccgggccagccgagcgcggcggctgcggccgcagacgtggaggagcggagcgccgaggctggcgccaggcggcctcttttgtttatctgacagctaaatatcaaggcaatcaccgcctcgcggccctgcctccaacccccacagctaagacaaacagttgggctaaaagaatgcctctgttatcataagtttctatctctcttctcatggctgggcctttattttctcttgcttttttaatttcagagtctcccccccctccttactccagatacccgatggattttctcaaaccaactggtgagtaaatgatttttaaaatatcctgcttatcttaagttagaaatagagcctctagaacgtggctttttgtgtgtaggcaaaggcttggggaggtgctgggcttcacgttggttctaggtttcctctgttggaagtttggtgaatttttctgttgtggctgggttttttgctgtttttgcaaagacgttcccttgatatgctttacattttgttcctttttcatgtatttgtgctgtgtagccggtgggctcagctttaacacgtggaagctttagtccagagagaagtgtcttgggaaccaaataggactggttgatggggataactcggagacttagtgagtgccaggagcatcagtgggaataatggaaagggtgattcgatagatgggaagacggtttaaaaaggtgcaaagaagactttggtctggagtagacactagaacttttcagaagtataggcaacagccagtaaaaggggggggggggtaggttcctcctgctccagtcacctgcaagtcagtcctctcccggggttttctcagtattcgccataggggctatcaaagtttggagcatagctctgcctgtctgctgctttgtcactggctggcatgaagccatggcagaagcccatttgagactggcaccagccctgttgtggttgtctgcattcaacttctggccggcagcagcacaggggtccatcctctggacatcacagtgctggggacagggtcagcaaaatgaacttgggggtgacaacaaggacaaacccaaattcctggagctccctcttacagtaggagatagatctgtttgctaaaagtacaggttgtatgtaaccttggtttttgtgcctgtatactggtgcctgaaaaaaacattaatacttgggacatttttattttgccaaggttctgggagaaggaaaagtgaagggttgggcaccatttagctcctggaattctgcaagtccttccgcctcctgcgttttggctgttgggcctttccccccactaattaaaagttttgctggggcgttgtcataaattaaatactttaatgaacgtgtaaccgaagcccatactctgcagccagtcctcctgggactctaccagctccctcaagttgggaaggcgttcctgcttgcctggtgccggtctaataagtggcccgcaaagcatgtgatattttgctttcgatttacaaaacaccagataaatggttattaataaggagatacccagctctctgtatttgtaacaaacgttaactggaattaccaagctctgttttcctaaagactgtaacttgactgggttttggcttaaagaatcaagaattcttttatgaagttcattttccaaggggccacctctgacctgttttttttgtccttccatattcttcaaatttggaggttttccttaaaagagagagaacagtgaccttagccccagggataaagaccagcaggggtaaatgttcccagaaacctccaaaaaccatagaaaagaaaggccatgttcccttgggtttcctgcagagacactgggataaatctgttctcaggatttaagcagtcattctgccaggccagggcctcattttcggtgagtggagtgatatatttattcattagcaagtgttgacattaggtagcaaaatgtgtgtaaacagagaagccacaaagacaggaatgtgccatttccaagggggagaaaagttctccagatcagccaataggaagtgattaacctgccaatcggaaactaagacagctggttactcacccaaaacgttttgttgaaaatagaacaaaaaaagaaatgagaaaaggcgctgctgtgtaagaatttagcatcagtaatagacaaagcccccacgaagggaattgtcctgccacattggaggacagccaggtctggagctggagcacaccccccccgcccccctcacaggtctggggctggttttgccagctgctgtggccgggggcattgaggtcagaccacagatgggcgctgacccaggtcttcatccccattttgcgtatgggagaatgtttggcccgggaatctacatggaccatttacattcttcagtttctatgtcccttaggttgaagttttggtcttgggttactagatgaaacaggcacaaagttttacagtggacaactgttaaaatgttaaccagttgcacaactaaaggaatacatcctgtgaagtctccatcttaggaaaaggtggtgggaatggggctggggcctggtaccctgcagcctttggagacacagagggctcaaagctaggaactccattttgctataatttaagccactccactcagcatctgggaggcctggactttagacacctaggtactgtgtggtccaaccaggagagccttctttgaaagagtgttcacatgactgaacctaggggaggccagttgtgacttgtggctgtcagaagtcagaaagacacccccacctccacatcccacaagaagtcagaatttgctgtttaaagctggatctcggggatagctgtgtgggctctgcttcccgtgtttcattgtatctgatggtctgaaaggtttgaggaatggctggccttggggggttgctgggtgagctcttgagggacccaggtggccagtatccatgggcagatccagcctgcaaatccagatcggaagtctggtgtcttgacctgagatctggcactgcgtttctctcttaaccgaggtccctcttaacttttctaggcctcttttaaaatcagcatgatgaaagagattaggtcattcattcatttattcattcattggttcagtcattcattttacaggcatgatgatgtgcctacctagaaatttgaggattccgatgcagtgctgtgttctttttttttccgagacagtctcattctgtgcccaggctggagtgcagtggcccgatctcggctcactgcaagctccacctcctgggttcacaccattgtcctgcctcagcctcccgagcagctgggactacaggtgcccgtcaccatgcccagctaattttttgtatttttagtagagacggggtttcaccgagttagccaggatggtctcgatctcctgacctcgtgtgatctgcccacctctgcttcccaaagtgctgggattacaggcgtgagccactgcacctggcagtgctgtgttcttttataaccagggttcatttgagttctgggttggttgaactacctggggcagagctgggacccttggggtacagtggtgagtaggggctcctctgtctttaacagtacttaggaagctcagaacgcagttgctgagactatcgtgggactcccagctcctttaccttgtactcattctcaatagttcgctcctggctgctccccagggttgggttttcaaagactctgttggagctgctcggagaaaggaatgagtctttttctctcgcagaacctagtgcttaccaagtgcttgataacacttagtgttgcgtgagtcaggagtggcctagagcttctgtctgccagccagcctgggctctggggaacaggcgacacaggcctaaggtgagaccctgacttcagagatctgtctatgcggagcttttctgtgggtgagagatggaggtatggctcctttaaccttgaggccagtctggatggcctggccacctccaggaaagagggtagggactccatagcctgcctggggagtgagagccatgggatagggctggactcttgggaatagcccagctcactgggtggccctttgagctagtcagtgacgcctcagtttacctggctgcctatggaacaggtatactttgcttcttcacaggggtggtagggaggcttaattaacgtttgtaaatccctcttgagatcaaagccactgcagaagggcagagcaccatttcacaaaaatgcttgtggttgcctgtgtggagctggcttacctttgatctgagatgggctgacaccctgaatgtggtctcagctctgctctgagatgcccggcttttcctttgaaacacaccttgcccctgggattctgccagccaaaggtggcggggagtggctgtggataagtcattatgtttaatgtgggggtgtcttccatctgggaggagtgggtggaggagagggttgagaagcctatctctagaaaatgatgaaggccatcaaaatggtttagaaagtgcagggtatacaccatttaacaagtaactccatttcctgcctgcctctattgttttctgtttgattaagtgtatcctgtaaaactgtatattcctgttaggaattagactttaccctgataaaatgagattacacacacagtcttctttccccctacccaccgcagccacctcacccccacgcctgcctccacttctgcccctcgcccgcttaggagagttcttgaaaagttgtccttccagccttgagaatgtgggagagggagtgaccctgagttagagagagaaacttagcattaagaggggcagacagcagaaacccagagatggtttggggctatgtgtaggccactaaaggattcccatgggctacttgcccgtctgctctttttttttggctttcctatttgccagcatggccaagtggttccaactggaaacccacagggacattgtcctggtggcctggggtaggaggcctggtgtctgcacgatccaacctgttgtgtttgctgcggacctgggcagcacctttccttagccgggctctcccctaggacttcagggagtttggcgctgccagtggtgcatgacaagcttacagggtcttgtgtatttgtgtttcatgggactaatgagttgtggttcatggacattaggttttgctttaattgcttggagggcggttgtggagactgtttctcagctggaattgtcattatcctcattaacggtgaggtcactgtgcagagtacctgagggtgacagaagttgaagagaagtctagttaagggcagatgcaatctaaaggtaaaaatcagtgaggaaactccgagtgttgggtgccaaacgttttataggaactgagggcagagagccttagcaggtctggggttgcctgggaaggtttccagagatgaggggtttggactagcccgggagaggtagaacatttcccctccggctcggagccttgctgagaatgttctctgtcttgatctggtggtggttacacagatgtatacatgagtaacattcattgcgtctacttgggattttgtatactttgctctacttaagttagtcctcaattaaaaaaggggaaagaagtcccggcagcccaacatcaatcttgagaatgttttcaagaactgggaaacctgtctttaaaaggatgaaggcagagaggacatgggctccaagaagagagccttctgcccttgatgagggatgacagagcaaccagggttgagaaagtccaacccaaacctcctttgaccttgggaaccacctggtatccgtaatgggggactggtaatgcaagagaaattccagccagtctcattgagcctgactcgagtaatgattaactggctgcccggagcccagacgggtgacaaggtgctgtggtctgtcttacgatgggcagtgaagcctgagcagaccattaataatcagcatcaaggccgcgagtcagccttttggaatgtgtggtttgtctttcatgctgtttagagcgtgcttaaagatggatcttggtgtttttatttgtgtatttatttctttctctccccttttcaaatccacagcagactgtccagatgctgtgccttcctccgctgaaacagggggaacgaattatctggcccctggggggctttcaggtaagatgctttctcttattttcctggcaattccaaccttttttgaaattgctaaagactggaggaatgggggtggccttctggccacccccaaagtgttggacttcattctcatttttatatgccttaagttggatgcatcggtggtgacattgtggtgcccttcagctcctcatcctgcagtcctttacgctctggacactggatccgttccgtggacggggagacaagagcgagctggggattgctttggtgtgtgaagtgttgcccggttatttttaagcagctcctggcttggggggcttcagcttggtgactttggtgtcattaactcatgcatttgagctctttttttgcttttgctctttgcgcatgggggatgtaaagggaatggacccacctttagggaacttgttgaagacagatcccaagcatacgatgggatttcagagtagatctgaggcttccctcccaagttctgattcccagcccagcctgctgcaggattttgcagcacatgtctggggctgggagcaccagggtgggagcactgccaacagtaggagctgtaattgttccctagcggggcaggttttcctcagggctcacaggtatgcgtgaaggcctggaatgccagtgctggggggtcacggggctggctgacaggcacggggtagccagagcattgttgttcctgaggatgcgaaaagagggcagtacttagagaaactcactggttatgtacatgggacgcatttcatgttgttctgaagaaatcctatttctacctgtttttccatccccaccatgtcatcactagattttctaagaactggctgaagcaagagggaaaacgaccttaaaaacagaaattccagcagagttttgggcatttggcatttccttgcctgtaggatcacgtggtagcagctcgaatagaagctgtgccctgttgtggtgtatcctcttgtgtgaggggcacccttttttgtggggtacctgctctgactacttggtggtgtgtcttccatggctggctcaggcaaagttcattcccggacggctccctccccggctctcctcttcaggaactgagcttgctgagaacgtctttagggagacccttgtttgttttcatttcaatgcaatatatactctgttatctgagactgagggtattgtttactcaaagcttctaatgagaattgagcaggaaaaagagggacctagagaagggagggggcttcaggcagtacggtgggagtggacagaggagttgaggagggagaaaaggcagcagtgtgtgaactgcatcttttctgctttctaaggctgagagagttcttgaaagaaagaaggccaatgagaggaaagggtctcagcagaataacacgctcaggatgttgttagatggttttattttttaaaccctgaatgtgcagggaggagccccggcccctccaaaccacatgaaataagcaagggaagtggcagcttttgaaagggtcctttcggaaggtttgtcttcttgataacatcttgtctgtctcccctgccggaggaaatgacgacaccaggctgagataccagcctgagtgcctcctcacccgcccgtgccatgtgacctgtgaagccctcaggagatgggtgggcttttttttttttttcttttttgacaaagtctcgctctgtcgcccaggctggagtgcagtggcgcgatttcggctcacacagacggagtctcgctctgtcaccaggctggagtgcagtggcccgatttcggctcactgcaacctccacctcccaggttcaagcaattctcctgcctcagcctcccaagtagctgggattacaggcatccaccactgtgcccagctaattttttgtatttttagtagagatggggtttcgccatgttggccaggctggtcttgaactcctgacctcggatgatccacccaccctttcctccccaagtgctgagattacaggtgtgagccactgcgcctggccgatgggtgggctttttttccccaaagctcttccagtcctagaaagaaactgggggtaaaacaatcattaactccttcccctcacccctccaggtaattgtagacacagatattaataaggagctgccaggaagaagcagtgactctctgaagggcagtgtggcttcagaagactgcagagagaagagggggccttccacatggcaagagcatttgttttgaatttcagctcttgatttactaattccaaaggcttcaaagtttgagctccttcttctttccgttcagagttggtgcagtgtattcataatgggccatggtggggagggtacactgttttgggggttgatgtcaccggcttgggggcgtctggaggggaggtgatgggcacggagaaaacctagggctgtcctctttgtagcgagaatgccttccaaaagggaactttattggcccctgtccagggcagagagttttgtaaatggagaaagcccaaacctcctccttttcaagaagttgatcgttccatggggggtggcctgggtgtgtctgccttgctgtggatgaggccagtgactggatgtggcagggctggatgggggaaggggcatagcagacactgaggttggggggtgggagcctggcagcaaggtggggagcagtgaaaactgaggagtttctccctcctcctccttgaaataacctctctgagcctctttcacaggccctgtgtgctgttttccttcctgtcctgccctggctgagagcgggcttaatgaatggggctcagtttagggtgggaggaaggtcggcagcaggagccagggcttgattctcttggcaagggaagaagggaaagaaaaaacagccgaatgtgaaaatgtggtgcctcggaggtgggggtgggggtgtgctcaaaggcccgtcctctcctgaaatgcaggggtgactccaaggctggcccttccctttcctgcgcccttgcaaactgcccgggaggaaggggagtgggcgggtaggagcccgggggcggggctgctggctgcaggttggaattccagcattgcagctttgttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtttcctcggtctgggaaaatgggacatttttagaaggcagtgacttgcttccaggagattgtactttcatttttgacagctggctctctgagacagatggattgctgggtgcaagcttgtgtgtgtatgcgtgtgtgtgtgttgtgggggtgggtgtgtgggtgggtgggttttgccgcagacgtacagatagacaatcccgtgcgcaaacacatgagagcgtgcggatgcccacaggcaggctctgggatagggtgggtccctgtcgctggggtgggttgatgtcagggcggcctctccaagaggttgtggacttgtggggtggagtttgtggattgattctgctttgtgatttggcagtctgtgcctgactctctgggatgggtgtcttttgaaaggcatgcaactccagaacaggtccttgctgctgcttggacatggatgtgtcatggctcaggaagatcacctgggagaggtctgatgtagctgggaagcctctaggctcagctccgtcgtggagatggaaaggatttgctcccagagctttccggggatcactgggaatgcagagcatgtgttggaagctatcatctttgcagcctccatctggagtttctgtctgggggctttcattttgcctgtctgctgtcctggtttgagtgggttgagggagcagcatctcccttgtgagttgtaggttattcagctgcagactcatcttctagcctcctcctttatatatgaatgtctggagctggctgggcctcagccatatggacctgcccagttagggtagggattggaagccagcaaccacttgtagttatttaaacttcaaaagaagtgctcccatggatctcaaggagggaggtaggaggcagtggagacagaagtgctcacgtgtcctgggaaactccatctcttggctgtgcgaagtcatgcttgttggagagacccggcaccatgcctccaacccaagggtggccaactctttgcttgagattcatatgtggctactagtccccaagtctgggggatgggagcgtccttgagtcagtatccattcagcatccaaggatgtttctgtctccttctctttgatccttgctggcatctgtcatagtctcagaggagagccttcaaaaatacctatataatctgaaaatgcacccctggctcagtccacagttgacttgggctcaaaccaagtagcttaggaaacattgctccatcctgttttaaggaaagttaatcagctgcacgtgaacaattattcattgtctggcttggaattgtgatcatgaactgggaacctgggcctgggcgcctgttgctctgcttttaaattaagtcacctccccctgcctggctacaaaacagctcatggtttcactgaggtctctaatgccattgtggagtgagggcagggggcacaggttgagctcacaggcatgtgggcctttcatccaaatgctcatgagcgtggactttgggggactcaggtggacaggtgcttgtgaccatgagcaagctccttccttcccatccccttagtaccctgcaggccactgtgagaaatgacggcctagaactcaggggacaccttctgcctctccttaaacacctgccaacaggatgagtcagggctggggcgggctcacctggtgcacacccacaccctggtgaagaccagtcctggaccccgcctcttctgcagtgccccaggtcatgcacttccccctggagaagggcttactgataaaaccccttttgtcctggaaagaatgaggcagtccggcaggggttaaatacagggtgacagcatttaaaatctctggagcaaatttgggctgctctgccggccagacaagatggtctgctgccgcctcacgcatcctgtccccaggctgaactgggccagcaaagggggagggccaggtgaaggccaggctttgggtggtgtcacttttggtgacactgtagcatgctgattgcccctcacttcctacacacacacacacacacacacacacacacacacacacacacacacacatgcctttacttagcaaagcctgactgtagctgcgtagacttgtacacctatgggacctccgtggcaagctcagagccggtggagcagtgaaaagggaggaaatgccgaagaattcatgatcaagtttggcttcctttgcttctttttaaaattttttaatgttttaattttttttttttttaattcgagatggagttttgctctgtcgcccaggctggagtgcaatggcaggatctcgagtcactgcaacctctgcctcctggattcaagggactctcctgcctcagcctctgagtagttggattgcaggcgtgcaccaccacgcccggctaatttgtgtacttttttgtagagagagggttttgccatgttggtcaggctggtcttgaactcctgacctcaggtgatccgcccgccttggcctcccaaagtgctgggattccaggcatgagccactgcgcccggcctctttgctcctttattattgttgttactgtgtcataattccttgcagaattatgatggccaggctggtctttactcccttcggtccaggccttgaactcggagcagcaccctcaaagcagttgtcttcacctggcagaagaaaaaaaaggtgtaaagtgctggttcctggacttgctcgcacactaaaatccctcgggattcagcttcccagataactttcttgcttctttgtagagacatttgagagaaaactattattaactatacatggtccactgttttgctttgctgtcatgaatgggattgtaaaagggacccatgggaccgggtttccttttgggacgatgaaaatgttctggaactgtagagtggtgatggttgcacagttcaccgaatgtattcaatgccattggtggcacattttaagttatgtgtattttaccacaagtttgaccaaaaaatggccagcggtaggttttaaatacatgtagatacttggataatctataaggaacagtgattgtggagagtaaaattggagagacttctgttagttgcctaggacctgatgatggtagacacttgttttggtggcagccctgaggtcacatgggaagtacattgatggaccagggagcaaggctggtagcctgcctgggatctcgtgtgtgtgtgtgtgtgtgtgtgtgtgtgtgtgtgtgtgtgtgtgttttgagatggagtctcactctgtcaccctggctggagggcagtggcgtgatctcggctcactacaacctccacctcctgggttcaagccattctcatgcgtcagtatccctagcagctgggattacaggcgtgccacaccatgcctggctaatttttttctagtagaaagggcgtttcaccatgttggccagactggtctcgaactcctaacctcaagtgatcctcccgacttagcctcccaaagtgctgggattataggcgtgtaccaccacgcctggccttctgctgtgtgttacctgagcaagcagacacatctgtgctgatccttcgaccttccttttttcttcgtgggttccagaaatgagagacaggaaagttccctctggtttgattcccggcctgacttttctgctgggggaagtgaatatgcttgttctcactctgcggggtccccctggcctgcccatcccagtgactgcgaaccaggatggtgccagggttggctccaaaagctggtgatccagacccttcctgggcccctggagaccccagtccctgtgatgtccttgcccaagttctagggctgcagtggccgtaggtgactggcccgggcaccctccctttgcgggagcctcgtgaaaggatactgtaagcacagccgcagggaggtcaccactggccctaccacctctcgctcggtattgaatggctagccccaagcctggctgcctgcctactgtcacacagaggcttcctctccgggctattttcagcgggaagatattattaactgctgaggcacagttctcaatttagtggttaacacaccaagaaagcaacactcacctgatcccggccactctacctaaacctgttggctcacttgggggactcggctgccccccagcctctctgtttctctctgtgggttcacctgggagatgtgggcttccactcccgtggaaggtgccccgtggattcagtatctgctagagagagaaccaggcttcttacgaagccaactcttaaaaggtgtagaaaatgatcgtatttatactctaagatggggacattttttgataggggtgggcactggctgggaaaagggactttcagcggtgttgaggacagttatttaaaacagggtgataactttcaccttgtaagttaacaggaaatattgggacaagacaggaaattgcatcatctttttttttgagaataactccagagaaaagtggttcgtgaaaggtagtggctgagaaacggctagcctgttttctgttttgtgttttttttttcttcccttccactcccacgagaacatgtaggccattttctttaagaaagaggctgtttgagaactttatgttatttttattatttaaaaaaatattttaccagaagggtcaccttcagttgaaatgttaactgccgccttatttcccattttactaaagaatctttcatgactttttcagcttccttccccaaatggtaaggccaagcagctcttggctggaagctaattttggtttggctgcggagtcctcaacactgagccccacccagtgtcattagctcagttttaacttgcaaaaaaaagattgtatttttttttttgatggggggtacgtaagaatttactcacgcctttagcctttttacccacccccggtactgccttcccctaacagaggcacctggcacttagccgccgggaactcagggctgccttcgtgttttcaagccaccgtgtccccctcatcctgcaggagttctgtaactttcctgagactatttctagggtgctagtgaggagtggaggggaaatgggtctcggagctgccctggtacagctgtgtccagtaacggtgctgtgctttggaggaaggagtgatatggttcacctagaagcatctcccagagagggggcttatcacagccctacagtggtgcagataaggtccagttccattttttgtctctgggtttctaaatcccctctttgttgatgtcattgttctaatgacacagggcatgggacagtgccccggcccgcgctgccaaggagccgtctttaggacagagaccagaaagaaagagacctgtgtgtgtggctggcccgctctccactcacgctcacccccaccctcccagctttttccttagcgtgctttgttttgttttcataacacaacaagggccctggggtgtgtaaaagcattgttgaacacttggtgagggcaacttgtccaaacagagcaggacgccaaagcagaatgctgtgggcaggtggtgtgcccacagaggttggtgggccggcgccggccttggaaacacctctcagtggcatatgccgcggcggctgagtgtgacctagcgcagaacagggcttccctcttgtgtcctccgtggggagtccaggagagggacttggtccttctggctgactccgtgcttggaaggtgtgctcccctctcaggtgggttcacatgtgcctccctctgccgggtgtgaagctaggtgggcccgctgctttggaagaagccagtgtgtccctgtggtttgtttatggagcaaatatgtattgacacctattatgtgccaggctgtgtgctgtgcagaggaccagttcctgggctgggttagaattaagaattggcagttggaatggcttgtccgaaggtgatgttgaatccatggggatggagccggcgggaggggggattgactaggagttgcctctacctggaggcaggcaggggcagcttctgtaggacagaggagcctggtccctccatgaagccaggccataggtgggggaggtgcagggtgggccccctgggatgggcctagctcttgagtcatccacttctacttctgctttggttgtgtggtctgttgagaattgagataaagcaaagcttgtggataaacagaggtaggtctcccgggttttggttccagcccgcctccccaccccgcttcttgctgattgtaagatgacagcaggaagaacaggagctgtggttataatccaccctccagaccctggtagtacctggggcacagcacagagtggaagtgaccagcctagcgccaggctcctcagtggaccacagccaaggggtggggaaacatctggaaagacagtatctaatgtcttgacagccagaggagaagtgggatgttttcaaagcccaggagtgactttccctttgtaactccagaggacttgattcgcaacgaagaccatctgggggatgaaggaaattcttgctttttaattttaaatctgagggttaagcccgtttctgaggtgtcagccctgtgtgtgaggccctggcctgtctggggttgggtttggatgaaataatctaagatgcagttaccagggtgtttccttttcacattcatccttctctgtctgttcccccggggccaaccgatggcttccaagctctgtggagttcactaattgaattactcttcttgctcctccgtgaagccccaccaggaagacaaggcggggagagctgcttttgctggggggtttgatcagagcagaaagggaagatctggtctcaattccaatttcatcttgcaaagtcgggactttctttcagccagaagacaactcagataaccaggccagcgactgtgtgctcatttcagtattgctttcttacgttttgatctgcgactgtcactcaacaggaacaaaaacaataagacgccaagatatgactgtgccgttggcagattagctgtctgcattttctggggtggctcactcggaggttaaatgattgtccctgtcccctgtcccaccttccagtcacctcatgaagctgttaagtgtctccttcccctgcaggctaagtgaggatcatcaagagctgggcctggggaccttgtcagcctcactgcagcctctgagccagccctgccccaccccctcatgaatcagtaaccaagagggaaaattaaaaagttagttatcagtgtgatctgagtgcaccataccgttcttacaaatagatgggccccatctcctgctcagtgggggcacaatcaaaaccctgctggggggggctgttttctggggaagagcccaggatcgtggggcctgcaaaaactcagaagcccccccaccttccccccagggtgtccaggatgccctagtcccaggagggggctgggagagaattacaatgtcggggccagcatcctccactttcctgtcactagaggctggcctgctctcctgggttgaggccgagtgtctcagcccctggctggccacatggccttgcaggagccatttctgtgttctgggcctcagttttctcatctgcaaaataagggcttgggcttggctgccaagtcccttcggtgatctgtgatctttgtctcttggatttgaggggtgtgggaatgatccccctattgatgagatatccctatggaagccaaagactgcttccattttaaaataaaaaggttgtagttctttctgtctcttggctcgcaaactcttccaagtatgggtgaaagctgaggactctgttcagaaaaatgcatgctataccacaatttgtatacatctgcagggggccgatatctttgctgaagcccagtcccacccgtggaatccccagttcaggaaatctatgcttatgaggactagttatgggggtgcaaaggagagccttaagagagctgaggcctttttcttttattgtggtaaaatatacataaaatataccatattaacaatttttaagtgtatagttctgtggcattaagtacattcatattgtgctattatccccaccgtccacatccagaactttttcatcttccctagctgaaactttgttcccatgaaacactaacttcccttctcccctcccccagcacttggcacccaccattctttctgtctatgaatttgcctcctcctctaggtacttcatagaatagtggaatcagacagtgtttgtccttttgtgatcggcttatttcacttaacataatgccctcagggttcatccatactctagcgtatgtcagaatttccttcttttttaaggctgaataatattttattgtatgaatattccatgtctggttgatttattgcttgatggacacttggcttgcttctaccttttggctattgtgaataatgctgctgtgaacatggatgtgcaaataccactggagtcgccgctttcagttcttctgggtatatacccagaggtggaattgctaaattacactgtcattctgtgtttaattttttaaggcatcgccaacggtagggcctccttgacttgtgcctcgtgtgtcggcacacaccgatcgcatgcggtgggggagccctacccaccggggtgggcttgagggcgaatcctggggcagagggagtgagaaagcggggaggggacagtctgtccctgcgcggtgggggaggggcagtgctgggctgctgcagtcaccagccagattggagctcacatttatgggagcccatgtttatgggaggcctggaggctctgaaaggtggggcacccagcacagagcagctggccgtgtatgttggactccagggccttgtgacagcagcttctgggtgggggaccctttcattcttcttttattcccttgacctcctaactggaggttaggagtgggaggacccgccagagggagtgggggcttgggtctgggaggtcctgggtgctttaggggtgaaagggctgggatggctgaacagtgagtgtgtccaagcgggagagattagattacggaggcagacagaagtaatgattaacttttccagtctgcacgctgtctccaggctgtcgtactgttgtttttccctctaagtacagtgcggccctggcctggccaggccctggtattgggttgtaaagtgagagatggaatgagggctgggagtgcacggggaggggggccagggagggagctcgcaggagaagaaggagcttttccatcggatcctgcattggaatttattggccggaatgcagtaaatgttcaaaatgccatcccatccaacagttttcataattgttatggaacaaggggagccgggggaggggaggaatgaaaaggacttttgtttctcactgtatttttccatgtcttcggacagttttcctaccctctagaaactggagtggagttggacctgtgggggatagggtgggagaagggtctgcctttgggtcctgtgatgccttccaaggactaggggtcctggtagcctggggctttattaaaacaaggcccacagcaaaagtagcttggtttcttgcacacacagagcccccccaccacctgcaaaaccagggaaaaactgtcctgtccttctaggggttttgtccttttggaaaattggcttaatgatgcagtggtttgtattaagattttcatgatgctttaacgtgtgtgtgtgtgtgtgtgtgtgtgtgtgtgtgtgtgtgtgagagagagagagagagagagagaaagagagaaagagattgagagagagagagagagaatgaatcagcattcagtgccagctgcccagttgggaatccagatagggaatttggggaatctcctacactctcagggtggcaggtgggtaggtgggtgaggtaagagacttgacttggtagtttctcttggacacgacagactttctgttccatgcttgtcccagcccttgtgtcttcctgggggtgccagggtcatgcccagagggaaggcagctgagcagacaatgccatgcagggctgagggcttctgtgcctgctaatatgtgaaccccctttctgaagagagctgctctgagttacttggggggtaacagtgggaacctggttggtgtaccatggaggggaagtatctggaaatttgaactcgagaaatgattcgactgcatgcacactaaacagcagccagagaggcccttactgtcaatattatgaatggagttggctgggtcgggagtccccacccttcctctgaggcctctctcagaggagcctgggcagagtgggcctcctcagacagcagtggctgcaggcagctgggtacacgctgtaatttgcatggctgaatgctggggcacaggaagccgcgtcagcctgactggcgagacagacaagagcttttgatttgtgtggctttcctcccctgccccgtgccaccctcaattacattctccatggcgagataaatgctcttaggagcattcatccccaggttgggggcttcagactcagatgcttggggggttttgggaggtggtgtgggaccagtttggggagccagggagtacattttagttctaggaattgattatttaacataatttgtaaggacacagtcactaattagtgttctagaccagcaggatctgcgaaatatgtaggcttgggagaggtggcaaggagggcggtgatgggaggagaaacttcagggaaccaagcctgggcagacagtggacggatgacagtgataaaagagatcctctcttgggggctcaccgtctcttgagggtgatgaatagtaagacagagtaaaaagtcatttctgactctgaaattaaagaaaaaaaaaagttggtttagagatggacacagcaaaacctgactcaaacctcctttcccttttgattttattttgttttattgttgcaaattaaatgcaaaaatgtaccctgctcctcaaagtggttttcttactctctggaaggtagtaaaaataaatggaaccagtgttgtttaatactgagaatcagagtccagccagagaccatgaaggcagaagggggcccatggggccatcttcccttgtcccctttacattatttatggacaggtcaaactgagaccctgagagggcaagccacttggccaaggtcacagagcagcttgctggcaaaaaagccgtatcaccccccacttcttgctgcaggggagttgcaccccatgcgcagctctaaaagctggtgcagcatttccaaagtgtgttctgaaggacactttggagaggaacagtgggcttggtggctttagaggcctgtgtccacagctcacaccaggcaatattctgggcttgaattgcagctctgcacttcggccagtgacttgtgcctcacccctactactccctttttttaagataggctggtgatagtatgcagcctcagagggttgtcatgagccacttagagaacacagcctatgcaaagtaaatgcttattaagtgtaggcattggcccagaactgttctaccacggggtgtggggatgtggagacaatcaggaagactggtgggcattttctgagcggctggagaacccaggagcctcagagatgagaccaacgtgtgtgcagcactctccacaagctggccccaatcacttttgcatcaaattggtacagcaaccttatgaggctggccttgggggaaccctgttttagggatgagctgaacttaccgggagactgcatgcgaggttggtgtgaaatgcatatctggctttgtagctggtcggctcacctctggggttggcacaggcgcgggggttctgccatggctagaatgcgctaaggggtggaaacgaagcctgctgggcccgggaaccagagagcagcctggcctttgaaggagaccctgtggcaccccctgcccacccccaagtccagccatctcacttcactggagatgctgcaaagcatgaaaaaaaaaaaatccagtgttctcaggtcagccttccaccagccaggattcatcgtctgatctgtttggggagagagcatggggtggtggagatgggttgggccccagtgttttctgattaactcgcagtttacctgaaacattttggtttgtttcctccatgaggaactcactctaaaccccagcattgtctgtgtttcctgaggagtctgagggagctctggggtcctgtttcctcttttggatgaggctgtgagcatggtggattagagacagccccttaaagtgagcccagatatctcagcaagttttacgcgtctctatttgggggagggattcgcctattgaaaacaagagaccagcaagggtccttgtgaattatgatggtttggcgtgagaatagatgggatggattggcactggagtccccttttatcttaggcttgtccctgaagagggcttgttgatatcagaacagccaatttcctgacagggttgggagcaggggatgggtgctgttaacctttgagatgtccgatgtggagggagagacaggatgaggcaaccgttggtggcgcctgggtcctgaggagggaggaccctggacctggcgttagcgaggcgtggtgatgtttgcgctcccaggttgccaggtgcaagctgtctgtgtccacatttctgcccttcatttgcccctgattggcacagggagcctgcaggaggcggccgtgcctgcccaggcgcccttcctccccaacttctccgtcctcagccttctgctctgctggaccatggaggagggggctgataggcccgtggccctgttggactttggcagaggaatatcacttcattatccaagtgcctcacagagatgagagccggtggagacccgtcctcactcgcctttgaccccagctcccggtaccctagcaattgggcacatttaaccgtgggtcatcagctgatggagctcatgtctttactggcttcttttttccccaagcttgcccttgttcctaaatggaatcttgggggaccccctccccacaagtacgtcctttgtgtgtctgggcccagtcaggcccagatagcttctcttccacgcgtgcccgtgttctcataaccccatggctgttcttggagctgctctgcctctctgccctctgccttcaggtggagaatggtattgttgaggcactgagcaaggcctttcccccctcctcccatttttcttctttctcatctcctgacgccttcaaattaaaaatttaagaaggggtctgggtgcggcggctcacgcctataatcccagcactttgggaggctgaggctggcggatcacgaggtcaggagatcgagaccatcctggctaacacggtgaaaccctgtctctactaaaaatacaaaaaattagccaggcgtggtggcgggtgcctgtagtcccagctactcgggaggctgaggcaggagaatggcgtgaacccgggaggcggagcttgcagtgagccgagattgtgccactgcactccagcctgggcgacagagcgagactccatctcaaaaaaaaaaaagaaaaacatttaagaaggggaaaattccttgcttaacctaaaatgtggccttgaggcctggtcaccctgtgccattgagacctggggtgtgaggttcattcacgagcctctggtctcctggaagggtctggtctgttcattcatgagcagggtaattaaataactctttgtaagagtcagggagctccttgctaagtggtcttccccagttggagcgcaaacacaggctgaagtcctctcctttctcaatacccacctcccccttccctttaaagggaggattttatgctttaagggaaatggggaaggtgggggggggggcaacaccttaaaggaattttaggcagattcagcatttttctggtgttgctccaaaaattccccacactgtaataaaaagatacaactgtgagcaggcatctgattagtgagctttttacaacacagcttttcttttggatgctttaaaatgaacacatactgttttaaaacaagcccctgtacagttttctggggagggggagaagtttgtggaaaataccggaaaaggttataaagctgagggaaattaacaaaggactgtgagttttgccttcagaggttaactatcagcgagaggccaaggctcttccttagtccttgtactgactgaacttcccagcccctcgacacgtggcccgggaagtccctgggagcaaagcgtccacacagacctttgtggggagactcgtgtgggctgtgggcccgattcagggaactgtgtttctgtgaagatgaagctgagcatttcccagaaatgagcccaaatggcggggaattcagggcaaaggggaatctctgtagtggcaatgggggatgtcgtgcggggtccccagaaggtgtgatgtccacacaagggtgtgtgttcgaggggcctttgctgttgccgaatggttttgctggaaagcttgttttttgtgtgtgcttagagatagtcccggcaggaggagactggagctgtcctaacgggaggacagaggctgctggtgggggagctggaggggacagcgagggaggagcaggcaggagtctccctgcggtgggttagggcaccaaatggacttcagggcccttgttcacacacagcagcattcacgacatccatgcactgcagtttttctgggctgggccattaacctcagcagaaaaatgctttttccagggggtgtctggcagcacattgctggcgggctgcacagatgaaacagaaacccacctgacacttccccgtcctgctacagatctcaggctccagtccccacccagcttcctctgcccccagaggcccccacccttggcagacaaggcttccaccccttgcctaggtggctgacaggcctggcatgggggcacctcgatctcaggtccatactccactcactcccttgctcctcctcctcctcctcctgttggccggtgccaggtttcagtgggtcctggctgcatgaaacaaagcattgtgaggctctgctgagggtctcccacccaccctccctcccgcctccttcccagcagctcctcgagtcttcctttccaggccaggtttgttgtcccgaattgggaaaataagcaaaagcttcttgtgtttcagaacaccctcctccacaccaaaagggtggatgtgctgtgcctcccggaagagggctttctcccccgcttcacacttgatgccaatgtgtccttccttccctgggcgttcaggtctttggtgtagccttcagagctgagttccctcagcaagaaagttcaaagattgccagcgctcacaagtttattagcagttgatggatactttgcagaaacaagtgaatgcctgatgagtcaccttctccctgtccctgtcttgttttccatatgttccagtacgtatgtgcacacagaaacacacataacacacactcgtacacactgacatcatggacacagtcttgcacacgcacatgcacaagcactggacttccaagctacatggggggtggtgaccggccagttttctggtgttgatttttagtgggggttgggggttgagggaaaggaatgagacctcagtgtcccctttttgtggagcttttggggcaggcatttgggaaggccagcttggggtgtctgtagggaaccgctgctctgggtgtgtgtgtctgtggctgccccagcaggccgcagtgtgcacatttgtatggccttactgacgggcacctccatccaacactggctgctacttaaaacaacaacaacaacaacaacaactgagtggagccagtgggttcccaggtcctaacacgcctgtaaaagttggagccagttagtgtcctgggctgccccagttacccagcctgctggggcagcaggatgcggccccatcttccgccatggaccccctgcagggtgcaacccatcatcattgactctgaacccagttactccagaaacacaaaggccacaccaaaacacatctcacactcaacccctgctttgtgccccccaggtccccaagaggaggagctggggctgcagggagcgagggcaaggccctgaccgacgtggggcccttcccctctgcttttccccctctgctgtccccatttttgttaacaaatacaagacttccggtctccaccctgctgccacaaaccacagcgttcctgcagtctggctgggctggggagatttatggtcccaagtctgaggcctgcccgctggctcctacttaaggaggagtcagaatgcccgccgccggggctccctttccctccgtgtgaccccccttttaaagtcctccaagtgcctgttgaggaaaattaccttaccagaatcaccccggcccccaggctgcctgtgggaagactgtgtagggaagcggggcggggcctgcaggggagggatgagggcggagcagggcgccctgcaggctccagatgcttctgtggaaggaggggagagagggggcacccctggggatgggggtgccggcagagaaggggagaagggggacgcatctatttgagacacataatcttctgtctgggctggaggaagctttgttaaggtagcccgggttaataccggtctgcatgttgtgatttggcattttgacatgaattcaccctttgtgtacagggctgctgctgacacactgagactgttttcctattaggaatatagatgtttttgtcccaagccaccctcatttttatttttaccagataggtccctcatgaccacggcactgatttgagagctgggtgacaggcacccagagaccatcgcataggtggtcccagagtctagacacctgggttctagctctggctgtgtcatcccctggtactccagcagcaggctttctgggtcctggttttctcatcaggatgacaaggggctggaggagctggccttcaaggttccatccagttgaaagatctgtaactccaggacgttgctgaggctttttgaggccctaaaagcagactacccaagctattaagggtccctttgcatctgtgctctgcagagaagaggctttgttggccaggtgggcacagatgctggtgtactggactcctgatgggcaggggcctggagagaagcagcacccagcgcttcctatgcttaaagaaaggcagggtcctggtcaaagggctgtaagagcctgggcaagtccaggactagcctcaccgcctccttctttctgtctcgtcctgagagatgagctggtgactgggtgcagtgggggggcgggtgtcttcattctaggagtcaccaatgcctgtccccactaaccctctctgccaatgtgttttctagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgatttcatgttgtcctccaactcctttttcttctgctgcttggagggagtggggaggagtgagtattcatccaaattcagttgagttggcgtcttcccagcccagtgcttggaggatgggagacgtgggccacaaaagagacatctagaacagccctggtcttcaagagtgctggaaagacctgcagccacccagacatccctccttcttgtgtcttgaatttgtaatgggagacaacctacaggagctctgtgggtgataattcaaagcttgtagaattgaggacagggaattacatctagggtaatgggaaggagacaggattagaggatggatggatggagaagtttagccccaagaacctgggtccatctggttcttgccaactcctcacttggtattaaatcctaagcctactgtacccctgctagactggattccaggagaagtttcctgggggctgagaccctggaagggtgatgaaggtgggggttgaatgtcagtggtgttcagagggactaggccacctcctggcgccctcccaaatactgtcctgggccacagaagtcacagagtacaagttccactctgcaatatcgtcccttgtctgctgggacttaagtgacagttcactagtccccttccccagcctagctctggtggcacttgcagtcaaaatgcctcttcagtgctgtctttgcatcagcctgccttggttcgctgctgaaccgtgatctgagccatgttttagatttgggaaatcttgcacaagagatggtctaaattgggtaccaaacaaacggctgtgcaggtgtctatgtaaggggttttgaaccttatatccaggaagggggtccttttgaagtgggggttaagatttgaatatcataagcctgtacaatttcatgaaagctttttggaaggccaatgtaggacagccaactttctattttgccaaaaaatgaccaaaagcgctacagcctactggcgccaccacttcattaaagggaatgacagtacaattggttagcaagaaatattaatacatgttgattgctgatttatgctccagggcattaatgccaagtggtcatcctggccaacttgtttacatgtgatagggagcttactacctctaaaagtagcttttgcttttttttgttttttttgagatggaatctcgctttgtcgcccaggctagagtgcagtgatctcggctcactgcagcctctgcctcccgggttcaggcaattttgctgcctcagcctcctgagtaactgggattacaggaacacactaccacacccggctaattttttgtatttttaacagagatggggtttcatcacgttggccaggctggtcttgaactcctgaccttaggtgatccacccgcctcggcctttcccaaagtgttgggattacaggtgtgagccaccacgcctggtcgctttttgctttttatcattgaactgaaacttgcttacatcgtagttctgtaacccagaataagtgcaaaatctcatctctagaaaacacccaaggagggttctaattaactctagggtggtagcggcggaggaggggcagggagggaaggtgtttcactgggggctgtcaaagttattttagtttgctctaaattgcgtcggcatgcccggaagctctttaataattgtagctaccatttactgaatgcttcactaggtgccaggcataatgttcaggcgtttgagggaattctcatttcatcttcattaggacacgctgcaaaaatggaggctttgagaggtgaaatgactggctcaaggtcacacagtgagatagtaagtggttagggagatcaggatctgactccgggctgagtggttcttcctgcttggtccacgccctgttgagatgtttatttggtaggatcctgtgtggctccagtcccacaactccctgaaatggagagaaggtgggagggtggtccgccacgtttcctcctgaccacttgcgc

SEQ ID NO: 13506 - DNA, 283538 bp, Human
  misc_feature (1)...(283538): n = A,T,C or G
tgaatttgaattatgtgttcttttatattacttagtgttcctctcactgaagtttctttaaaaaatcaaattgaagtcctacctacttggaatatatcatgtatggttcagaaaatggtgagggatttttttttttttccaggatgtacttcaagagccaatttacagtgtaattcagaaattttgttttactctaggtttctgatttaatcactaaagtgtccttattttctgtctatagactatgttattttccttttggaccttcaaatccacaaaggtttaactagtatatgataggaccatagaattttcacagactatgtagattatataagtttcagagtttaaattatgctattgcttatattactgataaacaaaacatggaatcattttgggacccagtttgtcagttaaataaggagattaaggcagaatttttttgtcacctctatcaacctcttagactattaataataatataaaagtgttgctttaaatcatagactttaaaggccaggcatggtgactcacacttgtaatcctagcactttgggaggctggggcaggagaatggcctggagccaggagtttgagaccagcctgggcaacaaagtgagacccctgtctctataaaaaaatttttaaaattaggctgggcactgtggcttacacctgtaatctcaacactttgggaggccaagcttggcagatcacttgagtccaagagttcaagaccagcctggccaacatggtgaaactccatctctactgaaaaaaaaaaaaaaaaaaacaaaaaaaaaaagtaaaagtagccaggcatggtggtgcacacctgtagtcccagctactcaggagtctgaggcaggagaattgcttgagccctggaggtggaggttgcagtgagctgaggttgtgccactgcactccagtctgggtgacagagtgagactctgtctcagaaaaaaaaaaaaaaaaaaaattaagcaggtgtggtggcatgcacctacaattctagctacttgggagtcggaggtgggaggactgcctgagcaaggcaatcaagagttcaaggctgcagtgagccatgattgcaccactgcacttcagcttgggcagtagagtaagaccctatctcaaaaaagccttgagaaaatactggtaaagtgttgagaattaattgtcttttatttttccaggagcctaaaggatgtagtggtggttaatctgtgacatgaaatcattaacataccttcttaggtctcaacagaatatggaatgacttgggcatgggtgcaaatttggatcaatatctgtgacacactaaagatattgcgtattagaatggctgatatcataccaatgaacagctgaatctccacatgtcttaatgattcatctttttaggtgtgacatttacatggtctttagggagaatattaggatcagctcagtccctgaaaactgggtctttagggaaagatctaaataatagcttacaaagaatattgacttgggagctctcacacttggaaggcagccttatgtagtttattatatctaaatcataggtggtatgagatctaatgaattaatgaggtctgagtcggatcaaattcgccttccagagttatgtttatttaacatgctttaacccagaaaatgaacatttgccagcgagcaccaaacaactgtgcgccgcagtgcttgagcgagtcaggtcctgaggccactctggcgatcctccttacaattcatgtgaaatacctactgcaggacaaagcatctgacggtttggaggatgtttctgtagtcctaggaatccacagtgaattcgagtctagactcagtcatttttcagggtcaggggaggagggagaagtagcaaatcagatatgcccaaaacgttacagaggtaacagtgaatccaggatgctgctgtcagcctgtgcattgtgaagaaggcaatcataggcgagcagccgcgggagcaggaacagcagcgtgctaagaagcagtcacataaacagcagcaggagtaggcctcctgcttttcaaaagcagagtactgcagggtcgcgaaatgcaagacactcagatgtttgaaaatctcccgagttgagaatggctactgtaaaagcgtcaccaagaaactctgacgatctggacagtcctaactctgtgttagcaatacttacttccggaaaattaatgctacttcttgtagatttttgcaaataggaaacccccttgaagaagatctcaaattacgccccccacccccaaaaaaagacaaacaggggagaacaaagttttggcatgcctgcaggaacggtggcttttttagaaactacctaggaggcagaagctaagtgatttgctcatgcctcttacctgggagtagaaggtgggaagaaatggaccgaggctgtgacgagaagacaaggcacagtgcagcttggtgaagccacacgctgactgcgttctgccccctcttcatgcagtgctgcgggctggtgcatcgccggcgagtacgggtgtcctatgtaagtttctattgctgtagaattgcagctgggagctgaaaatactattcgtgtctgtctggtgcatgttgcctctttcagctgtttttattccctgtgctgaaccaaccagacagtcgatcatttcgtaccatgagttttcaaggaatctgaggtataggagattctgagatatttattttttcccagagatgtttttatctgtcttttgtgccttgtgactttgataaggttggaaataacttgcgcggggattggtttgagaagtccattgtctcagagatctgcctcattcaaaccagttgatactctcttttacctagagtagtcctgttttcatatttgaatgatgggatggtggggggaagaaataccacggagtttgacaaattatagataggcgcagaggctaacactaaatcctattttgagcagcttcagaaaaatagtagataataatcactggatggatgacacagctgttgcaacagctttatcatcctgtgactctttcactgaaatagcccttatttcatggccctgctgtgttttgcaaaatggctgtctgagtattaaattctacaaggcaggctcacacaaatattgaagtgtatcactacttaacatgattggatgctaattgcaatatgctgtgccttacactagccgaccagctccgagcaagcgctggcttgattttcatactccttttgcgagcagctactctattttcaggaagggttgtaaaagggaacaggaggtttatgcaggctgggcaaactgcagtgctgaattgcttaacactggtttgacattcctgactgcaaaacaaatagaaaattgacaaagcaagctaatcaatacttaaagtattgaaggtaaagaaacccgtgaccttggaaaattggccacagaaaagagatatatgtgagacttacaggacaaacaaggtcaaaatctgatatgatctcaataataaagttggaaatggtgacggggtggggtgggagggcagggagagataactatactgtcaaaccttaaagagagtattcaattttattaaataagtaaaagcatgaaaaaccccttttatttaaaggtttttgcagttgttacatatttggtgccatttgtcttttgaatgcaacagttgacatatcagaaatcaatggaggagtcaggtagccagccaagatttctaaagacgacatctgcagggatagatggtttttatccagtcaaaaaattaattgctttttaaataagatttgggaataagtgttacaaactttttagagtataagattagccgcctaaagaaaaccttaagttaaaaacaaaaataattttaatttaaaaatccatagtttctagaatagtgaagagtgagaatttcttagctttctgtgtttctgtttattcttgtataatgaattagaagaaatccatggttatgtgtgcctattgaatacaaaaattctgaaataaggcctccaacaaagcaacaaatttttaccctacttattttagttcttcttcttacattgaacatgtaaataaatagaaagaagagacaacataatctggatttttgaagtcttgattgaaagctacagagacttggttcatctgctcattctcaaatatttttaccctgtattttgaataaagtaccacaaaatatagagcacagatgtcttttaaagataaaagaaatgcatacccttggtcactagaaataaattttcatttactttagagtgtttttctcttgggaagccttacctctaacccacctgctgctgttttaacctctcttctttgacactttatggattgcagttttctttacagatggccaacccagagtggaagataggttaaatcgaaacctatttttttccttgaaggaaaagaacccactgtgcatctatctgtaacggagactttagatttgaccgcaaagcagatgagtctagaggctgctcattgaatacaaagggcagccagacccctatgtggtactagtggttaggacctcgtcatactggttgggctgtcctggtgtcctttctcaaatctgttgtcagtttccaggaatcacaattctggtaatactggaactaaatgtcaatatttatatacatacatgtatgcatatatctgttagatctaattacataaataatatattttagatgtaatataaatcaattgataaatatgcacctgtgtgtgcatgtgtcttaatctttcactagttcttataccttttctttttagtatgacagctttcttaagaattcctcctactcaaacattgtctctcagaaagaatatgaaagttatgtgggtttcaaagaaagttatactcatatgccatagttctttatttctaggtttttacctttctaagctgttgcttttattaggttgcctccgctcacttgtttaacgttacattcagattcaaaacttctctgagcagtgggctcacagaagtaggctgcagactgtagtcctgtcttgctctttaagactcaatgcataagctttattcttgacattattattgatgttcaatatctagtcttcattcttttgtttactcctaaccatcattcttttagaactcagcttcgcagctcagaagtaattcctgtgtttacctaaactgtcttgctatttcgttaaggacatgaaaatctgtgagctgaataaatactcttaaatttaaaaggatatataaacatggtaagctctgtgtgcatttctgtgaaacacttctcaagtattgacatttgcatgctttggagagcagagacactaactctttttggtaagctttttgaaaaaatgttttaatttttgtgggtacataataggtgtatatatttatggggtacataagatgcttggatacaggtatgcaatgcataataatctcatcatggaaaattgggtatccatcccatcaagcatttatcctttgtgtcacaaacaatccaattatacccttttagttattttaaaatgtactattatcgaagtataacatacatgcagaaaagtgggtgcagaaattatataagcattgagcttgaagaatgttctcaaagcaaacatgcctttgtaaccaacactcaaatcaagaaaccaagcattgtgagcaaccttctcctcccttccaattccagctgtctcccacctcccccagggtacccactaaacagacttctaacatggtggattggtttttcctgtttctgaattttattcaaatgaactcaaacagcatgtactctcctctcatccagcttgtgttgctcaccattgtattcatgatattaacccacgtggctgcacatagttaaagctgcaatttctcgtgctcacggttgtacagtattccattgtgtggctctgtgatgacttagtgatccatgctactgttgatgggcatttgggtagtttccagtttggggctatcataaatagtgctgttataaacagttgggacatgccatattgtgaatgtttatgtatgcatttctcttggatgcaaaccaaggaatgaaactgccaagtcatagggtacagtataaatacattgtgcttaagtagatgctggtcagcagctttctgaaacatcgggtcaatgttcactcccacctgtgtgcctcccccctacacctagtattgtcatttgcattttagcgtgtctgatgagtatgtcagagtatcccattatggctttgctgtgcatttccctgataactaatgaagtcaagcatgttttcatatatttattgaccatttggccatcttctttttttttttttttttttgagatggagtctcactctgttgcccaggctgaagcgtagtggcacaatctcagctctctgcaacctccacctcccgcattcaagcctcagcctcctgactacaagtgcccgccaatttcacgcccagctaatttttgtatttttggtagagacggggtttcaccatattggccaggctggtcttgaaatcctgcccttgtgatccgcccacctcagcttcccaaagggctgggattacaggtgtgagccaccacacccggccatttagccatcttcttttgtgaagtacctgttcaagtatcttgcttctttttgtcttaggttatctgtcttttcaggcattttccttcagaaaagaactggcaaggagaaaagcatctggtgattagcataacaaaatcattaaagacaaatgttactgacagagatatatacaaatggaatcagacttagcctgggtttgaattttgatataatcatttacttaccatgtgatagtggggttcttttctttctttgagtctcagttttctcacccatataatcaggataatagtaaaatttcaaaagtttattgtgagagttaagatgaaataatgtttgtgtgcacttacttctggcctgatacgtagttgtttttgaaaaatgagtagttattgtgataggagatcatgaagcaggggagtttgctgtctacttggttgctgcctgtgttagttgctaactactaatagtcttgaaaagcttttattaataaatgactagatactggaaggtaatgtagtccacatgttagtaatctcttataagatccacactttccatagtgtgtgatcacctttgagcttttagagcatttaaatgtcaccaaatgatattgcatttgtatatataccgtaacttaagcaattcggtactctagttaaattctgattgttccaacgcacatttacatagttcttcaaagtttacaaaatgcttttatgcccactatttcatttgacattaaagcagtcactagggataggcaaaggaagtgatgatgtcttcattttatagatgagaaaatttcaaaccagggaagtaaactgtactgccaaaggccacagagtctgaggatggtcaaactgagattcaagctgaaattgactcttattccatgtatagtgctttggtcatcttgtttggaatgtctttccaagtttaaataatgggattataattaaatttaattaacatgaaaatgttgtagtgcttttgggtataaaaatcaattatcactgggctagagaagtgctgaagtgcctgttcacagagatttctggttagtagaatgtaggtagtatagttttttttttttaattgtggttgttcactcacaattcatactttttacaagtgatcagaattgtcccgacagttaaaataagtgtgagcgggccgggcacggtggctcacgcctgtaatctcagcactttgctaggccgagatgagcagataacttgaggtcaggagttcaggaccagcctggacaacagggtgaaacctcgtctctactaaaaatacaagaacttagccgtgcgtggtggtgcatgcctgtaatcccagctactcgggaggctgaggcgggagaatcactggaaccccagaggtggaggctgcagtgagccgagatcgtgccactgcactccagcctgggagacagacgagactctatctctaaataaataaataagtatgagctatacacttatatatgccttgggaaatatatttgcacagtaaatgatttttaaaggcatgtgtgtatgtatgtgtgtatatatactatgtgtgtgtgtgtatatatgtgtgtgtgtgtgtatgtatatatatctgtctccttaaatcactcagagcttttccagataatgtcttaagatgtcctttaagggtgatatttggcttttaagacctctgtatctttgaatgtcaagttcatatatgtattttcgtaagaaattgataacttcatatttggaactgcattttttttttattaataatagcttttaatattggccatgttaaaatccttaatttttttcagaactttaaatttggctttaattataaacctcactacataatgacattttattaaaattaaataaggggctgggtgtggtggctcgctcctgtaatcccaacactttgggaagccaaggtgggcagatcacttgaggtcgggatttcaagaccagcctggccaacatggtgaaaccccatctctactaaacatacagaaattagccaggtgtggtggcgggcacctgtaatcccagttactcaggaggctgaggcatgagaatcacttgaacccaggaggtggaggttgcagtgaactgagatcacaccactgcactccagcctgggtgacagagtgagactccatctcaaaaaagaaaacaaaaaaataaaaagggaaatgaggtaaactttcatataaacattaagaagcacagaggcgggaaaatgaaattaagttggtggttggcaacctctgggcatgtgtagagaatgagcttgttggtgcatgttcagggtcatgggaccctctggttgccttagcatctcccagcacagccccagttaacacctatcactttttcttcccattggagaggcagtttcatgtgtgaatgacacttccggggcagcggcccagcctttgcacaccagagaagctcctgcaagttacttcatcactctgtgcctcaacttgcctttctatgaaacaagaataataagagtcttactcttaagttttctatgattattaaatgtgttaaactatgaaaacacttggcacggagtaagtactcaagtaaatgtgaactgtttcaattgtgattattcccacctccctctgcatctgagtacaacttctccagtgctgaaaaagagcagtcccttttagaaggatgccttcattgttttaaagaaagctcttgtaaagcgtattgaattatgtaggaatgtagtggtcatcatctaactgttcattcatgaagcaattactgagtccctgctctttgcccaaggctattctgaaagttagaaatgtacagaggaattgaacctttcatctctgttctcagaaaagtctagtctagcagtggaaatatatgagtttccggaacattaaaatgtgtttgacataacaggattatctgacaataggaataaataaatggtataccacctatagtaggaaatagcatatagacattaaagagaaaaggctagatttgtatagacttacgtagaaggaggtttatattctgagaatacgttatataaaaattaagacgtagagcaatgtatatagtatgattgcatttattctacatgtgtttgcatttatattggtgtttgcatgagtagaggtctaaaagactttaccagtatacgaacagcacatgaaaatgagattatagaggaacaggcaggattttaccttttacatcattaagtatgttgcaataagtatgttttaatttaataatacatatttaatgtgacaaatgccttaaaattaatttatccctcaccttttcccagaaaggcttataaaatttaaatatgttatctcctacctcactagaaaacactcaacctgaaatgcattgagcaaaagtaattcataaatggaggagtctactgattgagaaattgtcatatgtactcaaagtattttggaataaagaagggcaaggtctggccttcttcttgatcaagaagtgtctcatagcagcactgctatgagctcccaaatgtcctttaggtctggccttcatgagatgttatatgtggaggtgcttaactgtgggttagggttaagtcctttgctttgcatgataagaacctgtttcacgaagggtgatcaagtcctactgagttgatttgcactgtggtacaccttcgttgctggcagatttcctaaataaataaaggtcagaaggaatatatgagatctaagcaggtgaatttacatcatcttaagagatatttccattaatttgtgctagcctactgaattatcatccgtcactaaagatacacacaactcatgatggtcacatggtcacatctgttagacatggccccatcccactgtctaaaacacttttcccttcacttctgtgataccacattctcctgtctccatttttttcttcctatttctcctaatctacatatgatatattcaatgtcttgccatattgctattccttcaggtggtcatgagtccatcctcaactctagagaagctggtgaatggtaacataacatttgaggaatgctcaaaagaaagaaaatctgaaagaaaatagacctagaaaaaatggctagagaaattgaagttaaacttttctgcacatacgctgatagctaccaaatcaatatgcccagcccagatctttcttccaagttttagacccatattcaaaagtttccagacatctctatttggaaactctccaggcactgtaaacatggttatacaagactgagctccatccttgcggtcctgttcctccctctctctgctcctcccttccactctcccaccactacttatatctactcctcatttactggttagattaaatgacacttttatactctccattgtccaagccagaaacatggtcctgtccctcttctttactttctgatccattcaatcatgttcaatcattgctacttccttgagagctctggaatcttttctttctattccacctatctccatcctagtgcaggctgttattttcttccccagttaccacagtaactgcagtagtccattctcaccctgctgtaaagtagtactcaagactggataatttataaaggaaagatgtttaattgactcacagttcctcataactgggtagacctcaggaaacttacagtcatggcaggaggcaaaggagaaataaggaccttcttcacgtggcggcaggagagagtagagagcaaagggggaagaaccccttataaaaccatcagatctcataaaaacttactatcataaaaacaatgtggaagaaactgcacccattatccagtcacctcccactgggtccctccctcgacaaggggggattatggggattacaattccacatgagatttgggtggggacaaagccaaactctatcagcagcctcctaactggtcaccccatcttagtcttcatccttcaacaatccattctccacattggaactgccattgtgattttttttcaagagcaatcatggtatttctctgcttaaagcccccagttggttcccattttctgagaatatgagtgcaatctgagcaatgttgctatgagacacttcttgatcaagccactgcttgtctccttagccttaattctcagcaccttcatcctctggagtcccccagtggcattgaatttcatacagtttcctaacaatcaacactcttttatttgcctgtgctcctccacagaggctgttccctggtctcggttaggtatccttgcttttcccgtatcataacacttaccctaccttatcctaattatccctttagttgtctgcccatcttagaacttaagtttctttcattccctttttgattgttgtatctctgttgcccagcaagaatgcctggcctctgacagacactcaagacgtaatggttgaatacatatatacataatgctggggaaatatcaaatttttactctttcactactacctctttattcctacttgtcattataatatgtcgttttgggggatgggggtaatgctctcagtcagtctatgaagcttcccctagatacttcattgatttatgtgatatatgtgaaatttactgtatacttgtgtgtataaacacacatacacagagctttgtgatggtataagtgttccttggtctcatcaatatgcagaaagtagaagagaaatttggttgatatgcataaagtagaagagaaatttggttgctacagtttgcaactatgtaatcatttcctcttttggcctcttttcccgatttagatgatattccttgtatttcttttaagaatataaagcaagaagcagcttatttacccataacaaggacctactgaagtgcagaggagatctaagttctgattgaaagcacgaaattgactaaaagccacaaactaactttgttttaaaacagcagttacaaaagtaggtaaatatgtttaaaaacaaaaacatatttaaaaacaaaaacctatcttcaagcacagccatttaaaaataaaaacaccaccagattatttaaagccttgagttaagggctttaatggctatatgtatggaaaccttccctaacatctttatcatatataaaacaagcagctcctattttaggagatgtgtccttcctccttccttctcccggtggcagcacaggcaggtagccgttctctgaagcagccttttgtgttgttggtttagaggctttcattgcccgctaacctttctgctgaatagatctgtttcccattgagccagactcctgtgtgtgttctcttccttggtattacattgagataacagccaattctcttctgtttgaatcatcagaagtagctttattttttgtttattggggtttttttcttccttgcacttttgtgatgagcaggtcaccattctcctccataccaccaaaggaataaataatttatgtaacctaccctgatttccaaacaataaacctgaataaagagagtaagggacaagggttctgttgtaatttccatctcttaccatttttttctttcttcctttcttttttctttttttttctggagggagtaatatttccagtgagtctgtgaagcttccccagagtgtcccattgacttctctatggtagtttcattattgggtgaatcagttttttctttggagcagatatgatattatgaaacaatgtgatagctattcgaaagagtggatcacaaccttttttctacagagaggagtgggacatagttctaattagaacaaaggcttcttaatgactttcaaggctcgtagttaagggagacagggcaagatgtcaaggaatggtgagctaaaagaatctacttggaagatgtgggatctctcccttcctctcccccaaggttctatgcctctatattcataattaccctccaaaaaacttcagagagggtggataatataattcggtggtacatactagaaatcacctctttctaatttaaaagatagaatttattggaggtttgtagcaatgctgctgatatggtttggctctgtgttcccacccaaatctcaccttgaagtgtaataatccccacgagtcatgggaaggacccggtgagaggtaattgaatcatgggggcagatttttctcatgctgttctcatgatagtgaacaagtcttacaatatctgatggttttataaaggggagttcccctgcacaagccctcttatccgccgccatgtaagatgtccctttgctcttcctttgccttcggccgttgattgtgaggcctccgcagccatgaagaactgtaagtccattaaacctctttcttttataaattacccagtttcaggtatgtcttttttagcagcattagaatggactaatacagcttcttagtgtgtactttgggtcactagcgttaggattcccagggatgttggtccccaaaaaaatgcagatctctgggaaccatcttagactcatagactctgaatctcagggatggatcctgataatttaatgtttaataatctctcaatgtgacttcattgtgcatcactattttttgagggctactggccaacagcagagctatggaaggaaagctgaaggttggatcagggctgctctgagaatttcagtattgggaactgtggctgggctccttggagtctatcttttgaggtgagtcagctcacctcaagtcaactggtgtcaagtgtctcaaggttcaagttcctaggagaggggatcagagtgacctggcttgatctccccaggtcaggagaggggagggctacttgatcggctctctcaccatgcttacagacagtggaggacgaagaggatttccctgaggaaaatccaagtgctgttttccagaaaacaaaacaaaacaaaaacaaaacaaaaaaaaaagagggaaatggatcctgggcagataaaaaccgcattttttttttgcacatacacagaactttatgataccatttttaaaagtgaaccatgctctcctgtggtgaaagcttagaaagtgaagaattaacatatttaagcttagcagtgctgatgttcctcattacataaatggggattatggaaatggtggctaatagtgatggagtttataaggaaacatccagaattcaaaatacagaattgcctttccagtaggatttgtacctggcaaaaacttgcagagtagggactcagtatttgaattaatttaagtagtcatggcaaaaagattttactcagatattcagtaagtattggcaacttactgaattataatactgaattatagtaggagcttgcagaattgactgagcaacactttgaagaacatatttataaaatagctaaaatgaaataccacatactctttcattcctttcaaggtacaactttaactactagatccagttcataccgtttgtttcttcttgttgttggaatttcttcttgttgttgttggaaccacaggtctgaacaaacactgttctgttgaatatctagaaggaaagacacaatttggattttgcttttccagaaagttccactccttgggggtcctactaacctctaactttgacatcattatggatgctgcagaaataagtcggatgtcctgggcgcaatggactacattgtgaagcctgttggcaacttcccttatataaggttaattcgggtgaaataaatcaacccgactacttattttgatgaaaataaatgtcagtccagaaaaaaaaagaggagagagaaggcacctgcagtggaaaggaataagaaaagtatcttgcaaactgttcaaactgtaagtaactatcagcacccctcagcaccatttttatctgaaagaacactgcaaatatcttaaaaagtgacttaaggttgtgcaagaagcttcctcaacttactcctgaacgcctgcctctcaaatctgaatatggcagcaggacagaaagaccctagaatttctcaccttgtatgtaagcactctaagcaaggtttgcctatgaatttttgtttgattaaagatgggtgaagagagggtcagaacttctctatgtcacgacctctcttccttcagggttgtacatgttttaaaagagaaatccacaatttttttttctcatatagtacacaccttcacttaatttagtcttatggctttaaaatgtattattttaaataacctttggtcaatcctcctcaaagcaccaatttcataggattttcatttctgaactatagttacaacatgcttataaccatttaaaaataataggattcttatttctatggaccaaaaaaacacttaaaatttcaaaatgaatccccgcttcaaagggaaaaaccatcagggctggagggtccttttctgatttttcatttttttcttctctgtatgatttcttattacacagttttatttttccaatgaacttaactcttgagccatgattgacactacaatcagattaaaggatactcttttaaaagacactgatttggactctactccacaaaaaaggagatgaaagctggctttttctgacttgattggctattctgtgtttacctttttaatgtccttgatgagacaggtgtttctcatggcattttatgcagtcagtcagtcaaccgggatttcactctgacagctgtgctccatcgctatctggagaaaatggcagcagctcagagttcctacagatacccctgtgatttgatttccagctatagactttcgttttctgccaggcctctgatgggtcagatttaagtaccaatgtgccatctaaatactagctttctgaactcatttcccaactttatcctgttaatgccaaacttctttatgaagggggaaggttagcttcgtaataaggggatagatacaagagactccatacacacgtggttttgaatatcagcttctaggagctgatggaagagtatgcacagaatattagtctcatattaagcatcaggaagaatagctagtggatgctgggcttaatacctaggtgatgggatgatctttgaagcaaaccaccatggcacacgtttacctatgtaatgaacctgcacatcctgcacatgtacccctgaacataaactaaaagttgaagatttaaaaaaagaaaaataaaatttatttttctaaaaaaagaaagtttcatattaaatgagtggctcatgaagaaaataaaattggattttattctcccatgcaactcatcatggttttaaaaatttattcttgttaaataatggctctgtgttttgtaaactgcatagaataacacaatcaatgttttattaatagtttctaaattaccatgcagaccacagaagctcaagattttaaattttgaagtaggactttactatcagttgttattagtaatttgaaccaatttctctggtttcaaaatacgttacttaattgccacgagagtggtgaaactttgttcagatttaatgaggaaattctggttcagcttttctttattccttgtctatctttcatacatttcaacatgtcaaagtattaacatatattttatagtaatctcaaataataactaatcaataaatacagaacatctctgtaccatgcaacaatttcagtttcacatgatataaaagattagaactgttacagactttgggcaaaagtggtgagctcagacaatttcacgataaattaaacttagaatcaaagagtgaaaccagaataagcaacgttaagaagtggatgatcaggccaatcttattggaaacgtcaatcgtgtacttgctaacctacagccttctactacatgaagctgcccaactcacagtcactgccaaatggcagttctgtatatacaaactacatggacggcaccctcaccccacaaacaagcagccaaaatgtattcggttgagcactttgacttaggaatttgaatggagaattcacagtatcacttagcagtggagcaggagctgaaagattaccatatgagaattaaagtcatagagggctggatacagtggcacgcacccagctctgtaatcccagagctttgggaggccaaggcaaaaggattttttttttttaagatggagttttgctgtttgcccaagctgaagtgaagtggtgtgatcttggcccactgcaacgtctgacccccaggttcaagcgattatcctgccgcagcctcccaagtagctgggattataggcatgtgccaccacacccggctaatttttgtatttttagtagagacagggtttcgccatgttggccaggctggtcttgaactcctgacctcagacagtccacccacttcagcctcccaaagcgctaggattaaaggcgtgagccaccacacccggccttgcaggaggatcttttgaggccatgagttcaagaccagacagggcaacataacgaaacccccatctccacaaaaaaattaaaaaattattagcctggtgtggtggtacgcacctgcagtcccagctacttgggaggctgaggtaggaggagctcttgagcctgggaggtcgaggctgcagtgagccgtgttcgtgccactgcactccagcctgagggatggagtgagatcttgtctcttagaagaaaaaagtcatggagggtcatggcaagccaaattctgagtaaagaatcccgtgaggaagtggaagctatgtgataaagaatctgcatggaaaagggaaagagtcagccaggtggcaccgggtgcagaccgcagagcatgcaggaggagtggcctataaaggcaacaccctttaagacagaatgttgtgttcatggcagaacaccagagtgaagatcaaaagtcgtctctggtttttctgaagtcttatggtccagcttttctgagttgccacaagtgtatattctttaagtaaggcccggccccttgtggggacttcagtgatctctgttcttttccgccaagtggccaacactctaatacaacgaggaaaatatatgatcaaccaaggagacaaaagtgagtgagcgctaaatgttagcataagcttaaatgatgcgacatgataaatcaatataaagatgaaatatatacagagatttctaaaacacaaatgataattaaagcatatctcataaattatgaagtgagacatacttaatcttcagcttaacaatgtctacacttattcgtttaatcaatatttatttaatgcctagcatgtctcagacactatgttattcttgggggatgtaaagatgaatcaaataatcttttccctcaaggaaatcatagtctggcagctagaatgagacatcgctttcatttttttcttttttaaaaaatggattgcttttgattcctgagtcaatctgttatcctcacttaagcagatcatgtatgggaatttgtctgggaaccagtttcctataaccagctataacacaatgtgattaattagacgtatattttggctcaaatcttggatttaagtgagtaacctaggtagtatacagaaatggatatttttcaggctaatggataaagatatgtgttccagtaaatcaagttacaaggaaaatattgtccttaatattgttgttattatgtagattaattttaagattaattatataactgctatgcatacatcatgacgaaagaaatgcaggatttagcttatgacttgatgtggtggctgggcacagtgtcccacacctgtaattccagcattttgggaggccaaggcagaaggatagcttgagtccaggagtttgagaccagcctgagcaacatagtgagaccctatctctacccagaaaagatttaatgtggtgagtaataaggaactggcttcatgatgatcatgagtctgcattgatgtggcaagaggcactccagaaagacttctggcgacgtaggcaattggatttgaatggagactgtcaggaaggccacagtcttatatattccccaggtgaggtgatcaagggatgagaaaagtcgcagtgacaggggctattgagagaaaaaaaaagaaaatgaaacataaatatgatgattttatctttttctattttacttataaaacatgatttatatagactaaaattttatttgcgataagggaaatggagatagaaaacggctaagtcagaaaaagatagtcattctgcttttcacagcctattttgggccaattgctccctgaaaataaattttttaaaaaaacttctagggcgcagtgaccacacttgtaatcccagcacttttgggggccgaggcgggtggatcccttgagtcaaggagttcgagaccagcctggggaacatgatgagacccctactctacaaaaaatacaaaaattagctaggcctggtggcatgtgcctatagttccagctacttagggaggctgaggtgggaggatcgcttgaacccaggaagtcaaggctgcagtgagccatgatcatgccactgcactccagcttggacaacagagagagatcctgtcttacaaaaaaaaatctttagtatgttttggtttgaaattgagcatattggaaacctcctgaattcttcctctatacattccttcacccatttcttatcaaggacgttttaatttagttggttggccaaattaatcaaatctgaaaggatttggctgtctttctgaaagctgtcccagaactggtaaaacaaatggttcttttcttcctggaagaaattcagagagcccctccctcccggatctccccatttccttttttctctacctttccccaatgatcacagtcagtaagagccagaaatggctttgtaactcttacgaataatgaaaagtcattgctgatgattcgcaccaagggggaaggatgctgtggttagatccttgcttaagaaacgattgtttgtaacattattcatgtctttgtcatctctgggttctgtcactgcagcatgttctactgggatgtgtctttgaagttcccttggcagacatttgtattatcattttagcagcattttcttgcatataatatgccagagtaatatatactaaaatgataaatatagtttttgcccttgaagagttgataatctgacaagggttggcatttagttactaaatcatccaaagagaagttatcataagaagtatcatgacctattgacaaagttttaggcaacctgttagaaatactcagcttggtctaaactaaatacagagctcttcaaagtcattggtactaaaagcctagcttgagctaaagaaaacaattttccacccgagagctgggcgcagtggctcatgcctgtaatcccagcactttgggaggctgaggtgggcagatcacttgaggtctggagttgaagaccagcctggccaacatgacaaaagtccgtctctaccaaaaatacaaaattagatgagcatggtggcatgtgcctgtaatcccagccacctgggaggctgaggcaagagaatcacttgaacccaggaggtggaggttgctgtgagccgagatcgcactgctgcactccagcctgggcaacagagtgagactctgtctcaaataagtaaataaatacaaattatccacccaagagaataaattctggtggccacttattcaaagtagaataagttctactttgaattattactactatgtgttgtttcaccatagctgacacatggggattataaattacatttacaagaataaaaactagaaaaattaaccatgagtatttattgagcaattactatttagcaggtactatcctaagtgctttacatatgttcatgaaatactcataacctatgagcactataagaatcttttattttgtagatgatgaaattgaggcacaagggcactgtgtccaaggatgcccgagccaagatttgaacacgttgagcctggtcctaaagtctactattgaattcgtacacttaatccctctcctagtcactgcggcccctctgtgtgtattataaaaaggtactctctttgagtgggaaaattagaaaaatgcaccctcacagggagcatgtagcctctctttatttcacccctaactcatcctttggcctgggcttttgaacagtacacagaatgtacaactgtacatggcagccctgtcttcactgtcttcactaccagtcagtacctttacaaatttcaagtaactttgacatgcataatcttatttgattttggcttcagccacgtgaaataaaaatgacagttaattacctttctcttacaaaacagaaatctattctctttatgtattgatgtattgatcacacaaaaggtacatcataaaaaccaagcagtggcccaggggcaggaaagatcctgggtatgaaccactgtgtgctttactatactacatgctttgcacatgacttaatttactgttcccaaaagccctacaaggtaggggatcactaacgcctgtacacagattaggaaacagcttcaataaagtgaattaccttgctgggctttccatattttgtaggttgaggtgtctgaattcaaccctgggctatctgacttgaaatctatgcttcttccaccattcttagaccatctctatttgagtctatctgattgtttggtgtagacatgttcaaacaagataatactcattagtgttggacaattggagattaggataaagcgtgcctcaagcagagaaaattgcccagggaagatacactagggaagatactgcctgcttcttaataagctagaacaaaaagaggtcacactcaagattatgagccacttattttgttaatcagcacatactaatggagcacctattaaatgcttggcagccatttaggagctgtgtgggaaacaacaatgaaagtcaaaccacttaccctcaaggggattgccgtctaattagtaagacaactaacaagcctgaatgtgaacactgaagctacttagtaatctccaaggacctctttcagtagggactcatttagtgaatttgcagaagaaacacacacagattgggagcttcccttccgttctttccactaaatggtggggtactgtttgctgttgtgtgtgtccaaaaataacagacctctttcccaaaaagcacagtctgagacaaggacttagtgtaggtaatttcctggaatggatgtttctgggagacagaggaggaaacgccaaaataaaggaacattatagcacttttggaggctgtggcaggtggatcacctgaggtcaggagttcgagaccagcctggccaacatggcaaaaccgtgtctctactaaaaatacaaaaaattagccgggcatgatagtgcatggctatagtcccagctacttgggaggctaaggcaggagaatcactggagctcaggagctggaggttgcagtgagccgagatggtgccactgcattccagcctgggtgacagagtgagactccatctcaaaaaaaaaaaaaaaaaaaaaaagggggaaataatgttattaaagttgtggacataaggggtctggattccatcagggccccctggaagatgtaccaaaaccttccagaattgtccactttaaggatggcagtggggagcatttgttcacagcttctgtcccctattcattgagagttgtccctaggggcagtcattaccccacatttctgggctggctggtgaaaagaatggatgtttacaggtcgtaagaccctggggcagagtggagagtcccatggcttaggtttgaggtagcacagaggacactgcagctgtggctgggttcagaggtggattgacagaatggaatgcagagcaacagaggtgtctgctgcaaatctctttcagccccctccgtgtgtgagcactagatggctgtccttgtcatagacaaaagatagaccagtcacctggggaggcactggcatcagcctgggaaatggtcaaagctgggttttaccagtagtcatttaaagtctcttggtctccatttcccataagatggaaagagtaataggacctgccttacagattgttaggaagacttattaactcagtgtgataaaatgtttcatagaatgctgagcactctttctggcaaatatgagtattcaatttgttgggaaacagagatcccaaaaggcttatattgactggacaaggagttgctttttttaagtgtgtttttttccttttattgtctgccttgttcattcacctagtatattagtccatttccacactgctgataaagacagtccctagactgggtaatttagaaaggaaagaggttgttgacaaatgggatctaattaaagagcttctgcacagcaaaagaaactaccatcagagtgaacaggcaacctacagaatgggagaaaatgtttacaatctacccatctgacaaagggctaatatccagaatctacaaagaactcaaacaaatttacaagaaaaaaatcaaacaaccccatcaaaaagtgggcaaaggatatcaacagacacttctcaaaagaagacatttatgcagccaacagacacatgaaaaaatgctcatcatcactggccatcagagaaattcaaatcaaaaccacaatgagatactatctcacaccagttagatggcaatcattaaaaagtcaggaaacaacaggtgctagagaggatgtggagaaataggaacacttttacactgttgatgggagtgtaaactagttcaaccattgtggaagacagtgtggtgattcctcagggatctagaactagaaaataccatttgacccaaccatcccattactgggtatatacccaaaggattatacgtcatgctgcgataaagacacatgcacaggtatatttattgcagcactattcacaatagcaaagacttggaaccaacccttatgtccaccaatgataggctggattaagaaaatgtggcacatatacaccatggaacactatgcagccataaaaaaggatgagttcatgtcctttgtagggacatggatgaagctggaaaccatcattctgagcaaactatctcaaagacagaaaaccaaacaccgcatgttctcactcataggtggaaactgaacaatgagaacacttggacacggggtgggaacgtcacacactggggcctgtcatgagtttgggggaggggggagggatggcattaggagatatacctaatgtaaatgacgagttaatgggtgcagcacaccaacatggcatatgtatacatatgtaactaacctgcacattgtgcacatgtaccctagaacttaaagtataataaaaaaattaataaaaagtgttcttcaaacaactgtgagcaaagatggactagtagatatagctcccctgaatactaaccattaatatgcaaagaagattgattttgacaatgtcatggacaacttttcagaagtttccaaaacagaaattgtagtgttattattattcatcactgataccagcctatatgtaagaataagtttttccttttttcaaaaatacactaatgtgattaaaaccttaaaaaaaataaaaataaaaaaataataaataataaaggaaagaggttgtttaactgactcatagttccacatggttggggaggcctcacaatcatggcagaaggcaaagaagagcaaagtcacgtcttacgtggatagttaacaggcaaagagataacttgtgcagggaaactccctcttaaaaaccatcagggctcatgagacttattcactatcatgagaacagcagggaaagacccacccccatgattcaattacctcctaccaggtccctcccaccaatacgtgggaattgtgggagctacaattcaagatgagatttggatggggacacagctaaatcatatcacgtagttgatctgttttcaatttttattccactgaaaggtcaattcagatttgctaaagtatccttgattgataggatatacctggttggacacaataaaaatcagttcctttactggaaacatgtgcacttaaaggagaatgctgaatcccatcaaggaacaaaactttctcccattctgtccccagaaactagtcacagaagggtttgcatattctttgtggtgagtgcatactgatgacaacttctgtttattcctccaacccacttcctagagccaggatagctttgtgcatctgattcttatgatgaaaattgttagattatttttggggaactgctgtgtatgaggcagtatgcttggtcctagaaatgtgaagggtataaaaacaaaaaaatatatagaatgcatttcttgtctacaaaaaaagacgattctggttgaaggaactggatgcaaatggttgagcttttagagataatggggaactagggagtactaaatcacagatttggtcccatttttacttatccaagacgaacataagaaattcaatgggaaaggaattcacctggggctctttgagaaataatgagctaaatgtattggagacgtaagtgagaaaggccagcagtcagcagttctgtgctcatcaaattcaggttatgcacagtccttttcctagatatgtatggtagtcttacagatgtggcacatctggtctccagagatgcacctctcccaacccatgagccatataccctgtattcctgtctttgtacagtcctctcccttgaatctgggctgcctccgtgactcacttttggcaggtctaacgtggtgaaagttatgccatgtgactttcaaggttaggtgagaagctttgcagctccttagggtttcttggaatgcttgttcttgggatgctgtctcttggaacccagaaaacaagctgtgagaagctcaagctatacacagcggtcacatgtttttctgtggtcaccatccccagctgagctaccaggtgacagccagcactgtctgccacttgggtgagccatcatggatgtccagctaagatatccagctaaggcttgaataaggcttcacatggcagccccagcagctatctgactgttaccatgtcagagtcctcaaatgaaaactgcccaactgagctcaatgaatacacagaaccataagataataagttgttcttttaagctatcaagttctgggagagtttgttacacagcagttgataactggtacaaaatgtaatttatgtcttaaatatcagcaagcttttaatttttttcacagttgttatgtgacattttgaagtctccatttttttgtttttgcttttcttacttttgacatactataaactcgatcctttcaaatagctttatggaataatattgctgttcattagtttttaaatcataaccttacagatgaaattcttaagtgtattgtcaacccttttgtagtctggtgaagcctacggaagtcttttattattaagtgaataataagaaatttgtagaatcacagaagaaaccaatcatgtgggaacacagtttttgaaatactttaaaacccaaatctgtggtgtagtaatatatgtacatctatgaacacattaaataacactattgatgggcacaattataattttgaagtaccaataaacataatcattttctaacattttgtaacattttagcatggacatttttaaacatgcagcaaagttgatcccacaaagaatatctgtatactcactgcctagactctcccattaacattacttatgctgccgggcgcagtggctcacgcctgtaatcccagcactttgggaggccaaggcgggcggatcacgaggtcaggagatccagaccatcctggctaacacggtgaaaccccgtctctactaaaaaaatacaaaaaattagccaggcgcggtggcgggcgcctgtagtcccagctactcgggaggctgaggcaggaaaatggcgtgaaccctgcaggtggagcttgcagcaagccgagatagcgccactgcactccgacctgggcaaaagagcgagattctgtctcaaaaaaaaaaaaaaaaaaaaaaaaaaaaaaaaaggaacattacttatgcttgctttatcatgttatctatctaaccatccgtcatcaatcttaatgtttttatgcattttccatgtaaattgcaaagcaaattgcaattctctatgaataattcagtgtgtatataattagctggaagatggacttaagattgtgattgtgatatatgtgaaaatattgtaatctgatggaaaaatgttggtgattcctattgctgacattactaggtattgctgttatcactgtggcttgttaccagtattcatattttaaagcaatgctaagtttcagtcagaagttactgaaaataaagatgtaaatttgttcacattcaagttcatgaccctacctattaatcgaccccatagggtccacgatctccaagttaaggagacctaataaatgaaatgtgcagatagtctatgaataagttaaaattcaaggcaaatatgtaaactaatataggcatactttaaaaatcaagccataggccaggtgtggtgcctcacgcctgtaatcccagcactttgggaggctgaggtgggtagatcactagaggtcaggagttcaagaccggcctagccaacatagtgaaaccccgtctctactaaaaacacaaaaattaaccaggcatggtggcttgtggctgtaatcccagctactcaggaggctgaggcacgagaatcacttaaatatgggaggcagaggttgcagtgagctgagatcacaccactgcactccagcctgtttgacacagcgagactctttctcaaaaaaaaaatcaagtcacaaatataaattctgacatttttccctttaacattttacagtgacattaatgaaaggagcttggaatactccaaagagtcatggaaaaggagaagggagtgttagtgatttgacatctgtattagctagggctggtgtaacaaaagcaccaaaaaatggtgtggtttaatacaacagaaatttactgtctcacagctctgaagcctggaaattcaaaaacagggccaggcgcagtggctcacgcctgtaatcccagcactttgggaggccaaggtggacagatcacctgagcccaagagtttaagaccagcctaggcaacataacaaaaccccattcctacaaaaaatacaaaaatcggctgggcacgatggcacgccctgtagtctcagctacttaagaggctgagttgggaggattgcttgagcccaggaatttgaggctgcactgagctatgatcatgacactgcactccagcctgggtgacaaagtgagaccctatctcaaaaacaaaacaaaacaaaaaaacagaggtgttactggggctgtgctattgctgatgattgtaggggaggattctcccttgcctactccagcttctggtgtttgctgacagtcctggcaatgctcagctcctagctgtatcactccaatcacgtgctgtcttctcctgtatctttacatcatcttccctctgtgcaggtctgtctctgtgtccaactttcctctttttataaggacaccagtcatattggattaaggcccaccctagtgacctcatttgaacctgattacctctgtaaagaccttaatttctaaatcaggccacattctgaggtcctaaggcctagaatttcaacacagctttttgtggggtcataactcaaacccataacaacatcagaacattgtaattcaaaggaacacaaattcaggtttactttgaaactaaatatttctagaattaaatttgtccagagttacatggtctagtcttactttcatacaactctcttctaacacactgtgtttgtgctggatatccctttatgagttttaagaactctgaaatgtgaaaagtacaaataagtaatctcttgcattcctattttagtcaaaagatcaggctccaaattgctttattcatctttgagtagtattgcagaaaattttaactgaaaattatattcaaaatactgttttcaatttcctaatggaactgtaaccaattagtcaaccacaattattgaacaaccatgagtactgtattccctgaggagaaaaaacatagtttttaggcaactatagcaagatgcagcaaatgagatttatacacacacacacacacacacacacacacacacacacacacacacagatacccagtagatgcagaatcaaggcactcttttatttaaaaaatccttttctctgccaggcgcggtgcctcacacctataatcccagcactttggggggccaaggtgggcagatcacttgaggtcaggagatcgagaccagcctggtcaacacggtgaaaccctgtctctgctaaaaatacaaaaatcagccgggcgtggcagcacatacctgtcctcccagctactcaggaggttgaagtgggagaattgctttaacccaggaggcagagattacagtgagccaagatggcatcactgcactccagcctgggcgacagagcaagactccatctcaaaacaaagaaaagtaaagtaaaaaaatttttctccagttttgtgtctattttaatttttcttctgattttgaactgattaaaaatttcatatctgcaactttagtggtaatatcaagttttgcttttttaaaatcaaatgctggttaatactgcctctacccccgaccccctccccagcaaaaaaatccagaatcattcaaaatcaatcttacgaagttgtcttcatttttttttcttgttttttttttttttttttgagatggggtctcactctgttgcccaggctggagtgcagtggcgtgatctcggctcactgcaagctccgcctcccgggttcatgccattctcctgcctcagcctcacgagtagctgggactacaggtgcctgacaccacacccagctaattttttgtatttttagtagagatggagtttcacccagttagccaggatggtcttaatctcctgacctcgtgatctgcccgtctcagcctctcaaagtgctgggattacaggcatgagccaccgcgcccggccaaagttgtcttcattttgagtaagatttttaaaaatgtaaaatacttaccacagagaacattttcagcaaatggtagctattataattgtagatgctggatggatggatggcacagagttatcagtggcttaagcccctgctgatagcactgatatttacgtgacgtttagctgtgtggccccctttagttgttctatcctttataaaattttactccaaaatatgttttttgaggagtcctggaacattattatttttaaaataagtaggaaccataattccaaagaattcttagacacataagggcaacatatggtcctttaaaaatatatagatgagcaattcttttagagtaggttgaaagagactgaaagaaaaaaatccagatgccatttgatttcagtgagagaagagtctaaaaagcactcctttgacttaatagatcttttttgagaggtatatgacatctctgtatcttaatttccttctctttaaagtttttttcttttttctttttcttttttttttttttttttttttttttagcctcagcctcctaagtagctgggactgtaagcgcgcgccaccatgcctggctaatttttgtatttttatagacacggggtttcaccgtgttggtcaggccggtcccaaactcctgacctcaggtgatccgcccacctcggcctccgaaaatgctgggattacaggcatgagccactgagcctggcctccttttctttaaagtgtttatgttaatacctatttcccagattgcttgaggctgagtatatataaatgtctttgtgcatataatagaagctcaagaaaagtgacatccagtttctggctccctctgtcacctcccatcacctcaatctcttggtcaaagtgaccattctcccaggaagaaaaaaactcaatgaaataaaataataacatgcatttcttctgttgtaactgacctttcaatctaaaagaacatcagaatttggaagaaaaagtaaaaagtgaaatagatggttccttccacctctatttgtttctgagcagcttctggtggccaaatgttttcttggtagcatattccctccagcagaaccttccagaatgcttcactccggtgaagagaaggacaacaggctttctaatcacacggtgttgcttgctgagggggaaggcagaggtccgcctgtataatccgatttcatcaactcacactaatcactactgatagtagcaaaatttagcctggatctgcgctgttaatctagattgacaggaggtaaaaggagaggaacgcaagggcacaggaacaaagggcggagcgccagcactgatttccagccttgctcttccgtctggggcttctaatttggtcccctttggggcttctatttttcttaccttataaacaaatgtccctggttgttaggataccagcctttcatggagcggtttcatcaacaacaggtgcgcagtgagcttctggaactgcagggagagcgataacctacgtcgtgaggctgcgcagaaggtacttacaggtactcattgtacctgagactatgtattatttattgaaactgagccctgaattatctttatcctctgagcggcactagtgcctcctaaaatggatgccaacagcagctaatctacaagagctcccacatgctccttgctctcattatttttcttattagtaattgtaagtggtagctaccaagcttcttattaaagcttggagagtaattgggaattgcaattgaacagccgagagaggaacacctctgtgattttggacgtttccacgtggactgaagttttaattttttcaagggactactccacttcggatgttgtggctatacagaagataacatgttgcagattctgcctccatagtgatcagagtagcaatctgtgatgtgtgtgttcacgtgcttaatgcccagaaggaagatgggctatgggaaggttactttcgctgttacttatgatatctgtgtctggcaaaccagagaactttttgcatttgggtaacaaagacgtttggaaatatactccattggattttccatgttggtgaaactattgttgaccgcttcagtactgtatgttgccatgccaaaatcacctaagggcaaaaatgtctcctgggtaagtagatgttgattttatatctcttaaaaagtatattttaagcagaaacacatgctttaagaacttaaagacatctagttgtttcatgttggtaagagtatttggaaaaccttcagaaagcatttgtcttagaaaagcatataaatatctttgtaagtgttagaaatcctttggcaaagtcacggtggagtgcttgctaaaatatgaactataagacatgtaaacactcagtttgttttgccatttttaggtttttaggtttgcttcacctttgcatacacacacagaatttaaagtgcattcatacaaagtcaaggttatgattttaacatgttttcaactccaaaactgtttgtgttgagtaaagattgcctagatttcttttttggggtaagtcaaatgttaagggtagaatatgtgattttcattattcagtgatattgttggtgtgttccttttttccttggaaacaagatagcatagctgtttcttaattttacgtatctaagtaattgccctcaatcaatgatagacatgtataaagtttaacatttcagtaataacaacggcatgttaatcctaatcaaatttgactccttaatattgtttcaaggtggctgggtgcagtggctcacgcctgtaatcccagtactttaggaggccgaggcgggcagatcacgaggtcaagagttcgagaccagcctggccaatatggtaaaaccccgtccctactaaaaataccaaaattagctaggcctggtggcgagtgcctatagttccagctactcaggaggctgaggcagaagaatcgcttgaacccaggaggtggaggttgcagtgagctgagatcgggccactgcactccagcctgggagacagagtgagactccatctcaaaataaaataaaattatatatatagatttaaggtagtttcctaccaaaaacacaaaacctaccagattgagctcagaataacgagaacaatctgtaaactcttaaaaaataagggctttagtttcctgctatcatgttaagtgagcttgatacattaaaattaacaggcaaatggattcctttctattctgtacagaaagttgtgtgtctaaacaccaaattttttaccaccagcccatgcaacctcgaccatactcatcatagaatttattattagatcatcattatggttttttggcaataatgtaggaaaaataaataattccatctttttggtcaagagataacgtttactaccttaatttgaaattcaccaattaggttattcttactttatatgaaatagcaccatatttgtctaaaaatggttattgtggcttttttctgttatagacagttattctttaagagtacttaattaaaagaggtgtaccttagtttgaaacacaactctcaaaattatttcagaaaaattgacaaaatttttgaagttaattcgcttttaataatggatactttttgtcttcatattattgttatcgttgattcttcacttcctcttagtaaaaccaagagatatgattcaggaacctttggcctaactggtgagtttctttccctccttatacggatgggtccaagggctagttctgatgtccaaatgtgagtttgctactttctgccagcacataaacattaaagaaaagagtcgtttcagaagtacatcccctccttcatctgattaatactcctaaaagattaattctgtcaaactagtgcctgcctaatggcatgtttctaccatgaaagcaaaacttgaaacattaagctcagactctacccttgggttgggtttacttcatactcaattatgctaatattttttgaaaagttcaagttgttggctaaaaatttaggagcacttatttcaagagagtcagcatagtttcatttcctcaggttaaaaattccccggtgtatcccacactattacaaaatgcctctgtaccaggtttgtccaaagatgagttatgagtttaatgactgccatattacagagaatacagtcatttggttggtgtgtgctgattatgcagtggtccaatcattcatgttaatgactatgataaaattccttagtttgactttagggcatagagagagagactttgaaatgttgatcattgcttcagttttcaccagtcacggttttttaggtattgaatgacgtttccctgcattttttggctatgtgaagtgaaatgtatctggtcttcctgcttttgccactggccagtttccatttggatatttatttagacttgagttcaggaggagaataaaatgattccccttgtctctttaaccacatagtaaacttcccagtggtgacagaagatcatgtaactcttcctccctggcccctcgggcacgtttccgagacctgcttcactccatgtgataaacatgaacacatcttgtggaacactgcaagccccagagtggaccaccaccttctttctcctgttcatgcctggtcagagtggtatctaggcaactggttaaactgcttgacagtgtagctctctgtgcaatggaaaagatgatagcaaccagcatgttctctgagatgtgctgaggcttatcagatcatcctggtacaagggttcgacattcattcaacaaatgttcacagagtgcctcttctatgatcctctaggtaccgaggacgcagtgaaaaagatccttgagaatctccaacatcatagagcttacattctagggaagggagaaagacaaaaagcaaatacctaagtagtacataagatggtgaatgaaatagaacagggaaggggttaggaagtgccaggaattgagaggtggtgttgccaattggttggttaaacctatttgagcagagacttgaagaaggtaacagagtcagccacggggaaatgtgggactcaagcattccctgcaaaggaaaaatgctcagatgcaaaggcaggagtctgcccagaatgtgaggaatggccagaaggctaatatggctgaatcgtagtgtcattctttcagtttcctgtgtctcttgtatgtatttgcatatctttagtagttcttcatgggggattccaagacagtcctcaattcctctgttcaaatccccagagaattctgacatgtaggaacttcgtaagaaggtgcacaccagtgcctgccaatgaaggttataggtgacaggagagagggggcagagcactgcagacgcccatctcatcaccctgacacagtcaagcttcataagcagccctgaagagttgataattttgttatttttatttttttaccgatattgaggcagttttacaaatgagtattatggtgttttataataagagaagttaggagcaattttaatattaaagatagtattaaaaggggggatttaaggatacaggctaataggacacagcacttccaataacaatgcatactttttgttagaaaatggtgcacaattccaaactttattatagaatctccatatattctttgagtataaaaatccttcctgttttttgagacatgatcctgcttccacttgttcatgacaactgcatagacccctaatggctgtagacctgactttataccacactaaccaagtttgttgaaaagtcactttgccttggcaatacaaaaataatggactccacttaggatcctgatgctaggcaaactctcttgctgttcttttaattctcaggaactgaaatcagtcacactgaacctcccagtgttccatatctatggtcctacatataacaatgattacttgtatatggtacatttcattggttgttcttaatgttttttattatgtgtcataagacactaataccatttaagaaaatgaagggaagctgtaaagaacataaatgagtgacttaggttcacataacaaagaatgctagagattaaataagaactcagaattttggagtttgctttctgtttcttgattgagatactcctagcaaatacattaagtatgtgcatgttattatattataaaagtagatgttactagaaattggctaaaagactaacaatgacaattaaacatactgcatagacgatgagacattgactcatttttgaaggggaaaaggaaagggttctgccagggacagaagtccatcacctttccttggtcattgaatgttatttccatgtagatgtctctctccagttgtcaaaaatcactattctttttgcgtgtttttttttttttttttttttttttaccctccgtgatcactgtatctgtcttgatgaatttttttcaaactgaatggctttaagttatgactttatcagagatctatctcttgttgcttttacctaatttgatatgcaggtttcactgcaacatctagattactggtctttccgacaataacagtttctaaaaatatctgattttatatttttcttttttattctctgaatgtttgccactgtcatcagaaagagctccctgttgttactctcctttgttccctttctggattacattaggtttactgaacttgttcaaacatctctgaagattttaattttttcaactttactcacacttgacaggaaatcatagtgtgtctggtgatacagatacgctatttacttacgctcacagccatgaagatttttccagacactcatacgttgagagagtattttcttctccaataaattaataagcatatagatatattttttttaatagataactctatgtctagggaaacctgagagatcacaccaggtggcttcagtgaatatgaatattcactagccagccataaagcattaggaagtatgtgtttgtatacagcctgccactaccgattatatttaatattcaaatgtgtaccttttaaaaatcaaagttcaaacttacagggtacttagagatttaaaagggaacaagtcatcagttcctatctcaaaactggcccatttacccttctttcctctttctcatttctgatcctggaaacaaaattattttctcatacaacatcgagagcattgcagacaatgtattatagtgagaaagtatgtgcggtagaggcagattctgagtttaaatcctgattctgctagtagttgttgactttggacaaattattaaccactaaggtttccgtcattcatctgtaaaatgaggataataacacttttcctgtaggagtattttttaaaacaacatgtaaaaagtatgtattgtagtgccagcgcataaaagtaatttgttaaaatcgtttcctccttttgtctgccctttcttttccaatcctactgctataacatgaattcggggatttatcgtcttgtatctactagacaccatggcagccttcataccaattgctaacttcccttctccattccattccaagcacttctattcaatatgtttcctttaatccagattttcatcagttttgaagcacatcataatcctttaaaaattcctcaggccaggcacaatggcagatttctataatcccagcactttgggaggccaaggtaggggatcacttgagcccaggagtttaagaacagcctgggcaacacagcaagaccctgcctctacaaaaacatttagaagaatttttttttaatagccgggtgtggtggctgtatgcctgtagttccagctactcaggaggctgaggaagaaggattgcttgagcccagaagttggaggctgtagtgagctatgatcatgacactgcattccggcctggatgacagagtgagaccatgtctttaaaaaaagaaaagtttctcaccatccatagataattaaacatttccaggccgactgaattcctccacggagaagacaggagagggattcagaaccaacctgagcccagggctgctccactccctgctctctaccttcttccccttgggtttgagcccagattttaggtgagatgagctttcagctggtggaacatctctcttccgttttgctgtgataacaactctagttcttatgtggagggagggattaaagtgcattggagtgcactatccctccacagaagtgcttcaccctgcagcgcaaatgtgcttcctcctgggttgggcatctagcccaggtatttctgagtctgacgatcatggagtgaaggccgaagaatgtggataaagaaagggaaggagaatcaaataatgccccccaagttactaagtgtcttgctgaacttttgctttttctatgtgggtgaaggtaaaaagagataactcgagacagtgcaggaaaaatatcatttaaaacctaaccttgaggctgggcgtactggctcacgcctgtaatcctagcactttggaaggctgagattggtggatcacctgaggtcaggagttcaagaccagcctggccaatgtggcaaaaccccatctctactaaaaataccaaaattagctgggcatggtggtgggcgcctgtaactccagccactcgggaggctgaggcaggagaatcacctgaatccggtggggcggaggttgcagtgagccgagattacgccatttcactccagcctgggcgaaagagcgaaactctgtctcaaaaaaaaaaaaacctaaccttgagatcactatatccagactaaacaatgaagagaatgtacagtgtgaaatttctaggagaaaatgttgatctatgtcatagatcattttaaatgccacaggtgaggccgtaagggcccaggaatgggagaaccagttgtgaatcattccctaaaatcaagaggtgatacaatgtgcaatgtgttaccaactcatagccagttccaagagatctgggtctatatccggtttggggattttgtctccactactccagccttagtgcaggctggctgtgagttgcagccctggtggacattagatgtcttggccagcaggtcaccggacctttcagagaaaacatgccaccttcttgtagttcaactgcactgtgagaggggcagatggataatccctcatttaaaggtaagaggtaaagcagaggtaataagaatggcgggtttcttccactctgcaaaaactgctgtatgggctgtgtgggcacacctttgagctcttagatggagacgagctcagggatagtgcctttggagaaaaggttggagagattgcactgtgagaggcttcaaatcaagttaccaagtaaataatgagtgcagcacaccaacatggcacatgtatacacatgtaacaaacctgcacgttgtgcacatgtaccctaaaacttaaagtatactaaaaaaaaaaaaaataaaaaataaaagaaaagaaaaaataaaaagaaaaaaataaaataaaaaaagaaaaaaaaagttaccaagtaaatattaacccttttgcaagaattcattaaaactaggagcaccagaagtcgcatataatgcctcttgcccacaattcttaatagttctctttctttctcagaagtgttctggattggacaatacatggcatgctcactctaattgtcataacagagtacgggtggatgatcatggtgggaaggagtaggaagaagtagggcctgggaaagtgtgagttttcccaaggaaaagctccactgtggttactcagaaattcagtggagaaggggagcgggagcgtggctgcacctctggcctactctggctttaggcatcagttttgtgactttggatatactaattagtctctttgaaggtcactttcccagcctgggcaacatggtgaaaccccatctccacaaaaaatacaaaaattagccaggcatggtggcatatacctttactcccagcttctcaggaggctgaggtgggaggatcaattgagcctgggaggttgaggctgcagtaagcagtgatcgcaccactgcactccagactgggtgacagagtcagaccctgtctcaaaaaataaaaataaaaaaaaactttcttcacctgcaaaatggagatcattataactcatgttgctgatggttgtgagaatgaatcataagaatgcaaagaatatgtatattgatgataagagatgtcacgagaaagagcagctgggattatgctggaccatgctacttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccaatgattctcctgcctcagcctcccgagtagctgggattacaggcatctgccaccacgcacagctaatttttgtatttttagtagagacggggtttcaccatgttggccaggctggtctcgatctcctgacctcgtgatcctcccaccttggccccccagggtgctgggattacaggcatgagccaccgcgcccagccgcctgtttctaatacataggaaggagatgaatatgtcacacttcctggaacccaagaaaataacccaaattatgcattctataaaagtaaacatagccttaagaaagactaggaggaaaagtcttaccaagcagaatgaagaaatagcatagtaattgatttatcaaaattgcccacatcaggcctcccaacttgacgtaaagaaatcaaaatgaaatcactcatttagcagtcaaagttgtagaacagactttgagatattgtcccagtgatgcccagaacctgaatagcagcagtccagggaagtttgatggggtcaggggtgggtcggggggcgctttgttgctgtagcagtcttccaagctgcttgcagatctgcagcatagcagcagcagaagcgatagcgcctgtatttaaatgtgaatgacattatacaaaatatacttgcatgcacgtttatagcagcagaattcgcaattgcaaaaatgtggaaccaacccaaatgcccatcaataaacgagtggatagagaaactgtgcgatatgtacgcaatggaatactactcagacataaaaaggaatgaattaatggcatttacagcaacctggatgggattggatactgttatcctaagggaagtaactcagggatgggaaaccaaacattatattcatatgttctcaaccgtaagtggcagctaagctatgaggatgcaaaggcataagaatggcataatggactttgaggactcagggggaaagggtgggaagggggtgagggataaaagactacaagttgggttcagtgtatactgctcaggtgatgcgtgcaccaaaatctcacacatcaccactaaagaaacttactcatgtaaccgaacaccacctgttccctaaaacctatggaaataaaaaataaaaaataaaactaaaatgcaaatgacaggtgtgcagtagacttttctagacttgcaggcatattgcagctttgtgtaatctgtgctgaacagagatcgcatctctcttcataaagctcttttatagtttcacacctgtaatcagctgtcctttaaactctgaagcttcacgggggtctccttagactcgttagtctcatggtggcactcacagtggaggatgtccttgttggctactggtgtcacctttggagttgaaggaatagacagtttattcttgtttttgcttttctctcatggctgtgcgggagtgctggcaaaaagataaggatgtgagaaatgtttaagaaagggagaaggccaggcatggtgactcatccctgtaatcccagcacttcgggaggccaaggtgcgaggatcacttgagctgaggagttcaagaacagcctggccagcatagtaagacgtcatctctgcaaataataattaaaagttagtcaagtatggtggtgcacgcctttgttcccagccgctcagggggctgagataaaaggctcgcttgagcccaggttgggaaggctgcagtgagccatgatcacgccactgcaatccagcctgcgtgatagagcaaggccccatctcaaaccaaaagaaaattaaaaaaaagggagaaaaaagaaacacaatccagggccacgtgtctcagatgtcacttacttctcttcataagagccagtactgaattcttagaagctgtgcaacccgtatgaaggcaacccatatgaaggttttcattttctgctactttttcagttatcctggaaaaaatactgagaggcaacacctgttaaggcaggctgtccttgggggtgcgtgtccagcgctgcccttgactagttgtggcactagttacttatcttcatgaagtctgttttccagtccgttcagtgggggagcgttaaacctgtcctacccacctcagacaatgaattgcaaagaaaatgatgtctgtgtaagagttttgacattatgcaacattatatgagattaaaatttattcaagatctagaaaaaccgccagtgtttttattttttattagtattgcttgttgagacagagtcttgctctgtcatccaggctggagtgcagtagcacagtcacagctcgctgcagcctcaaacttccaggctccatcgatcctcctacctcaccctcctgagtagctagaactacaagcttgcacccccacatccttctaatgttttaatcttttgtagagatagggttgcattatgttgcccaggctggtctcaaactcttgggttcaagcgagcctcctgactcagcctcccaaagtgctaggattataggtgtgagccacttcacccggcctaatcagtgttttcatacgtagaattgcaagtcatggtggcagtggacaagtttatttctcaatacacaatgggcaagtatattatctcaaatgaggaaatgaactatgtttataccacctaagagttgtggagcttaaaaaaagtattcagcacatttaagaaaggtattaaatacattttgtttcaaatattgcattgaaaacattgtttgtttccccaaatttccaggtgaaggataagcctgtgctctttttcactccattttttttttcccaatgtaacctaaacctgttaatatctatattcagcaaagctgccctggttgcctggcaaccaggcttcgtgggctagggaaacaccaaggcaaggaaccaaaggcagcgaacacaaccttgactttgcctgccgctgcacaggcgatcatcctctctgtattctgtataaagctctatttccaaaacataagtaaatcttgcaagaatgtagctcgatgctattaggagtttaaaacttacggtttgtgggataacatttcaacataattaaataagcatgaagaaatctctctctctgctcttccttaattaaaacaggggcggtccctttcctcacaggtcatgctgtacatttcaatcccactttttatttcctctgcagaaagatgtgtgcattattcttggaataagatgtaatggaaattgaaatgtcaactttgagaaatagaagtttaggactcattactgccaaacatatatttttgtgtcttatacaaggaagtaaaaagaagaatgaatgaaaatgatttttcttattccaattcttccatgtttccacctttatctcattccctttcttatattctcccctgtgggaacttcatcactttaaaaattaagaacaaggaaagcctttgggttacaggaaataaatgtcgtctacttcatggacagtaaatgctatgaggctgagacagaatttggaatttaaagcttacattatctattgttttattatgtcacttgtttcataaggcagcttttattggttaagttcaatattcagaggaaaagtaaactgaaggaccctgaagcagatcctttttgaaataagattggagaataatataaggtaaaacatgtaactggggctgttgaagtggagatttggctaagtatgacaaaaatgagaacagaatacagagaaaattaactcaataatatctcagcacaaatcctcgaaatctgcaatgaacgtatcttttgattcctaagtcatgaaagaagacagtctttcattattactttgccatgtaatagccatttatatcaatttcacattctactttcttctatccttattccatagctggtgtgagttagttttcaagacaaactggaagtcccaattttaagtaacacctcctaatttgtaagtgttggcttcagtaaaaattaacaacctcactctgtaggtcaaacagaacccatctggaagccaggttatgctcatggttgacatttgtgaccccaggtatagggggagaagaagggtaactgaggaattctcacgtgttaagaggctgcatataaaaatgataagtgttgggaggccgaggtgggaggatcgcttgagcccaggagttggaggctgcagtgagctatgattgtgccactgtactccagcctggacagcagaccgagaccccatctctaaaaaaaggaaaagtaaagtgataagttgtcaaggaggtcagacaagaaacagggtcctgcttcacactttgataagtaagggtgcagaacatttcaggaggaagagaagagacagccagggggccaaaacagaattcagcaagcaggcatttaattgtgatcttgggagaggagtttcaagaggatggtggaagtcaggcacagatgcagtgagttataaggagcgtgtgggtgatgaaagtagaaacaagcaaatatagcctccttctagaaggaggaagtatggccacaatcacttgaggagaagtgagttgagggaacgtgtaggtatatttgtagacacagaacaaatttctggagaaagtagaagataggacaaatacagaggtctagggtttgaaagaattaagaattagagggtagcggaacacatagataaatatgtaaagggtttcctgtggttaatgacaaaagattttgagtagattccataatggttcccatcagccttgttgcagtagaaatgaggtccttggaaaatgaagaaggcaatgtgagagaggcagaagaaggagaaagaagagtctattgtaaaataatcataagcattacggtggggtcagggtgaaactggataaagtgttatgtatggacattctccagcaatttgcagtaaccccagagaaaatgtctaacatgcttttcagggttagtagctaggagccaaagatagttaaggagtgagggcttctttgttgccaaagactgagctgttgaagttctagtccttgggaagtcagccagggagaaaagcaggtgattccgggaggttaatggactgaagacactgcagagggttagagatcatgggaaaagctaagtgtaggtttattttaaaagaagcagcagatagggtgaaaatataaaaggttgtgatctgagaaaagtgtctagatttgaggtccttgggttaaaataatatgggttaaaggcaagaggcggtaaggatgatgtctgtcagttcctggttaggaagtgaaagttcctctagaagaggaaagacaaggtccaagggtaaaggcaggattttgtatttcacatcctgattatggcagagaaaatggtggagaaaaaaaaaataagctaggtgaaatcgtgtttaaaaaaccagaggaatacctcaaaagttggtaaataaatgccattcttttagggccggtcacgtggctcccgcttgtaattccagcactttgggaggccatggcgggcagatcacgaggcctgaagtttgagaccagcctagtcaacttagtgaaaccctgtctctactaaaaataccaacattagccaggcgtggtggcacacgcctgtagtcccagctactcgggaggctgaggcaggagaatcacttgaacctgaaaggtggaggttgtggcgagccgagattgcaccactgcactccaacctgggcaacagagcaggactctgtctcacataaataaatataaatgcgatgctttttccttcatggcatttattatatgtaacaattgtttgttttttaatccccacttccctactaaattgaaggcagactatattttatctattttgttcataccaagttcccagcacagtgatggcttataaaggagacatgtccaataaatatttgttgcatgaattaaaagacagaaccaaggatgggaaagtgaacatataatttgatgccacagacttaaaaagatgtgaggtcactgaataaaataaataggaaatgttctggcaatggaacaaaggagcttatctcttaataaaaatagaaaaccataaaaatgttcaaatccatgataatgaaagaaatataattaattcaaacatttgcttaccctgcagaaggcaagaaagaagaaggtgctttcatttttctgcgagtagcatgtgtgtattacactgcttcagtcagagaaattaaaaggtaggataacttaagtctaaaataatatatgccaactttttttttttaaattttttttttttgaggtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaagtaaaaaaaaaaagaaaattataaagaaaagaaacccacccactgggttcgagcaattctcctgcctcagcctccctagtagctgggattacaggcatgcgccaccatgcctggctaattttttttgtatttttagtatagatggggtttcaccacattggccagggtggtctcgaactcctgacctcaagtcatccacccaccttgtcctcccaaagtgctggtattacagacctgagccactgtgcccggactgttttctttcattttctgttttggtttacaaacctccactttagtcttcaaatacattcattttattaattatgctgaccattgaatttttttatgctggcaagtatattttaatttccaaggacatttcattgcctcatcagtactttttcatagctttttgttcttgttttataaatgcaataatctcttgactctctctgaagataccaatttggattttctgcttgtttaagtttgcttaagttccttgtatttttgtttccctgaaattggtttatctgcttattttggaccttttaggctcttctttctttttattttccaaatatctgcttttacttatttgtccatccatatttgtgaatgattgactactttggttcattataggcaggtggcatgggttcctctggaatcttttagtcttgttttcttagtagtcttctcatctctaaatgagagggcagctgcggctccatgtagataggtaggagtatagacaaaccttgagcaatgtggcggttaggggcgttgacccattgcacagttggaaatccatatacaacttttgactccccaaagccttactactaatagcctactgttgaccagaagctttaccaagaacatcaacagtcagttaacacatgtgttgtgttgtatgtactatgtactgtattcttacaaaaaagtaaactagagaaaagatgttaaaaaaattataagtaaaaaaatatatacttactattcatgaagaagaagtagatcatcataaagttcttcatcctcatcgtcttcccactgagtgggctaaggaagaggaggggttggtcttgctgtcttgggtggcagaagatgaaggaaatcttcatacataagtggacccacatggttcaaatctgtgttgttcaagggtcaacggtagatggcacttagacttccctataaggtgtgtagtcagggaaccgcctggtagggacccctacagtcacctgacttaggaagtgtgttactcttggggatggagcacttcatttcttttactcctgggcagagctgacttttcttctccaatgatagtccccttctgtacttctgggtatgtcagtatttactttaaactactctattcctctttcaatcccacaccttttgaaatgcatttatatatttgatgcttcttatcttttttaagcctgtaagttgtctgactaacagaaatttcccaagtaggtaaatcttaggaaacaaattaaaatgataaatatggtgaaatttaagaccttctaaatgattaataaagtatataaaattcataagtttgcaacttaaaatctcaaatctaaaccaactactcagtcacacattttaaattggaattaaatgactgatctgtttctattgagccgaactctcttaaacactaaaaatatgtaaaatgtgaaatatgcacaagctcctttacataaaaaaatattatttatatttgtttagtcattgaaatagctctgcttttaattataaatttttctggacttgcccacaaaggaataatttatatcatcctagctcagccagttaagattatataacagccagaaatattggcccagatgctgaataaatccttgtcgatgactataaggagatacacagagctctgttaaggtcactgtatcagtgtcctttaagtgtgtgtgtttgaaggtgtggggtggcaggatgcagggaggaagagctgtgatagcccaggtcattcagatccctaatctgctcttttctgtcttcatacactgaattagatttggcctttctttagcttttaagatttatgtgtgccttttccatctaactctaaatacctttgataagtcctgtctcctttgcctgtattttttaacacttaggactacagaactcttgggggcgggggcattcaaatggcatccagagttttagtgcgttctcctgacattgacttttttagccacatttcaaggtcatgctactgacgattacggaccaagagaagagcaagtgactgctgacctctagaggatactcaatgcaataaatgattgtttttctgtgctaataatagcactgacatcatatggttgtaataaatttgaacaggatgattgaagcaaatgtacagcgcctagcatgcactaagaatttggtgactgtgatcattttttatagttgcatttagataaagaactgtccctaaaaattattcatcgttagatgagaaagaaacctttaagcagatatttagataaggggtgttttcttttatatctccagtatattcccactagcactgagcaatattttatgaatctagtatcgcaaaaacagtttagatttatagcaggttctcagcctcagcaccgtggccatttggggctggatatctcgttgccgtggagccgtcgcgtgcatggtaggatggttagcagcgtccctggcccctacgtactagacgccagaaacactcctctccaactgtgacaaccaaaaatgtctccagaacctgccagatgtctcctgggaaaggcaaaattaccaccaaaaaataaccatgcccaccccagagtatttttttaaatctgtaaaaataaatgcttctctgaactcagttcctatctttggagctttctatcttttgacctaaaagtggcatggaatatctcaacacttccttttcctccccagctcggggtctaaagaggagaatgtaattaagattaaatccaaagctttatttaaataaataatcaatctattaaggggaaaatatgctccactaaagccataaagccatcggctatcactccttcttgtgagcctgacttgctttttcggtttgtcgctggttaagagaattgcagatgtattccattgaggaaagcggtatgttcccacactagcgaaaaacattgtattcttctagttaatcattttcaaagagctgtttctatttctggttactacaaaaataatggcctgcaggtcatctatttatgatcaagtaaattccgcttcattgaaatgttgtagactttagaagaaagaaagaaaacacactaaaggcttctggacagtcaaatattttaacttggagtgtgaaacactaaattaatcacacagtaacttcaggctgttattagccttttatggtcaatgaatattgattgttgagtgaatcaatgattggacacacgttatacatggattttatcacttggaaactctataattatcatactaaattcccgatattgtggttaatagctttctagaaaaaagagttgttataaaaccataatgtattactgttaaaagttgggattcggggaaaagtaagagctgtataattaatccacctatcaaaaaatgatcctaattaatatttttattgttagtgaatttgaatgttagttgaattgttcattttggataaggagattacaaagatgtttgactctgttcacaacatggggaaaatgattgggctatctgagactgagttatcaatagagtatactttttgtttgttacatcagtaaatatcagggttttttttttctgtttttcctccttcttcaagtctgaaaaattatttgcctagaaggggaaacatattcagacaattgaaattccacagttcatcttcccacatttgtgagaaaaaaaaaacgtgagccaccataaagtaactaaaacagctaaatcagtctattactgttgccctcagttaccattcaaaaactgtctgccatacagcaaaacattttttcatacacatgaaccctacagtacccactgtaacaaatacagcaaaaatattacagaataaaaacgtctccaaggtccaataaaagatgtttgtttgatacagtagcaataccagtgcacctgaagagtattacttcatcctgaaaacctcttaaaatctgcaccaaaagattaaaaaacacttacactaaaaacttactaactcagaaaaactcatgggaaggacaattggaattctagtggtgtttcatttctttttttaaaaaatacttgcccttagaaattcacatactaactctaacctagtaagttagatagacatgtacaaagtactttctaattcagagataaaaacagtgggaccaggcgccatggctcatgcctgtaatctcagcactttgggaggccaacgccggccgatgacctgaggtcaggagttcgagaccagcctggccaacacagtgaaaccccatctctactttaaaaatacaaaaattagcagggtgtggtggcacacatctgtaatcccagctacttgggaggctgaaacaggagaattgctcaaacttgggaggtggaggttgcagtgagccaagatcacaccactgcactccagcctgggcaacagagcgagactctgtcaaaaacaaaacaaaacaaaacaaaacaaaaacaaaaacagtgggccagtcactgtagctcacgcctgtaatcccagtgctttgggaggacaaggcaggaggattgcttgagcccaggagtttgagatcagcctgagcagcaaaaagagaccttgtctctatttaaaaaaaaaaaaaaaaaaaaaaaaaaaaaacattttttttttttttaattagccagatgcagtggtgcctgcctgtggtcccagttgctctggagcctgaggtgggagggtaacttgagcacagaggttcaaggctgcagtcagctatgatggtgccactgcactccaacctgtgtgctagagtaggatcctgtcccaaagaaacaaaacaaaatgaaactaaaaagagtggtgtgttggtaaatgtttaatattccactatccaaaaaataaagaagaaaataagttctgatgtgtagcgctttccaatttccatggtataaatactcccaccatggacaacttcaagctacaacatcgcctcactgaatgcagagctgaaagtcatgctgctgacaccattctgcagtttccatcatagacgtaatgaacttcggagtacagacagtagcaaaatcattaggaagttatgagttttgagtattgtctttgtttttagcataatttatttagtcacaggttttagtaacttctagtaatggctgtatttgacaactgactctccaaattcccaaaattttaacagtcaggcaggccagctccaggagcacacctctgagatacattatatatgtgtgtgtgtaatttacatttacatttacatttacatatatatgtaaattctctaaaggttaataggtacttgaaacatctatttcccaggtgttttaaagtaattttttgcagtattagcatctacttattcaattccctagttctagtatctaaaacaggagctggtataaattaagttctcaataatgttgggtagctgcctagtcctaacaatgtgaaataggcctgataaatcaaaggaaagttcagttagcctgtattatctcaaattatctctgaattaaaaatctgtattgataactagaaaaggtctttctttttttcttcccccctctctttttttttttttaagacagagtctcgcactgtcacccaggctagactgcagtggtgtggccatagctcattacagcctccaacttccaggctcaggcaatcttcccacctcagcttcctgagtagctaggactacagatacatggcactatgcctggttaaattttgtattcgttgtagtgccaatttcaccatgttgcctcagctggtcttggacccctgggctaaagcaatccacccacctcagcttcccagggtgctggaattacaggcatgagccaccagacctggtccctaggaaagatcttaacctactcaataagcctataagaataaataagtggcttcctccaggttctctgtcctttttgtattaggatcctgcaaatcttagcactgtcttagccccagcagaccttgccaacttacttcatccttgggtattctttttataattaccctcaaggaagccatgcttcttaggagagtggagaagagaaaaggtaagctcctattacaagaagaaactttgctttttacctctaccaccttcacaatccagcaagaattgaaaggaaacacattcttacctcccatgcactcataaacttacagctgtctccccattccccacaccaccccctgccccccacacagaaaacctactttacaaaaactgtcctctcaaaggtctccagaaaccttctccttgcttaatctaatgacttccttttggccttcatcctaccaaacttttccctagctttttttttttaaatcttttttaaaagtttagatttgggggttacagatgcagatttgttacatgggtatactgtatgacgctgaggtttgggcttctaaagatcccattgcccaagtagtgaacaaagaacccaatagatggtttttcaccctttcctacctctccccttttgggactccagtgttcattgttctcttctttgtgtccaggtgtacccaatgtttagctcccactcgtgagaacatgtagaatttgattttctgttactgtattaatttgcctaggttcttggcctctagctgcatccatgtggctgcaaaggacatgattttattcttttttatggctgcatagtatcctgtgggtgtatatgtatcacattttctttatccagtgcaccagcaacaggtgcctgggttgattcctcatcttggctattgtgaacagtgctgcgatgaacatatgagtgcaggtgtcttttggtagaatgatatgaccctaaggaacatccattctttcttgaaaatttctgacatttatttattcatttattccatacatatttattgagtgctcctctgttccagccattgctctggacattgggaaatcagctatgaataaagaacatgaggtctttatgctctaaaagaatctattttaacctaggaatacagcttacaagggacctgaagtacctcttcaaggagaactacgaaccactgctcaagaaaataataggacacaaacaaatgggaaaacattctatgctcatggataggaagattcaatatcgtgaaaatggccaaactgcccaaagtaatttatagattcaatactgttcccatcaaactaccattgactttcttcacagaattagaaaaagctattttaaatttcatatggaaccaaaaaagagcctgtatagtcaaaacagtcctaggcaaaaataacaaagctggaggcataatgttacctgacttcaagctacactacaaggctgcagtaaccaaaacagcatggtactggtaccaaaacagacatatagaccaatggaatagaatagagacctcagaaataacgctgcatgtctacaaccatctgatcttcaacaaacgtgacaaaaacaagcaatggggaaaggattccctatttaataattggtgctgggaaaactagctaaccatatgcagaaaactgaaacaggatcccttccttacaccttatacaaaaattaactcaaggtggattaaagacttaaatgtaaaacctaaaatcataaaaatcctacaagaaaacctatgtatgggcaaagactttatgatgaaaacaccaaaagcaattagaacaaaagccaaaactgacaaatgggatctaattaaactaaagagcttctgtacagcaaaataaactatcatcatggtgaacaggtaacctacagaataggagaaaatgtttgcaatctacctatctgacaaaggtctaatatccagaatctacaaggaacttgaacaaatttacaagaaaaaaacaaccccatcaaaaagtgggccaaggatataaacagacagttctcaaaagaagacatttatgaggccaacaaacatatttaaaaagctcatcatcacagattatcaaacaaatgcaaatcaaaacaatgagataccatctcacatcagtcagaatggtgattattaaaaagtcaggaaacaatagatgctggtgaggctgtggagaaataggaatgcttttacactgttggcgggaatgtaaattagttcaaccattgtggaagacgatgtgggaatttctcaaggatctacaaccagaaataccatttgacccagcaatcccattactgggtatgtacccaaaggaatataaatcattctactgtaaagacacatgcacacgtacatttattgtggcactgttcacaatagcaaagacttggagccaacccaaatacctattaatgacagactggataaagaaaatgtggtatatatacactgtggaatactatgcagccataaaaaggaatgagatcatgtccttttcagggacatggatggagccggaagccatcatcctcagcaaactaacacaggaacagaaaaccagacactgcatgttctcactcataagtgggagttgaaaaatgagaacacatggacacagggaggggaccaacccacaccagggcctctcagggggtggggggcaaggggaaggatggcattaggacaaatgcctaatgcatgtggggcttaaaacctaggtgatgggttgataggtgcaacaagtcaccatggcacatgcatacctatgtaacaaacgtgtacattctgcacatgtatcctggagcttaatattttaaaaaataatataaataattaaaaaataaaaaggcacaacaaagggaaggaatttaatttttgaaaaagaatattttgtaactgagaaagatagtaaataaacaaaccaaataaactgacaaattaaggggaagtgtgagcgttttgcagtagagtgaaggactctctaatgaggtgacctttgagctgagacctgtatgacaaggaaatgccacagggtgagctaaggtggagagagttctggacagaggcaagtgcaaaggccctgaggaagagtgagtctggtgggacccaagaacagagaggccagggcagctggagtggaggccagtggtgaggatagcagcacgtgagtccagacagaccgggagggacagattcactgtcttcctcctatagctttgctctttggctccttctgaaggcatcattccaccgagtatcaccttcccctccaatcactccccgatccactttcatgccgaccccgccaccccaaggacctgtcagctcctccataaactgatatctcaccagttcgaattaatttccccctctttgattcacacgtcaaactctgttgacccttttatacccaatcctcatgtactctccaatttttctaccagattggaagctgtttgagcacagggagcttttgtcttactcatcttcagtgagggcaaagtcttcgtagttgcattgttatgtttgtttcatttgctttgctttgctttggttttgtggtctatgacatagttaagtacgaaacaaattttttttcgtttggtgaaatgagtgaacatatatttaatgaatgttgttctggcaaaaattttgaaaaactagtgcttaaaacatagcttagaattaagtctttgcatgaaaaaagacacgattattagaggcagtagaatgtgatgtttgagagcacaaagtctgaatttagactgcggggacataatcccagccctgccacttactaactgtgatcttgggccagttacttaacttcccatgccattgtcatctcatctgtagaatggggatagttgtatgtaacccacagggttgttttttaggttgaatgaataaatgcatggaaagaactagaaaagaacatagttagaactgcgtaactattggctattatttacttattgatgggctgaaaaagaatatacttgattttcacttcctgtccagcaacatttgtctgatttttttgcacattttggatgctctcaatagtcatttcattacaagtagaataaccatatccaagaaaccaaggatttgaaaaagaaataattgtcttacttaactaacttgatttgcaggtagaactactgatgataacatgcaaggggacagaaagctcatatttttccttctaaggcaactattagtaaatcctttatttcacacaccacaaactgaagtatttctgaagtgcagtccaggaagaaaatgtgtctcttagaaacagagaattgagaaagcagaaatagaccttctaggtgaagctgaggacttctggtgcatccctgcaggccatgagacattttctcagataagtgggaagttgatattgagcctctgattactctgaacaccttccctccacctccaactgatggcatttattgattagatcaacttggggtataagtgcagtgatgtaactagactttgagagattgtcttaggttatgttttgactatgcatgtatttgagaataccacagtacttagaaaatttaatttatttcaccagctaccagaagtatgacaaattagtgattgacaaggcaattgctagtgggaaaaaaaaatgaataagacctactgtttgacagcacaatagggtgactatagtcaataataacttagttgtacatttttaaatcacttgaagagtataaatggactgtttgtaactcacaggacaaatgcttgggggcatggacaccccatgctccgtgatgtgcttatttcatattgcatgcctgtatcaaaacatctcatgtaccccacaaataaatacacatactgtgtactcacaaactttttttttaaaggagagaaggcagttggtgtttggtattttaatcacctcactagtgtggatatgtgacaatcataggagccattacctcatattaggtcctggcctgttgatgcatcttttgccctctgcccctctttttgaattgtttttgggattcatgggttgttggtagggagaaacctttctaagccaggggtggtggctcacacctataatcccagcattttgtgaggccaaggtgggaggatcacaagaggccaagagttcaagaccagcctgaacaacatagcaagactctgtctctacaaaaaattattaaaaaattagccaggcatggtggcgcatgcctgtggtcctagctactaaagtggctgaggcaggaggatctcttgagcccaggagttggaggctgtggtgagctatgatcgtaccactccactccagcctgggcaagagagcaagaccctgtccccacaaaagagagaaacctttctaggatgttaaaatccctcaaacagaaatcttagaaatcagagagtattaactctgatttccaaattaacatcttggaaatcagagaatacagctaatgacaagaataattaaaatgagctgaataacactcaaaaaagaatgcaaatcaactttcatggatgaaatcgcatgatttgtaaaaagcaggcagtgagcagatattttgtggttaatgtttgttgattaaggttctttgctgttcaccaacacaatcagtaatttgtttttgttgtttttatatgtaacaagtttgttgtcctacaaaacatcccacatttccataattttacaaaattaccctgaatgagatggaataagccgattagaaacaaagatctgagagcaatgtgatatctctaattatatgattttatttccttttaggaaaatggagtagcttttaatgttctattaatctctgatttcaaagtgaatatgaaagaaataatgactatatttgtgaaactaaggtagatgattgtcaaaacatgacattaaaggaataaattcttaaagtatcttatttttgcgttagagaccacagctggctaagtcatttacattaatagacttgtagtgcttttacatgtgcagtagtgatagtgtattaaatttaaaggtcttacttcctgcctaaaaacatcaagaaatatttttaatttttttttttttggaaatgagatgcctatagaaaattgcaagaaaaatgatagccactaccttaacttttatggtgatattcttttttttttttttttttttttgagacagggtcttgctctgtcacccagactggagtacagtggcatgatcatggcccattgctggcttctcctcctgggttcaagcagtctccagcctcagtttcctgagtagctgggactacaggcacatgccaccacacccagctaatttttttttttgtagtgatggggtatcactgtgttgcccaggctggtcttgaactcctgggctcatgcaatcctctcgcctcagcctcccaaggtgctgtgattacaggcgtgagccactgctcctggcctctccttgtttttctttattatttttccatatctttacacatccctaagcaaagtggagtgattttgcctatttttgtattttgtatgtaaatgcaatcatattctaagtatatattttttgagggcttggtttttttttactgaatattacatttctgcatttggtctgtgatatttgtataatattccattttagaacctatatcacaatttatccactaaatgttggtgaacatttagtctgttttttaattttggaacactcatcgaatcatagtatagtaatgttcataagtatgaatctgaataatcaaaaaaagattcacttggattccatatttccagtgtaagattgtatggaattagagattattctccccagaatggatctcaatgtgatatttttgagcagttaagagtgagtctcaatactggaaaattcacttacttggaatgtcctaatgaaaagagataatcacattcaataactacactgaacagaaagcaaaaagttggaaagctttatgttgttaatagattttcctattttctccatccagaaaataagtagtgagcttctttcaggcatgttttaaactgttacaatatgattacacttctttgaacacattgaaatgagacaacataaattcagtcatctccatcttaaagtcatttgtagaaaatggcatgttatattccatgaatagcctgctgatgtacaacagataaaacattacacaaaatgataggggaaaataccattttaaacatctaactgatcatacgaatgagtgtaatggctaggaaggcaaatgaatctttgatgatacacttgcaaggaatttaaaaaatcattcattcactcatctgtcaactattaattaggtaccatctatgtgtttctgttcatgaggagcttcggcattacagggaggagaattatatattagataagtatttgcatacatggggtggctggtgctattataaacaatatgcaatggataatgaagagaagctttctctctagtaaggtcagggaaggcatctgaaaggaaggaaagtttccattgaatttaaaatatggattggagtttgccaggaagacaaagagggaggccatttcagaatgcagaagttttggtagccttgccagtcgcaaatacttacagaatgaatggatgatattggtaaaggaatgtgcaaagagacataaataagccaattgggaagtccataatatggaatgcaaagtaacagaaataatatgttttaaacagttaatgtttattcaaaacttacctgtggggttgggtgcagtggctcacgcctgtaatcccaacactttgggaggccgaagtgggtggatctcttcttaaagtccagagtttgagaccagcctggccaacatggcgaaacctcgtctctactgaaaatacaaaaattaactgggtgtggtggcatgcgtctgtattcccatctactcaggaggctgaggcaggagaattgcttgaacccaggaggcagaggttgcagtgagctaagagtgtgccattgcaccccagcctggacatcagagcaacagagcgtgactccatgtcaaaacaacaacaacaaaaaccttacatgtgccagacactatacttagcactttacatatgttacttattcctcactcttacgccatgaaagatgtgctattagtattagcttcatgagcatgtcgcctgtgctgagaagggctccacacttggattactgctctgctattattctgctgtgatccttcataatttggaacaagggacaccacattttcagtgtgaactgggtcccccagtcatgtagccagagctagtccagagcatccccgttttttagttgcagaaactgacctacaaagcaaagtcatttgcctcaaacctagttggtttttgtctttttagggacaggatcccactttgtctcccaggctagagtacagtggctcagtcatagctcactataaccttgtcctcctgggctcaagggatccttgtgcctcagcctctcaggtagctgggactacaggcatgcaccaccatgcccagctaattttttttttaaattttttgtagagatagtgtcttgctacgttgccaaggctggtcttgaactcctggtctcaggcaatcctcctgccttggcctcccaaagttgctggtgttacaggcttgagccaccacacccagatgaaacctagtctgtctgtctttctttctctttctttcttccttcttttcttttccttttcttttctttctttcctttccttctttttctttctctctttctctgtcttttttctttctttcctttctctttctttccttcttttcctttctttccttctctctctctctttctttctctttccctccctccctcccttccttccttccttccttccttccttctctctctttccctttccccttcccctcccctttcttccctttcctttctttcatctggctctatcacacagcctggagtatagtggcataatctcagctcactgcagcctccacctcccagactcaagccaacctctcacctcagcctcctgagtagctgggaccagaggcgcacaccaccatgctcagctcatttttgtactttttgtagagatgtaattcctccatattgcccaggctggtcttgaactcctgggctcaaactcctgggctcccaaagctgctgagattataggcatgagccactgtgcctagctgaaacctattttttcttcatgttgattcctacggtgttagtcctatgctaacctgactctgttgtcttctattttcaagataaatcattaacagaagatatgagctactacagttattcagagttagtgtacagaaacagaaaaaaataaagcagttttaaaaaggaaaaaaatggactgaatgattaggaataaataaaacatgcaaatattaccttgagtcaaaattggaattccaaaatgaataattagtagatgtaaggcattcctccagtgtacttcatggcttgaattcaaaatcatgttccaaggtaaataaatctgctccatcttgtttatccaaagggcagtttggtgttgacttagttctgctcttttttggtaacttattcaagaaaagcaaagagcagaaaattcgtggtgttttaatccagggagaaggagcgggtggaagtaaacagagttcctccttcatcagacttcgtcagaactgctatgccctctgactgcattagattaaatactgcaaataaattggatcccatttggtacttaataagcacagctcacttggaagaagttttacttcaagatatcttcacttttctttggaatatgacagtttacccctctgaccacatgaacctcttcaaaattttatttatgctccttcatgttaattcagaaagtagaaagtaataatttttttgagacagggtctcactctgttgcccaagttggagtacagtggtgtgatcagggctcactgcagacttgaccttctgggctcaagcaatcctcccgcttcagccctccgagtagctgggactacaggcatgtgccaccatgcccagcaattttttgtatttttggtagagacgggtttttttgccatgttgcccttgctggtcttgaactcctggactcaagtgatccgcccacctcaacctcccaaagtgctgggattacaggcgtgagtcactgcacctagtgaaagtaatgatttttttttaagcattcccataggccacccttccttgaagactgataagtcaaatttccatgatattaaagaatggtatcctagaacattccagattggttttcattctgtttgacttaaagatttgaaatatgttctgatgttattccagagcacctgtggatttgagggtccaagaaaagtgaccacaaaagagcatacctattaattatataaagaacatgttttttgtaagtatatccattatattttcataataaaaataacatgattttatttctatttatttcttcagcctccaaaaatatcagatatacctaaatgctcttttgtagaaatatgcacatctggaaatcctaagttgcccggtcatttttgtttgtttgtttgtttttatttgttttgagacggagtctccctctgccacctaggctggagggcagtggagtgatctcggctcactgcaacctccacctgctggactcaagcgagtctcctgcctcagcctcctgagtaggtgggattacaggcgcatgctaccgtgcccagctaatttttgtatttttagtagagacggagtttctccacgaaaccaggctggtctcaaactcctgacctcaaacagtctgcccacctcggcctcccaaagtgctgggattacaggtgaggcatgagcctccacgcccagccccagtcatgttttcaatgaccacatttataccctgtattctgctgaagacagaaatttaaggcagtatccgactaacctcttcttacagatgagcagggtttggcacactagagcctctggagctaggactgagggttggggggtgtcctggcagggctagttcaagacttcagggcaaggggaagttttgtcaaatgcctgaggaaaggcagagtggaagttgaagacatatcagaagtgtcaaattcttgaagcagataggatatgagaagatgggctgccttaggggtaagtggtgagcttttgtagccagttctggaaagaggacctgaaaagatccaacctctatgcagtgctctaagaatcttagaagtcatcaaatgctgggtttcgtggtagaaattcaagagctgccagaattcaagggtcaagactgaacaatgatgaaccatgcagagaaaagaggagaatttacatggccctaaaacaataatttgctaccttggccacacattagaatcatctggggaactttaaaaaatccacatgctcaaccaagttgcatcccagaccaattaagttggaatctcatagggtgggattcaatagttggtataacttaaagctccctgtgattccactttgcagcaaggctgagaaagactggtttaaagcaagaaggaatgcttacctgggtacttttggcctggtttatccacttaggtatcatactcattatattcatagttagaataattcactgttctataagtataaccactattatacttaagtataaatatacttaaattgcacttacactgtttgtctacacaggcacttaaagggtcctgcttactagggttcaattcacatcatcaaagactgaaacttctataaagttttagtccccctaatttaacaaaccagtgtagaatagcaagacattcatcctaaagagacttgtacattgaagtcgatgtagatttgggactcaattcaatgaactgctctttcatcaggggttggttaagcaagcttcagggattctgagctatttgtgtgaaccaaacgtaaccctaggtcagagatttgtagaactgtatatgatttcactggatatgtagagaataaggaaacacaaaacctccacatctcccaaagactgtatttatgttgggggtatatccagtttttcatttgatactcagagaatagttttgactttgcagacctcctgattgctctcagggctctcagactacacttggagaacccctcacaagaggcatatgcatagtgaaaggagtgagggctgcaagttcatggatgcattattttctcgttttcgtttgtagggaaatacatgctctgtcattgacttgcaaggattttctttttattcttaattgcctccctaatcctttctccactcagctgtggtactcaatgcactcagattaaatgtgtgtgttcttctgggccaggaaggaatagatagcattgatgtggaccctcaactgtattacagaatagggtggtaaacactcaggagaaacattctccctggtaaagtgctaagcaattgttaaacagcattttaaagcatgaatgaacgtcttgcttgtacattccaaagttccacaaacaaaagaaaagttcttattctaaaggagcaggagatgaatcctgccgataatgttttttataatgtggctgtgaatattttttcccagagttggtaatcctaaatcacctcttacaagtaaaaaaagaaaaaaaaaaaaaaaaaagcaggataagaagaaagatataagcttaaataatgggccattgtagtcaaaatcagggagtagccaattatttttgcgatttgcactaagtgtgcgtttagaaagttggattaatctcactacttcactgcagaaattaatgagatgagatcacatggtagaaaccagtgctttgtacctcatgatctcatttttagcaatcttgtatgtcctcgttttatagtacttttatcccaaattcattgtttccaataaaatattttatgtttattttatgctattatatttatagatttatgttttcttgttgttgtttgtttggttttcttttttgagatggagtctcgctctgtgtcccaggctggagtgcagtggtgcgatctcggctaactgcaacctcctccacttcctggtttcaagcgattcttctgcctcagcctaccaaatagctgggattacaggcacgcaccaccctgcccggctaatttttatatttttagtagagactaggttttgccatgttggccaggctggtcttgaactcctgacctcaagtgatccacccttctcggcctcccaaagtgctgagattacagttgtcagccactgcacccagccagatttatgttttaaaaattcagatatttataaagataacacaaagaagtcctaaaaatcgcattcattatttaatactcaaaatatttgacagacttcatatacgtaattacacattagtcacatatcatgcatatgcttatgtaatctagtgtgaatacaattatcgggtctattccttccaaaactcatgacatcaacaagctttagtttaaataaaagttagatggccaggtgaagcagttcatgactgtaattccagcactttgggaggctaaggtgggaggaacactcgagcctaggagttcaagaccatcctgagcatagcaagactctgtctctacaaaacattgaaagattagccaggtgtagtggtgtgttcctgtgatcccagttacttgggaggctgaggtgggaggatcatttgagcccaagaggttgaagctacagtgagatgtgattgtgccacttccctgggtgacagagcaagaccctgtctccaaaataactaaaggttaaaattaaaactaaaacttttttttttttgagatggagtcttgctctgttgcccaggctggagtgcagtggcatgatctcgactcactgcaacctctgcctcctgggttcaagcaattctcctgcctcagcctcctaagtagctgagattacaggcccccgccaccacgcctggctgatttttgtatttttagtggtgatggggtttcatcatgttgcccaggctggtctcgaactcctggcctcataatctgcccacctcggcctcccaatgtgctgggattacaggtgtgagccaccgtgcccggcctttttatcttctgcaccatgcccggccttttttttttggaaaccgagtctcactctgttgccaggctggagtgcaatggcgcgatcttggcccactgcaacttccgcctcctgggttcaggtgattctcccgcctcagcctcctgagtagctgggactacaggcgtgcgccaccatgcccagctaatttttgtatttttagtagagacggggtttcaccatgtcggtcaggatggtcttgatctcttgaccttgtgatctgcccttctaagcctcccaaagtgctggaattacaggcatgagccaccgtgcctggccataaattttttttgattagatgatgctgggcacaatggcacacacccattgtcctagatacttgggaggctgaggcaggaggatcacttgagcctaggggtttgaggctgcagtgagctatgtttgcgtcattgcagtctagcctggagaacatagctagatggcatctcatttaaaaaaaaaaaaaaaggatgggggggtgaaaattgcacaatttcttctgacttttttttaacttaaattaactgagaagccctagagattataactgttacctctaactgcttgagattcttgcataaagtcttgttcctccaacatgttactagaataacagctccagaactgttggtttgaagactaagtcactagcctccctctaggtgatgagttgaacatcctctcataacagcagaagactcagagtctcaggcctatcaagcaacttagccagttagttaatggcaacagagccgggcctagctcagatctccaaatctaaatctggtgtactcttcactgtactgaatgaacttcaaggtttccctggattgtgggccaaatcatatcactctaaaagtaccaagtatgttcatggtggcagccatgcaggagttgattaggggcgcagggtgggggcagtgaggggaaagcactctaagcagatggaagagaaagtgcggaggccccaacacaggaatgctcttggctcagtccgaggacagcaggacaccaatgtggctgcagtgtggggatgaaggggcagagagaggggagaggacgtctgagatgtgagtggaagccatatctccccaggccctgcaggccacagttatctcagctgcagcaagacatgagtagaggactttaattttaagcagcagggtgatacaagctgtctgtgccttataaagacctctttggctgctctatggagattggacagcgtccaagagatgagctggggatattgctaaagggagtggtggtgagaggtggcaagggttggatttgcgaaatactttggagttagcatggacaggacttggtaagtgattagctgggaggataggggagcatgtgggtgctgtttgctgtagtatgaggaattagtagctctttcggggacacagaaagatcaagaagtctattggatatccatgcagagtcatcaaattggcgttaaatgcaacaatctggaactcaaagaccttaaatatttaggaaaatccaacctcgcagaaacaaagagtattccaggactacagaataagtattctttcagcataggtgagaagtgaacatttcaggaggaaatctcttcagatggcaggtcagagaaaggctgggagaagaggattaggaaacagggtgagagggggtatctaaaaaacacagtgggacaaaaatagcactttatgtaacctccctagtccctagcacaacttgtattagtctgtggaaattgtattaaggagaaatattgaaacattatacataatacattgaattagttagattcatttaactactatagaacataatcagcagttcatttacagttaactctgaaaagatgtttaattcattttaatggtatgaaaaagagactttaccatgttaaatgcaggttacaagtaccaaaaaattgcaagctatgattttcagtgtcaaatttacaatacaacagatctatggggttggggagtaaaggggccaaaaaagccaccaaaataccctttcctcccattatttctagaattgcttgaagtggcagctttcatgaagataaaattgctatgcctcttcattaataacagtaggttctcattttcaagtgtatctcattcagcgatagggatggggggatggggaaaagtccttttcagtttttgcagttagtcgtaatatgcttgaattcaacgcgctttctcaaaaaaggctcatttatttgagtggctctgatttgaataaagtctcaccttatctgaagctgctgaattgcaggcgggattgatcatggcttcttagagggataaactctgaggaagggatttccacagtacaactacttgccttaaatagtacagctttgggacaaaagcactttgctcttctcagtcaatagcaatagctcagttggaaattttgttaatgttaaaaaaaaaaaacctgttagagacaacatagattgctatgttgaaagaaaattctattatgtctgtgactatttccatcttgtttttttactatggcatgtgaaattgtttcctacttttattttttgagaaaagcatgtgttggctgttatttaccaaaaacacatgtgagccttcgtgtgtacacacacactagagttttgttttgctgttatgattcactgtctggctaacacgtaccataattatccatatttgtacacatagcatggtcttgtataatcaaagatgacactgttgaggcataaactctaaattggggtgtgatcaagggaattttttcacaatcctctatggttggataaatagactggactttgaagtctggacggaccacttgaagtatgtgacctccaaaattctgcctttttttttgtcgtctcctggcaacgtaacatatttatactttggccactacctctccttccagaaaggtctgctgctgttttaaagtttaaaacaacaaatgagaaagttgtcccgattgaaagttcagaattcctgaggttctcctctctgctttctgtttatgtcgacagataatagcaatgcagactacaaataaatcaacagaaagaacccttctcttttcagattagtgagcatgcatctagttataatgtcattttcattaagcccttttcactgtttagcaaagacaacttgggggcaagtgacgggagcaggggatggaaggaagttggaaacaagctaaggacaaatgttccacggtgtgaatacgagctgggactgcagaaacctcaggtccttccatctgcaatctgacacccagctactccagtggcgtctgtgcgcttctcccagaatcacagaataactgggcacttaactgagatcccaggagctgcttttgagacccacgggggtctggtttttctcctcctgcattttgcctctccagtcttctgtcctactttcaagcaatctgaacaagatggagaaagaatttgaatttcacattctgggatcttaggttatacttgaaagcacttcacattgacagctttgacataaagggcaccttcatttctggccagtttctcattctcagcactatggacatattgtgcaggattgttctttgtgatgagaagctcccctgtgcattgtaggatgctgagcaggaaccctggcctctgcccactagattccagtaaactcctcacccctccccatcgtggcaagcaacaatggctccagaaattgcccaatgtcccctgaggggtcaaaatcacccccattcgagaaccactgagttacagcaaaggaaatcaacatttatttggcaattctggtgtgccagatgtgtactagatgttttatgtcattctggcaattatcttttgaagtcttatcctctttttatagattagaaacctgggagatgacaaggagaagcattgttttgtttcgtgctttcctttcactgattttctggtactcaacaatgaaaatataaccagaaaaattatttcataactaggaaaaaaaccgtgaaaacatgctattttaatatatttatcccataatatgactatacatttcagacattcgttacctaagttacagacatctaatgtgaaaatttgtcagaagtatgaaaagtaaaaaaaaaaaaaataccgttggatatggacttaaccacttaaattaagatagcctttctttttctattctcttaacactggcaagtgaccaaattgtcttggatttcttatttcttctggtgtcaggcatgacaaattatctatcatctaaaccatcactttcacagggtgtgatggctcacacctgtaatcccagcgctttgggacgccaaggtgggcagatcacttgaggccaggagttcaagaccagcctggcctacatgttgaaaccccatctttagtaaaaacaagcagacaacaacaacaaaaataattagccaggcatggcggagcatgcctttaatcccagctacctcaggaggctgaggcatgaggattgcttgaacccaggaggcagaggttgcattgagccaagacgctctccagcctgggcaacagagcgagactctgtctcaaaaaaatatatacatattaagtccatcacttcctgtcttacatgaacctcaattattcttttttctgggtttcaatcttaggtctgtttctcactgatgcatacattttttccttagtttttcctcattagtttttctctatatgttcttaccaaggacctcaacaaaatatctctcagtcttgtttgacagcaagaaaacacacacacacacacacacacacacacacacacacacacatacacacacagttatttagtagtagaaaatttacagaagcttggaaaggcattgaaattcctatatgttccatttagaatttccatcctcatccttctcttcaaacctcagttgctttggttacccaaaatcattattagttaacatttttctattgtaaatatgttttggtggcattataaattaaagtgggctgggtttggaaagctgatactcaaatatgccattgtcagaagagagaggaactatggcttcaaatttaaaactggcatctaaatataatgtttccaaactttcagaacatgtctttcaaacaaatatagattgaatacaggccaaattttgtttttaattcattaaaggagccagcatggttaagccagtttgaaagattatgggaaaggtttaagtatttatagtcattgaaagaaagaaccctgagctatgaattgttcaattagatacaagaactggttaatactccccagaacaataaaatgacgacttagggtgggccagacatggcagctgatgctgtaatcccacactttgggaggccaaggtgggtggatcacctgaggtcaggagttcaagaccagcctggccaatatggcaaaacctcatctctactaaaagtacaaaaattagccaggtgtaatggcgagtgcctgtaattccagctactcgagaggctgaggcataaaaattgcttgaacctgggaggcggaggctgcaatgagccaagatcatgccactgcactccagcctgggtaacagagagagagactccatctcaaaaaaagaaaaaaaaaaagatgacttaggggataatctttcctacaagacagcaatcatttgcatttctcctagaccaatttatttatattggacgaattcatttgcatgtctgtcagcttttgacaagttaaagtctatcctcacagagataaaaaatatcctaacccataataaatgctgagttaaacaaagggttctaatttccctagaaaattagataatccttggttgcgtgttagacacttaaactttatttgaggttgaaaagtaataccaacccattgtagaaagtttgaaaagtactaaattttttaaaaggaaagaaaaaataaataccctcaaaccactacttagtaacccacagccactgttaatataattcatatgcttccttacaagtttcttctaaatatttttaacagtggaatctttactgtaaaaacaaattggtagtccacttttttcttttgctttttgcttttcttttctcttctttcttcttcttttttttcttctttctttgtagacagggtctcactcttgttgcccagactggtgtgtagtagcgtaatcttggctcactgccccctcgacttcctggagtcaagcaatcctcccatctcagcctcctgagtagctgggactacggacatgcaccactatgcctgaggtctttctttattgcccaggctggtcttgaactcttgagctcaagtgatccgtccatctcagcctcccaaagtgctggcattacaggcgtgagccaccatgcccggcctacttttttcttttatttactcttacccattgtagcatttgttatgtaatggaagtgtctcataagcattttaatggccacagtggtctagcactttttgtatcaaaaatttttaacagtttttcctaactttagacatttatttattataaattatttcagaatacaaagaagcatagaaaatattataatgaccaatgatgtaggtgtgatctagttttgaaaacatattactgataaagttgccccttcccctcactaacgcttccaaatatactcctctccagacataaccaccatcctggatttggcattcattattttcatatttatttttttacatgttttaccacctgcataaaatatatagtatttctgcatattttcaactttgctgcaaatcataccataggttctttttaaaaaagtctctatatattaaggtgtacaacatgatgttttgatattcatacacacagtgaaatgaaactggatcgttatcttataccatgaacaaaatcaactcaaagtggattaaagacctgaaaccataaaattcctagaagaaaacattgtggaaaagctgctgaatactggccttggtaataatttttttaaaacatcacaccaaaagctcaggcaacaaaaacaaaaataaacaagtgagattacaccaaaccaaaaagctttctcatagcagaggaaatagttatccaaatgaaaaggcagcctgtgggttgggaaaaaatattttcaaattacatacctgatacggggttaataccccaaatatataaagaactcacagaacggaaaaaagacataacctgattttaaaatgtatgaaggacctgaatggacatttctccaaagaagacataaaactctggccaacaaatatatgtaaaggtgtcaacatcactaatcatcagggaaatgcaagtcaaaatcacaatgaaatactagtttactcttgttaggatggctgtgatcaaaaggacaagagataacaagtgttgttgagggtgtggagaaaagggaacccttgtacacataggttctcaaggtaccttaaagttccaaaacttgatttttctatcaacattgtgtttgtagggatttactcaagtaggtaacttccagacccttcactttcactactgaatagtatccaaaattttatccacttttctgttgatatgcatctaggttttttctttccttctttcccttccttccttctttctttctctctctttttctttttttctctctccttccttccttccttccttccttcctgacttcctgccttcctgccttctttccttctttccttttttttttttttttttttgaaagagggtcttggctccacccaggctgcagtgcagtggtatgatcatagctcattgcagcctctacctctcaggttcaaatgatcctcccaactcagcctcccaagtagctgggaccacaggcacatgccaccatgcctagctaatttttaaatttttttgcagagacggggtcttcctttgttgcccaggctggtttcaaactcctgggctcaaatgatcctcccacctcggcttcccaaagtgctggaattataggcgtgagctaccatgcccagcctgtttcccgttttttactacagcccctcggtgtagctagggacatttcattcatgcacctccctgtgtactcatgtgagggtatccctgggtatgtactgaggggtgggatgccaagcctgagtacttgtgcatcaacagtttcattatatcctgctaaatatctaatgtgactgtaccagtttatactcccaccaacaggctgggcacagtggctcatgcatgtaatcccagcactttgggaggccaaggcaggcagatcgcttgaggtcaggagttcgagactagcctggccaatatgctgaaaccccgtaactactaaaaatacaaaaattagccagctgtgatggcactggcctataatcccagctactcaggaggctgaggcaggagaatggcttgaacctgagaggcagaggttgcagtgagccgagatcgcgccactgcactacagcccgggcaacacagcaagactccatctctaaataaataactaagatattctcccaccaacagtatgtgaaagtctagttgctctgcatcacaggcttacaaaccttttctgtaaagggccacgtaggacatatttaaggctttgtgagttacatggtctctgttgcaatgactgctcttgtaaagagcacaaaagcagccatggagcatacgtaaatgaacaagcccgtatgttccaataaacatttatttaagaacattgatttgaatttcaggtaattgtcatgtgccacaaaataccattctgttttttattttttccccagtaatttaaaaatgtaaaacacattcttagtttgtaggttatacaaaacaggtggctgactgagcttgactgtgggccatagcttgccatccccttcttgacattttcaccaagatctgagattttcagattttttaaaaatatttccaccatgatggatgcaaaatggtaaactgtgatttcagtttgtatttcctgattagaaaggaagtcctgtgtattgaccactagaattttatctcctatgatttatctattcacgtcttgttttccatgttcttttagttgtgggtcttttggttgtgagccttttgatttataggagttctatttcctggatagtaatacctatatatatacatatatgtgtgtgttgcaagcatgctctcagaatattgtgtttattatttcaatgtttaatgctgtcttttaatataaagaagtttttaatttacaaaaggtaaatgtctccaagtgatactcatttgactgtgaaaaaaattagattttccatacacactgagaacttgaaaggcaacgaaaaaagaaagatatcactttcttgtgtgcaaaagagaaaatatttcttcagtgggtgggagtagaaaaatatttttacttttattgcagactttcaagacagtagtttctttgaatgctaacagcttatccagttatgcaacctgttgttctgttctgaagaaaggattctcgagcagggctggagtcctggctgcctggagggacctgtcgcatctgatactaatgaagtgttactgtactttgacaagtttgcaggcgtctgtcttccaagccagctgacgtaattcagaggagaataagaccctcccacttgcgtttgttaattgactttgatgagctcctctgctctgcctaagtggttctggaacagagagctgttgtgatccgacgaactttagaaagtcacactaactaagactacacaccccaagccagcaagaaaaaggaaagcagttgctatgctgttcagcaaagcaagacttggctgccttttagctagtcctgaattcttgctcctgtgaagaaaattcctgctggagtgctgggcgcacttggaattggtctagcatgcttgacagacgccttatagctcctcaaactaaatacattattcctggggtaagcatacgggagagaagccggccagatgcacggtgcggtttaaagaaaacaggaatgcatagaactgttgccgagcttgagctaaaatcatactagttacttaactttttagactttcttatcttgccagaaatgttgccattcacagtgttattactttaatgctgtggtgatttaagcaagtgaaactgtaactctggttttaaactgtatgttactgagcttcatttagtagcttagggagagagtcccggtgcagacaaatttagtggaaaatgaaaatgctttttccagctatagaccagcacttgtcttgagtatcactctgacagcctagccactgacttcttgtgtgtctgagacctatctgtgtaaatcaggatggtctgacttgctgtgttgctgcaaattaagattcttttactattcatcaactttagaaattttgaatttaataaaatacaaacatgacagtctaaagtttaaaatacttaaacataaagctttgccacacgaggactgactgtttgggtcttcggatttggtttagaacttttaaagaaaagactttattattatttattggtgcctttttaggaaaggatgaaaacatgcacaaaaaaaaccctgaacctaaaactaaaccagagcccgtaaaaataaaagtcataaagttacaaatatctgtgctaataggacatgaaaataccattttaaaattaatagtttgtctaaaaattattttaagtacttcttttgtttctaattgttccaacctatactaaatttagtataatagagaaaaaaatgcttgctaggaaatatctttgtggtcatttcttctatgttgtatcatataaaactggaaactgagatactttttatgtgattttgatgattcttttattagattttactttaagttttctaaagatacagaattttacttgctgagttggccctcattaagtattgtacgtgacaattctatttctttaggttctgacatggctggcaatgtatacactaattatcaacggtttctgggcattagatatgtcacgcccacctatcaaatgctactcatgtccaatttagaaattattctgtacctgtttgagtacatctggaatcatttcctgtaaacttgcttgctttttaagaatattatcaaacatgaaataactgctatattttttcctgcagcggaattctgtgaattacgaaaacatgtataacctaaaatgcaaattgccaaatacattccattggccattttgaatattttcagcaacaaaactggtcacaattatgtcacagttatttaataagaatgacaatctatatgatattaaatagtcacgaggccaggtatggtggctcacacctgtaatcccaaaagtttgggaggccaaggtgggaggatcgcttgaggccagaagctagagaccagcctgggcagcatagcaagatctgtgtctacagaaataatagttatcacatgaataatttatcctacaattaattttagtcctatctttaagtatcatggggaatctgcacagggatgtttagtcttttaaattacttctttcctaaaaatagactttttgtttcctatggcctggctacctctcattttaactaataagtatgcttgaatagggcttataaacacatggatttttggatttttgaatggttaaagtttaaaacaactctttttaaagtctttataaccattcaacactttaaattcagtctttctcaaagttctccaataatgacagaaattctttcaagtttggacaagaatataaatggagataattttttaaattatacatatgtatatttatatatgtatatttatatgtgcctgtatatgtattatgggatagttgtttagaatgctgaataaactgtgtggtctttatttttgttctaatcgcaagtatgatttcagtttttatatcagtttcagtttatttcagtaccttctaaagtcattccaaacctcaaatgcaggaaacacatttagaaattacccatttaattctcattgtgcattaaaatgaaatcaataaaccaatgcaatttggtgtaattactttctaccgccaaaggcaaatatatatagatcagtctaactagttttaagtgcataatttatttatgaatcctggtatcattgcattgtaaatttcttgaacatggtatctttaataactgcaattgagtgccattattcttagacccagatggtcacttcctctctatcctttcttcccttcctccaaataacaatgatctctctgatttgggcaggtttttttttattattattgttacccgtaatttttgttttttctgactgtggttaagagaaagtatttggatccagtcagacttgacgttgaatactaaaccgtcccctaaataatggtgtgatttggcagattttatcttctctgagcctcagtttcatcatctgtaaaattaggaataataataactgtgtttcaagatacttgtgagaattttttaaaacgatcagagtacatgcatagaatataattatatggatggcttagcatagttcctagagttattcagggaaggtgtatgccttcctatattttctgcaatagctaggaatgaaagaacttagctctgaaatcccaaactgtgatacttctgataggcagcaaaggaaagtgatgagttgagtttttatttgcatattggaggacagggagagagattaaatgtcccccttgtgaagtgtgacttctaattggagacctgtgggtcagctatcagcgggctgggaggggaaagcaaatacaaacgctctaaaactgtgtgcaaatatttcagtctctgcatatgtgaacattttctagcttctgccaattatcaaagtggtcctcaacttctaaatggtaataaataaataaatctgagtgggcgtaaacctgagacaacaaataagatgatgatgatgaagtattctaagaaggctagtaattttgggtcgattattttttcttcctctttaattttatattgctcaagcatttatcaaaaaaaaaaaaaaaaagaaagttagcatgtgactgtgtattcctgtatgttataagacaaataatgatctaaggctgcaggcttctacatcactcttcagatataatttgtatttaaatgtaagtataatgtccataaggcctggtggctaatgtatgtacatggagatgctggcttcagcatcaagaggagccatcctgtttgattttactttgccccataaaacgatcagtttgtggaaagagtcattttgtgcagtcgcaatagagatttgcagttattttcattattaaaattgacaaaacttttttttttttttttaaacagagtctcactctgtcacccaggctggagggcagtgacatgatcttggctcactgaaacctccaccttttggttaaagtgtttctcctgcctcagcctcccaagtagctaggattacaggcgtcctccaccaaccccagctaattttttttgtatttttagtagagacggggtttcaccatgttggtcaggctggtctcgaactcctgacctcaggtgatccacccacctcggcctcccaaagtgctggaattacaggtgtgaaaagagctctatccttcaaagtaattaaagtttttactactaaaaatagaagaaattggctgggggcagtggctcatgcctgaacgacaccagcctgggcaacaactccgtctcaaaataaaataataaaataaaataaaacagaagaaatattaaaggaatgtgggtgtaggaataccccacaagctcaccatgctgtggtcagatatttttatgctggcatattgtactgcagttcttttctacaagcatacatatttttatagttgtaactgcagtgttcagacagttgtgggttctgccttttttccttcaaccttattttgagatcactgtttaatcagatcactgtttaatcagcataatataacatcgtgacgatctgccattgattgtccaataaaatggtcatttatttttggactttttaattgattttataattttgttttcatagataaatctataacaaatttgaacatatggttttcagctccattaaataacttatttgagataaattatcagatgtggaattatttgcacagtgagtgggtttgaatgttcttataagtccctggctatgcttttgatatctttttttccaaattctaccagtggacaatgccagtattattcatatactaattttatcacaatgtatgcagtattatgtattaatgattgcttttcatgtaaatagttatacagcattgttttaatttctgtttagtggattactactgaaggtgaatatttatatactctctgtatttctgtgcgaattgtttcattaggcttcctgcatttagattaataagttactttttatttgttggatattaacaggctttccctctctcaccttggaactcccatccgtctgtctctgtatgggggagcttcttccttctttctttcctattaaacacactccgctccctaaaacaaaacaaaaacaatccttacagaattaactgtggaatagtttttcccctatccaatactatgctatcaaaatactgtctttcatataaatttatcttaaatttatattctaataccctactggtatctctagaggttggcttgaagaaatagagtattcgcataattagaaatcaacagatagactagtcacaggattaaacctcagtttcggaatgtggagcaaaaagcttttgactttattcagatatctcacttatttttgacagggagctaataaccattacggagaataaggaaaaggtcacatctgaccgaagcacgcttagtatgaaaagtgcattctgtctcacctttctgttcatagattttacattgtcaggggcagcacaagccaacatatcatcacatttctgttgtttcagggctggcagggcctggcagagaccctgtgcctttgtagcttcctgcagggctccccctccagtggccattcagagatcttccactctcctcttaagagttggagaactggaactttcttttatttgtttgaggtggagtctcactctgtttcccaggctggagtgcagtggcgcgatctcagctcactgcaacgtctgcctcccgggttcaaacgattctcctgcctcagcctcttgagtagctgggattacaggtgcccgccaccacgcctggctaatttttgtatgtttagtagagacgggctttcaccatgttggccaggctggtctcaaactcctgacctcgagttccactcgcctcggcctcccaaagtgctgggattacgggcgtgagccactgcacccggccagaactggaactttctatatggttttctggtaagggatctgctagtattttgatcttaatgtaatatcatgtcatttgttaattcacaaatagtcatcacttttccttcaacctttgttcagttacctagctttgttaatgttagtggcttttttgggggaggaggggagctcggggggcacagggtctcactctgtcgcccaggctggagtgcagcgatatgatctcagcttactgcaacctccgcctcccaggctcaagccatcatcccatctcagcctcccgagtagctgggactacaggcatgtgccaccgcgcctggctaatttttgtgtttttcgtagagacaaggtttcactttgttacccaggctggtctgaaactcctgagctcaagtgatccaccctccttggcctcccaaagtgctgggattacaggtgtgagccactgcacctggcctgttagtggctttttggacatcagagaagagaaaaacctgacccgtgaaatcacatctaagatccttaattgtgctgccaacacacaaaatagacctgctgctgtcagtcagaaggggccatactcattgataaaagtgcaccttttagaaagtctgtttcatactgttctgtgccgcctagtcttcttaatagaagaaaaaggctttgatttgaaaacatgataggatggacatatctgactgcactgaaaggacaagaacaagattttattttattttattttatttttgagacggagtttctctctgttacccaggctggcaggctggagtgcagtggtgagatcttggctcaatgcaacctccgcctcccagatgtaagcaattctcctgcctcagcctcctgagtagctgggactacaggcgcatgccgccatgcccgtctaattttttttttttttttgtattttagtagagaccaagttgcccaggcttgtcacgaactcctgagctcaggcaatccgcccaccttggcctctcaaagtgctgggattacaggcttgagccaccatgcccagccaagattttattcttaattctagcactggctccttagtttttgagcaagttgattaacatctctaggctttttttttccccctatacaatgaaggcaataatttttatctctctactgctctgtctggaaggctataaaagcctatacgggtaatgcagtatccttaaagcatctgagaatagctgtccctagttttgtctttactttgaagcctgagtaattacttaaggaatgtaccttgaatcttgagaccatgtttctaacaacacaggtatttctgcaacctgaaatctgatgagcctgagatcctttctgttggacccaggttgaggactattttcgtgacttcgcttaatgagatttaatgttcaatataaacacttgaaaggaatttttcaaggctaaattctacatcagaaggttttgagcgtcgtgcacagctcaacttccaagtcttttacagtgggctgtgaataattaatgctgatttgatatctgggcattcttttaaaaaacgtgtatatccacccaaatataacaatatagaaaaaagaagagcctcatgatattgcccaaaattttaatgactcacatgtgatatgctgagtactatctaggtgaagttaaatgtggcctctgttgacgaaattgccacttacttggataacataacaagataaaaacacgtttgcaacgatgtacattttgagaaatcatgaatttctgcattgtagacataaatatttaaagaactctccgggtaaaagatcagttgaaaatttggaaattgtggaattcagttcaatttagaatacttactgaatgacaacaattagagaataattttgtcaaatgtctctttaaaatgatttaattaagatacatatgtttggcactgtagctggaatacagaggcccaaggtggttatatgggctaaatttgaactcagaaaaaggatggatggacggacggatggacagatggatggacagacagacagacagatagatggatggataggtggatagatagattgtttgagacagagtcttgctctgtcacccaggctggagtgcagtggcctgatctcggctcactgcaacctccacctcctgattctcctgcctcagcctcccgagtatctgggactacaggtgtgcaccaccatgcccggctatttttgtatttttagtagagatggtgtttcaccagtttggccaggctggtctggaattcctgacctcaggtgatccacccgccttggcctctcaaaatgctgagattacaggtttgagccactgtgcccagatacaaagtttatattttaaagagacctcagaactaggccaggcaagatggctgatgcctgtaatcctagcactttaggaggccaaggtgggaagatcgtttgagctcgggagtttgagaccagcctgggcaacgtagggagaccctgtctctacaaatatattttaaaaatcagccacatgtggtggtgtgtgcctgtgatcccagctccttgggaggctgaggtgagagatcacttgactcccggaagttgaggctgcagtgagctgtgatcgtgcttctgcactccagcccgagtgacagaatgagtcccaccaaacagaacaaagggacctcagcctttcttcacttctttgttcttcatatgaagggtgggcattcacaggacattgcaggaggtgtgataagattcagagttccccatacagcctccacttgaccgcttctatttgaaggatgtgatgctgtggctggaacaactggttggtgaaaatgttgttgaaagtcgtttgtttaaagagacctaaaaagaaccgttttcccggagctccggcatactacaatgacctaagttaatagaccacagcgagtgtgaagaataatgggtccaattgttgatgcagtatctgcttttaggctgagaaaatatatattggtttaatttccacaactgagtttgcctgacttctctgggaccattttccattccagcagcataaacctggctcaaaatgccattaaaattgatgacaatctgctaggtgagatgagccagacacaaggagacaaatacagaatgaccccacttatataagggacctagaatagactcacagagtctagaatggtggtttccaggggctgggagaagaggggagtggagagttagtgtctaatggggacaaactttcagttggagatgatttaaaaaaaaaaaaaagatcctggagacagaagatggtgatggctacccaataatgtgaatgtattcaatgccattgaactgtatgcttaaaattggctcaaatggtaaatcctatgttatgcatattttgtcacaatgcttaaaatacaatttaataaaaacccacctgtattgcgcacgtatgttgcatgaggccaaatgctttatatctattattattatttttaattccgtaacagctgggtgcggtggctcatgcctgtaatcccagcacttttggaggacgaggtgggtggatcacctgaggtcaggagtttgagaccagcctggccaacatggtgaaaccctgtctctactaaaaatacaaaaaattagccaggcatggtggcgagtgcctgtaatcccagctactcaggagggtgaggcaggagaatcgcttgaacccaggagatggaggttgcagtgagccgagattgtgccattgcactccagcctgggcaacaagagcaaaactcagtctcaaaaaaatttttttaaaataataaaaataataataataattctcataacaacccagtgaagtagacacatgatcatctctagttggcagataaagcatctcagcacagtcaagtttgtcactagcgtggggtcccacaggtgtccgtggaaaaagcaggaattggaagcaaaagggcagcctcttccatgcacgcagcccacacagcactgcctgtgcctccttgttgtttttgtttgttttgcctctggtgactgcactttctaatggccccagctgctagagcagtcgacgttccctcaggagtagcgctttaggttcccttaatcttcacccaggggtacctccttgaccttgaaccctgcaggtcctgtagcaggaggtgagattgcccatcagccctccaggagtccaccagacctggcaggccttcatgcagcagaacaaaaggccagctgtttatttcctaggcagagttcatgaaaatcaccccatgggtgtgataccaagatcatcttaaaattaacttgtgttttaaaaaccattttctgtttggttttttagtggtggtggttgtttttgagacagggtctcgttctgccgtccatgctggagtgcagtggcacaatcatagttcactgtggccttgtactcctgagctcaagccgtcatctatcacagttaaaaaccatttttaatcttctctaaacaagtaacttttcttaacatagttttcaatcttctagaatgatcaactagaatttttttaaatgagctgcttttttcttattatatgccagctactttttggaaaaacaatagcatagagtcattctcacaggagaatgtatataaaaacaaagtaaatatatttttataaagatcacatgtacaccctttcttttcttttttttttttcttttttgctaaaatgtgtatttataaccagatttctcatcaggctttcttgggatctttaaaatatgtttcttttgcaaatataggcttaggactaaatatattctgtatcccgtcatcatgttgtattacagatgagaagacaattaattctgtgataaagtatcataaggcaagaaagaaggtgcttggggaaattggactgtgctagagatcttttctgattctgcaatatactacgtattcagtgatctgctatatacaatgattactgtctctttacattcttctacctatattttttaattgggtgagatgatgaactggaaaatgatttgctacatccagaaatttcaaagcattcttaaggattttgttgaaaacacatgttattctattgttaccgttttctgcctttttcactctaccatggaaaaccagatggtctgtacaagccgagagaaataatttccaacccagtgtatttgcataatttcctctctgcccttaatctggaacaaaaggaaacaaaatgaattgagttcagcataataaactagattggttcttaattacagaattaggaaagtttttcacataatttaagattctttggttgtattgctttcaaagttagagaaagtctcttttaaagtgtgatttctattagaggctttttttcctgatgaattcattgattcaacaagtcaaaatgggtgacagtttttgcaaaccaaaggaagagagtgatgacatttaaaacacatatatagacatagagaatttcaaatgttctacactcctgctgctctctcaaggcgtgttcagagtctcctaaaaaggatgtttgacctgtttgcagagctctgacagatgatattttgacaggtctatttcttctgcgtgttcaatgcaatgcccaagatgaataggcattcaacctaaaagtacaacttaaaagtacatttttgcatccaagccagcctctgcgtacttcattcttatccttatataagggtaagatatttgatattctgataatcctgttacctttctgatcgcatgagttgagtggacttccacgcatcacgtcccatgacagggctcctctgtgaagcagggaaaaagcatggcatctgatctccttaattcttacaacaccaacagaacataattactttatcatacagggctatgaagatagcacatgtcaccactgtatgaaagctcttaggttgtggaatttagtctaatgttatcatggaagagtactgaaatagggaacagtagggttgataaatagagaaagaaaagagaaaccaggaataatcagtgaatgataagcaagtaacatggtttaaaagcattccaggagttccatttttaagcactcttgtttacttagttttgctacccacttgttgctttggaagagtttctattaattagatgtcatttttcaaaagtgcgtacttaattgttatatgaattacaagggactgcataggtttcgttgcaaaaatgtttttcaaggaacacttagaggaaacatgcttcgtagcatttcatagtatatgacatttttaagggagaatgctttacatgtaatatgtagcacaatttggaattattagtatattggattttctcatgttctgggcaaatgaaggaacatatatgtttgtatcaataaaagctgtgaacagaatatgtgagcatattttgaatccatcaaatgtattacatcatctctagtaaagctataaattatagaatactttaataaagttatttttcttattcatgaaatattatgtctggtagcaggaaaatgtgatctgttcagaaaaaggataatgaaagaaatcttttattagagaaatatgattgctatacaataatgtggcctacatttaattctacatgttttaaaattagaattgggctttaaaaatttatggttctatgccaggtgaggtggctcacgcctgtaatcccagcactttgggaggccgaggcaggtggatcacaaggtcaggagttcgagaccaccctggccaagatggtgaaaccccatatctactaaaaatacaaaaattagccgggcacagtggtgggcacctgtaatcccagctactctggaggctgaggcaggagaatcgcttgaacctgggaggcagagtttgcagtgagctgagattgtgctgctgcactctagcctgggcaacagagcaagactctgtctccaaaaaaaaaaaaattatgattctatatgaaacgtacgtttgtatggacttggaaaagtcttagttaaggacataggccttctcaactctttttaactctgtaactttatgatataaacaaaatatgtaagcatttcttcacagttcgccgatctacgttgattcagtataaggtacacatcaaagtaaaattaaccaaagactctaatttgagggaataataaggcacatggttgataagaaagaatacaatattccaggggttatgaactattagcatttctgattcatggcaatccaatttgagagtataaatttggattaccagcttagttctgaaaaactttctttatactgctctatggcagctgagggcttccggttcatcacatgtatctgtttagtctgctaactctgacaaaagccattatctattttttttgcccaaaggcattataaggaaatagtatgagcaaagttttctttctagtataaacaataaatcttactagccattgggcaaactcatattctggtgaatatttgaaaaagcttggcactcattaataccagcaagtgtccagtagcttgatgagtactttatagtatttaaatggaatgtatagtctgtcaaaaaactatagtaggccttaattagctgggtgacattggacaaattatccagagtcaaatccctgagagtcaatttgcttatcttttcatttggagtaataatgatgtatgacccctatagacctcaaggctcaaatataatttgaaaatcttaaaaatagcaaagcactgtatgataatgaggtattaatcatttaacaaacacttgttaagtgttagctcctttttttcctcctgacttgggcccttaaactgcttgcctgtcttgggaagagtctccttggtgaggtcctatgagaactttccactgtgcctggtcccaaccaccacccaactctccacccttccaccaacttgtgctggccttgaaaaggtcagaaggctgttggaagagtcctggggagagaaacatggcagccgagcgcaagacagttatggtggggcctagagaggagccagatgtcatggtgtggttgattgtgttggatgaagctgaggtcacagaagatgaaggctgaaaggaaagctagggttattttgcggtgtttttgttgttgttgttgctgtttttgcttgtatgtttgtttctcaattacaactatagggatgggggaactatctttagaggagtctcaggacccagcaggcccaacaacagaggagtggggacttctgagaagtctggcagagcaggtgatgggcagtagcttttccggttctgaaaatatctgcataatctacacaggggtcagcagggttcagagaattaacctaaagcacaaccataaaaccatgtgtggtttctttcttcaaagtcacatctgaagctcaatattacaggttgagcattccaaatccaaaaatccgaaatccaaaactttttgagtacttaacgtaggctagagacacctttgcttcctgatggttcaacgtacacaaactttgtttcatgcacaaaattatttaaaatatcatgtaaattaccttgaggctatatgtataaagtgtacatgaaacattaatgaatgttgtatttagacttgagttccatccccaatgtagctcattacatacatgcaaatattccgaaatccaaataaaatttgaaatctgaaacacttctgtcccaggcatttcaggtaagggatactctgcatgtacactctaagtgtttcagggtgcttaacatagtacttctatcatttcttgttatttgagctttctagattttggagttctggatgagaagcttatcttttacaaacattacttgtagttattcttttccaggtataaacctaggtagaaaaaagttgttataatgaaaagaaaaatgtatcgtcgtttttttaaaaatgggacttctatatgtaactaacgatttggtgttagtgtgagctatgatttgttctcaggatcatgaatgatatcacacaaatgattacgacacttgaataaatgtggcctttatttaattttttgatgctattgcagagctgctgctaacattcagtcctagttataatcacaaaagtatctgccataagcccagctgattaggctctgcaagtttgatctgatttttctcttttttttttttttttatttttttgagacagagtcttgctctgtcgcccaggctggagtacagtggcgcgatctcggctcgctgcaacatttgcctcctgggttcaagcaattctctgcctcagcctcccgagtagctgggattacaggtgcctgccaccacgcctgcctcatttttttgtatttttagtggagacaggatttcaccatcttgaccagactggtcttgaactcctggcctcatgatccacccgcctctgcctcccaaaacactgggattacaggcgtgagccaccatgcccggcctctgattttttattctcctctgtaatgtccgagtcaactaacatgcacgtaaaatatgcaaaaaaccccacaactttctggaaggtttctgtaaggattgctccacggagactctggcaccccaaggctgcaggcccctggaggtcccaggagacctggatctctgcccactgccccatgcattgacacagccctcccttcccaccttccccgctgtaatattgcttacccatcttgattccttcaaggatgaagctgccataggctgggcctctgctcctgcttttttctgatgcttcattcatgcaactatcccaactgcccagcacccactttgcatcacgctagctctgggcaccatcaggaagcccactgtctataccctgtgctctgtctcactccacctcatcatcactgcttattttcctcactttctccagcaagccaacttctttccacctttctggtcttgctggattattattattgttgttgttattattttaaacctggaatattcctccctgccctttactttgatcctaaacatctctgtggttctgcagaaaagcttttcctgactacattgcacaaaggagcttctcccattattcacatcacccagtttgcttcgtataaatgtaattatttgaccagcagtttacattttgatcctctctcctctcgtctctttttctccttcatttttttttttaacagagtcttactctattgcccaagctagagtgcactgacatgattgcagctcactgcagccttgacctcgagggctcaagcaatcctcccatctcagcctccaagtagctggaaccacaggcacatgccaccatgcctggctaatttttttatattttgtaggggtgaggtttccccatgttgcccaggctggtctcgaactcctgggctcaaacgatcctcctgcctcagcttcccaaagtgctgggattacaggcttgagccactgtgcctggcccagactcaatgtcttttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggctgactcaatttcttttacctgtatttcagcactcgtcctttatcatcctgaagtgaaatgtatagttaatgcaaacaaccaacacacaaatttttaaaaaccatttgggtcaaaatactgacccaatgaataaaaagattaatttattctctggtaatgtgtatttcaatgggttattatgctggcataaccacactagaaaacgtgaggaagcagttccatggatagggccactgcatggacggattagcggtgatgtacacctacaggtgtgcggctattaaagacaatagttaacaatttggtaaagttccaaacaaagtacaatctttcattgattgtcacagtactttcatttctggaaaattcagtatattttacaactatgcgaaaagacttgtactcatatccaaaaaaagatttagattctaggttcagataattttatatttttcgcccacatgaattccagcaggatagtcaaagatcgtgagaggaggtgcacatccatcttataatcacataggattgctgtgtaaaatgcaaacaggtgtattcctagccactgtgtacaagcatcctgtaatgcttctcagtcattgaaacaaccaaaaatccagcagtacctttctggaacactccttttggggacccattagtttagacgataaactccttaagctcctcctgcatggcgggcaggaatcatatttgcctcatctactatacaagcctcaacatccagcacatcattgtcgcagtgcatggcaaatatttaaagaaggaataaacgaatgagtgaatggaaaggaatacgcagaaacaggaaaacacattcatccattcaattgattgattaactggagacagagtctcactctgtcacccaagctagagggcagtggcacgatctcagctcactgcaatgtctgtttcccaggttcaagtgattctcctgcctcaggctcctgaggagctggtaccacagacacgcgctaccacgcctggctatttttttgtgtttttagtagagatgggttttcaccatgttggccaggctgttctcaaactcctggcctcaagtgatccacccacctcagactcccagagtcctgggattacaggtgtgagccaccatgcctggcccatctattcaatgtataaatgtttactgagcaactagtatatgctacctgctgttctagaacctaggaatacagcaatgaatgagggaaattccttttctaatgagcacgctctctctctctctctctctctctctctctctctctggagctgctttgtgattgcagtatgacatctggttttcctatacaggtacaaggtggctgtgcttgagacatgccaagttttttttaactcagaatacttaccatataaatagagcaatagagtatgatagacaaagctggctaggaaataaaaagcagtggaaggaattcagtttgatgacaaagaagtgtgaattgcccttaagaaacaaacaatagaataaaatgagagcctgaaaataaataacttggttatttatagatttcttgtgtctgtcaatacagcatcacagaccaaaacatttaaattcaggggttttgttgttgctgctgttcttttcataaatatggccatattagaaaaactttacatggcgtttttctcttatgcaatcttttttatgtagcagtttcctgggaaatgttatgtcagctttaatacaggcctgaatttaactggcaaatagtgacacaaattgtcatgatggaaaagtaacatgttgggggttttaataaccactgaaatactgatagccattttcttttttttttaacttctacgttatttagggacctattttgcagacataaccttaaactaaaatatcccgtgtccattgagaagcctacccccacaaaaataaataaatagatgtgggaatgatatttggagtttgtgagtaatgtttgttttgttttttgtttgtttgtttgttttgacacagggtctccttctgtcacccaggctagagtgcagtggcgccatctcggctcactgcaacctctgcctcccaggttcaagtgattctcccacctcagcctccagagtagctgggactacaggtgtgtgccaccatgcccggctaatttttttttatttttagcagggatgagattttatcatgttggccaggctcgtcttgaattcctgacctaaagtgatccacccaccttggcctcccaaagtgttaggattaccagcatgaaccaccacacccagcctggagcttataagtaacattctgttttgttttttttttctttttcatactttaagttctggggtacacgtgcagaacatgcaggtttgttgcataggtatacatatgccatggtggcttgctgcacccatcaacctgtgatctacattaggtatttctcctaatgctgtccctcctctagccccccaccccccagcagtccccagtgtgagatgttcttaaactggcatgtttcttggccacatctcttgaattttaattattgtactttgaattattttgatgttaagattaacttttatgcttatgcttattgctgtcgtgagtggtactaaagagtcctgggttgtaaattgagccacgagtgcaaagaggaaattaaactattctatattcaaattaagccataaacataggaactggactctatactggggagggcgggtaagaacagtacaggagcatagggtgatccagcgtcacacagagcaggtgctcaggaaagacatcaataaactgccgatgaatcaacattgtaagaacaggggaatgaactttgaagtttctttgacatcagttattccaacaacctcagaaataggtgctgcctcctctcctatataaaggaggaaactgaggcacaaagagttcagtttaggtttattttaagagacagagtctcactctgttgcctaggctggagtgcagtagagcaataattacagcttactgcagcctcaaactcctgggctcaagcgatcctcttgcctcagcctcctgagtagctgggactacatgtgtgcaccactatacctggctaattttgttttttgtagggatggaatctcactttgttgcccgggctgatcttaaatcctggcttcaagggatcctcaggcctcagcctcacaaagtgctgggattacaggcatgcaccactgcacccagccttattttgttgttaaggcaatatttatgctgtgtttctaataattcacttatcactcacaagagtcctgtgaggcagacctattgtttttatttcacagagaagaaaactgaggcacagaactttaagtggcagctttgatcacggggctaagatatggtggccacacatagtcatgagtgaggagagcaggctccataacttgtcctcttagacgacttgctggctgtatattcccctgcatctggggtgtcagattatgcacctgctgaatacacagccagcaaggagcagaacaggactgtctgatttcaaaatctatgtcctttcccctatccttagctgcaaaaccagtgatattccctactcactgtgggaagaagcatgaatgccttcctaatcatcaaagccaagaggttttgtccacaattcaaattcctgctgacctttcttttctgttcattgttcatccctccttcatctcattgtggtttttttcctgcctcctacttctctgagcatgacctctcattcttctctgacttttcccccatctactaaatgtgtgtgttcccttaagttttatcttaaactctctttattcttttatctgcttggagcatctgtgtcttagcattctcctctacttcccgggctcatccattacctttatgtagccatcctaaagtagacttttcaaaaattccacctgtaatcccagcaactggggaggctgaggtggaaggatcgcttgagcccaggagtccaagaccagctggcaacttaatgaagccctgtctctacaaaaaattaaaaaaaaaaaaaaaatagctgtgcatgatggtgcatgcttgaagtcccagcaacttgggaggctgaggctggagaatcgcttgaatccaggaggtggaggttgcagtgagccaagatcgcaccactgcactccagcctgggcaacaaagcaagactctatctcaaaaaaaaaaaaaagaaagaaagaaaaaacaattccagtcatataagtccaattgcttatcatacatttctccacggttgttatattactgttatcctgtctaaggtaaaattctttttttttttttttttcgaaacatagtcttgctctattgctccggctggagtgcaagtggcatgatctcagctcactgaaacttccaccttccgggtcaagtgattctcccatctccagcctccctgaatagcggggattacaggtgcatgccatcatgcctggcaaatttttgtatttttagtagagatggggtttcactacctaggccaggctggtcttgaactcctgacctcaagcaatctgcccgcctctacctcccaaagtgctgggattacaggcgtgagccaccacacccagcctaaggtagcattcttaattgctgtttcccaaaaccaacccctgtttctaacttccatattattactgctacacatttttttatattttttatattttgtagggatgaggttttcccatgtcgcccaggctgatctcaagctcctgggctcaagcaatcctcctgcctcagcttcccaatgggtagcagatataagacaatttgtttaacaattaacactcagtttatctagcagtggttcacctaatgattgaagcctctttcgagtgtttttgtatacatgcatacatcctattcttttcagccatattgtttttcttgttaaggacttcttaaacatgcttattaaaacattttcaacttaatttgtatttctaaaaagtcatgatgaattttgtttcagttatagctattaagggttttctaaagatcctctcttcaaaatgttttgttaggagcaatagatatttgtaaaatttatgaaaatttgactagttttttctaattctttacattgtgtgattactgtttcctccttgtttttttcccccaagtgattatattagtattctatttttgtcattttagagaatggacacagaagtcaccataggtgaattgacttaaaatcttttaagtataagaaaaatagcaaaaatgataacctgcgaagtgggtgatcaattttttaagtccataacgtgttaaaagtccataacaaatattgccatagaaaatgcatgtagaggctgggcgccgtggctcacgcctgtaattccagcacttcgggaggtcaggaatttgagaccagcctggccaacatggtgaaaacccgtctctaccaaaaatgtacaaaaatggtggcacatgcctgtagtcccagctacttgggaggctgaggagagagaatcacttgaacccggcaggtggaggttgcagtgagctgagatcgctgacactgcactccagcgtgggcgacagagtgaaactctgtttaaaaaaaaacagaaaaacaaaagaaggaaaaggaaatgcaagtagaatgttagaccaggtcttcattaagtgacttcattaactctgggctaattggctctacctgtgagcaaaagctgattgtctgtgttgaagacagtttatccacctgtctctcctctctgtcatagtcacatgttgcctctcccccatcttctctgctcacacatctcagaagctcctaaccagcttttcttcccatgaacagtaaaataggtttcctaaataaagattttgacatcccagccccttgtgttaaaatctgggatggctcattatttacaagatcaatttcaaaagtattagcctggcgttccaggctctcaacaggatggatggctcaggcttggcttttcagacataacacctatggtttctgtacaagcaccaagcagcacgtctactcacttgaggatgtcttgtacccagtcacccccgctttcttcctggttgaaatcctgtcgccccatggggccttctctgttccccatggaagcttcatcctctgatcctcagtgccatatggtatttgttgtgctggttatttcttgacatgtctgtcttatgctttcaaagagtgtgcactctctgaaggttcagcatgaaactaccagtaccttccattcccttcagtcttctattctagtaagctcaaagctagcagttcaaagctagtatttaatagcatgtttaaaatatgtatatgactagacaatgtggccaaaggaagtgtctgagccagagggtctgaattcaggtctttgtctaacatactcattatagctgtgtgacacttggtatggcacctaacctctctggaaatcagttcttttttttttttctttaaatagtaaggatagttataccaatcaaataggtttggtttaaaaacagatcattttggataagtgcattctatatcataaactgctttaaaaatgttaatactggcaatatttttattaatgctgttgcgaatagtagggtcttgaaggcagtttaattttttttttttttttttagatgatgttttgctcgttgcctaggctggagtacaatggcacaatctaagctcactgaaacctccgcctcccgggttcaagtgattctccagccttgcctcctgagtagttgggattacaggcgcctgctaccacacccagttgattttgtattttcagtggagatggggttttgccactttggccaggctggtcttgaactcctgacctcaggtgatcaggtgatccacccacctcagcctctcaaagtgctgggattacaggcatgagccgcggtgcctgccttctacatgcgttttctatagcaatatttgttatggatttttaactaattttttttttttttctgggagatagagtcttgctctgtcacccaggctggagtgcagtggcaagatctcggctcattgtaacttccgtcttccgggttctagcaattctccagcctcagcctcctgagtagctgggattacaggcacgcaacaccacgcctggctaatttttgtggtttcaatagagatgggttttaccatgttagccaggctggtctcgaactcctgacctcaagtgatccacccaccttggcctcccaaagtgctgagattacaggcatgagccacttcgcccagccaaggcagtttaatttttttcttctggtcttgtcttctctttctttctacatttctcaccctcttctttcatctcctgcctgttctacatctgttacctctgacgtgcatttgttgccaccgtttcttttgtgtgtatcaatttactttcctctccttgctttagatatctttcatcttcattcccaatcttcctctttctgccaaaatgtcattttccatgcgatatttcttccttcattattctttagcttactttcttgttagtatgtataatagggtttaaaagtgatcggagattaaagaattatcataaaatccagaagtccatacaatttctcttgcacttaggatagcatttttttcaagtgctgttttatttgtaggcacagaattttggaatgttagtagtagaaagaggtgtataaattaatctaatccaatctacttgggttaaggatgaaagcagatgtctagagaagttaaggcacttgtcttggacctcagagttaattactgactgagttgatagttaagaccatttcctgagttcaacttactcttgtctcattttttgctaaccactgtattgtgtttcctgcccctgagtttggttaagggcaccatctgggagttagtttgttttcagcatgcaatcaagctgattggctttgaacgagttatttacccctctggccttgacattctcatcagaatatgagaggacaatatagagattctttaaggcctctttttaattttcaacctttcttcatccatatttgacagttatttggtgacggccaattatttacaaataaaagcgatttggactcttacattcagtttgccttcatgttttattccaaatgccacccaagtttgggcttcttttgggcattactgtattttaatctatacaacctcataagcttctccaggatttgtttaaattatttctaattaaaacatgatggctttctgggcagaaatcctgtccttgtactacaaggatgtttggcaaggttattgttattttttaagaggctgaaggaaaattaaatattttgctgaaatattttctctggattataacgttgggacagaatagtgcaacatgcttagtgtatactacctgaatgttgaaaaagagagcctccattattccttatttggagaacagtatagtattaaccattcattgatttcagtgaatactttctcacacaaattattcacaatgtgaaggaaactcagatcaagaaagaaaagaaatgtatagaactatctttgttgaggatgtaagaatctgtcaatttggcctgtggagggtaggaattccaggaagtttctgagccctctcacttctcacaaacactcacattcccttcaaattcatagaaaaccattctacccatttaaataaacaagaaataagtcttgcttatttcattctggttcattagggttcttttcccatctacctggctcactggaatgttggctggttctacctttcaaatgtaggagcctttccacatctaggtctgggtcatgtaaataaacagaaacttgaatgaaattctcgctgagggcggtggctcacgcctgtaatcccagcactttgggaggccgaggcgggcggatcacgaggtcaggaattcgagaccatcctggctaacacggtgaaaccccgtctctactaaaaatacaaaaaattagccgggcgtggtggcgggcacctgtaatcctagctcctcaggaggctgaggcaggagaatggtacgaacccgggaggcggagcttgcagtaagccaagatcgcgccactgcactccagcctgggcgacagagtgagactccgtctcaaaaaaaaaaaaaaaaaaattatcctggcccagcactttctttggtttattttgcttttaataatcaattaatatagtccatcgaagactgattttgggctgggcagagtggctcacgcctgtaatcccagcactttgggaggctgaggtgggtgaatcacttaaggtcaggagttcaagaccagcctggccaacatggtgaaaccccgtctctaaaaatataaaaattagccggaaatcacttgaactcgggaggcagaggttgcagcgagcggacattgtgccaccgcacactccagcctgggcaacaaagcgagactccgtctcaaaaaaaaaaagctgattttggctgtttatggaattttcagtcagtttgccagagcatcatttcctgaagtgcttacaaatagtcattttttgtcttttggtgtctgagagcctattttaagagcattgccaagcgtgggaaactagtatcactatattccagctgtggaaactgtatcactgtcataatgcacttgaacttcctatgaaaggatttcttagcggacatgctgagaatttacttcgaggtgtgtacgaaacatgtactacgatgacgatgagccttctgaagtggtaagaaacatatacccattgacatctgacatttttcatcatttttttaaccatttccaagtttgtttttaaactttccactaaagtgcttgttgtcactaacagtaatataaaacaaatagtattttttttttttcccttagggactagcacaaatgttgaaatactttgggacaaagtttgaaatgaacacattttataattatattattttgttatatgcggaattattttttgtgcttgaacttggattttaaatagttttcaatatcttcacacgtcttctgaaaaggtatttttaaaaggttttataagtgtaactatagacagtttacattcttttttaaaaaacttgatttcctagtgaaattatatctgttaaatatagttaaaagtaattgaattgagaattgtatatgttataaaactttggatgatttgtaaatacttagtaaactgttagtgaaacctcactgtaagaaatgtttctcttaaatgtttaaaaaagtatttaaattaagagtatataactaattaggattctgtattgttctcaagacataaaattatgtaaaaattcacatttatcaatacacatagcaaaacagacagtaaatgtagtcacctgttccttgtatgcaaataaaagatgaagctaaactttaagagttagggatacatttttgaaattgtagaaagctatattaaaccatatacttctttgaaatagtatataattcaattcaaatttaataattatgtttctgcttccttaatatcttattgaattgtgatgtaatttaatttgattttagaaagacttaagaattctaagtttgactgttaagaaacgaacctatgttaaagaatatattttggccgtctggtcatattctactgaaaacgaaattccctttttaggtgcgtttgggggtacagtagaatgagattatttcactttttgtcatatggccaggaggaaagaaatttcttgaaaagcaactgagctctctcctgtaaacacagcaagttgaaatcgcacagctcctaatttggtgtctttatttcaatctttggagtaagattatgaacaatagctataattccattctgagagttaaaagttttcattgtaaatttcaaaatggtcatttctactaatatgggcattatttttccaaagacccacttctgtctcttgtttttcgccctcgggtcactggcaatatggaaaaaaactttcaaaagagtaggatatgactccattccagtgttcccaggaactgaaagtgattgcaaaattataagctttcagaataacacagagaaaacttctacgaaacaagtaatgcagaaatgcatccaatatttaggccttgctctctatttttattgcctgcatcacatgtggctcatacagaattttcaaactatttaagagttgcatttaagcatatgctaccaaaaaggaaaaaagtattttgaggaatggtgttaacattttagggaaagcattcctgaaaatgagttccaggttttgttatttttttaataaaagaatgtaaatgtatacagaaattatttcctagaatgtacttgaaggagtattttaggaatacaaacattcattaattaaccctcatgtgtttaaaatatacacctgttatatatgattatgcacaaaagccagtttttcatgaataatttgtgtcttttttacataatttcagaaaccatatgctctataatgaagaaaaaatatttaaagtatgtaatcatgttaaacagttacagcatgagtcactctatttaaaaaaaaagagagagaaccagtctgcacgtgacaacaagaacttaaaggatctggtgttcatttgaaatgtactggtaatttaacatcactgtaaattcattaacttaggtcattctggttattgagatcaaatttgaaatttttcttttgttaagtattcaaatgtttaaaagccctgtaaaccagatcagagtattaggacataaatttgagtgtgtttattccttaaaatgaggtctacataactgttttaaaaattgcctctggtaattcttctaagtcttacagtaaaatttgccagaggcgtactatttaaattacaattaagctatcaaatttaaaaattactttttcatttcttttagttctgtttttctccccgtgaatcaaatattgtttgtgctactaataattttttgtggatttgtcattatttttgaatatttaaaatatcctgtactttgctgtagtataggtggcagtagtctaaaccttgatctttttaatgcattcacatcaggatttttatttttgtgggaaggtaaaaatcattattttcccctaaggtcagtgatgtggtcttatttttaagaagaaacatgcatcaataagaaacataaaaataggctgcctttgaaaggactactttatttaagaagatatatttccttattgtgtcttgttagagggtggaactgggccattagtggacaaaagggataagagggtcgagcatggggtttcacacctgtaatcccagcactttgggaggcccaggcaggcagatcacctgagatcaggagttcaagaccagcctggccaacatgatgaaaccctgtctctactaaaaatacaaaaattagccaggcgtggtggcacatacctgtagtcccagctactcaggaggctgaggcaggagaatcacttgaacctgggaggcagaggttgcagagagccgagatcatgccattgcactccacccttggcaacagagcaagactctgtctcaaaaaatcaaaataaaaagggacaagatatatctcttttctgttcagaaaataataagtgagcccactgataaatgacctgccaacctcccagttctggaagtcttttgtcctgcttttggcatgcactagtcaacactgtccaatagaagtttctctgataatggcaatgtttatatctgcactgtccaatatggttgccactagccctgcctggttattgagcacttgaaatgtggcaactaaacaattgaatattgagttacatttaaatagccacacttgtggcttctactagactcctttctgtacaaaatgtgctccctgcaccaggagtgccggcattaccgtggagcttgttaggaatgcagtctcagaaaccacatcttttttcatttgtttttttgaggtagagtcttgctctgtcacccaggctagagtacaggggcactatctgggtaggctcactgcagcttccgcctcctggattcaagtggttctcttgcctcagcctccccagtagctggaaccacagacatgcaccaccatgcccggctaattgttttgtatttttagtagagacagggtttcgccatgttggccaggctggtctcgaactcctagacttaagtgatcctcccaccttggcctttcaaagtgctgggattactggcatgagccattgcacctggccagaacccacatcttaacaagaaccccaggtgaattaataaactcattaccatttagaagtcctcatagggctggggagcagccttgtagagctcatgcttacttaaaatttccatcattctttaggcattaaaaaagtaatccaagcttacatatcataatttttaaagtactctttataattaaactttctcccattgttgggcatttaggttgttttacacatacacgcaggcacatatttgtatagatacacacatatgtgtatatatttcaacatctatatctcgatatgtaaatatagataggtacacatgtatatgtcacatggtgaacattctcttacctaaatattttacgtgcatctttttctttcacaaagattccagaaaaagataattactgagtatttacttttaaaagagtaatatgtattcatacactgcttttcagaaaggttatactaaatttagacttccaacagccagcaatgtttgagttccactgtattactattatttaaaaatagttatttgatagacaaaaatattatctcattcttaaacatgtgcatatttctgattactgttaagtttactgtttttattttgttttttttaattatactttaagttttagggtacatgtacacaacgtgcaggtttgttacatatgtatacatgtgccatgttggtgtgctgcacccattaacttgtcatttaacattaggtatatctcctaatgctatccctcccccctttccccgaccccacaacgggccccggtgtgtgatgttccccttcctgtgtccatgtgttctcattgttcaattcccacctatgagtgagaacatgtggtgtttggtttttttgtccttgcgatagtttgctgagaatgatggtttccagcttcatccatgtccctacaaaggacatgaacttttttatggctgcatagtattctatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcaccacgctgacttccataatggttgaactagtttacagtcccaccaacagtgtaaaagtgttcctatttctccacatcctctccagcacttgttgtttcctgactttttaatgatcctcattctaactggtgtgagatggtatctcattgtggttttgatttgcatttctctgatggccagtgatgatgagcattttttcatgtgtcttttgcctgcataaatgtcttcttttgagaagtgtctgttcatatccttcgcccacttgttgatggggttgtttgtttttttcttgtaaatttgtttgagttctttgtagattctggatattagacctttgtcagatgagtagattgcaaaaattttctcccattctgtaggttgcctgttcactctgatggtagtttcttttgctgtgcagaaggtctttagttgaactggatcccatttgtcaattttggcttttgttgccattgcttttggtgttttagacatgaagtccttgcccatgcctatgtcctgaatggtattgcctaggttttcttctagggtttttatggttttaggtctaacatgtaagtttttaatccatcttgaattagtttttgtataaggtataaggaaggggtccagtttcatttttacttttattttgagatggagtttcactgttgtcacccaggctagagtgcaacggagtatctcggctcactgcaacctctgcctcccaggttcaagtgattctcctgcttcagcctaccaagtaactgggattacagatgtccgccactatgcctggctaatttttgtatttttagtagagacagggtttcaccatgttgaccaggctggccttgaacttctgacctcaggtcatccacccgccttcgcctcccaaagtgctgggattacagatatgagccactgtgcctagcgctgttttcatatttttaagccatatttccttcttcctcatttatgtgtccttggataagttatttaaactatctgcactttactgtcttcatcttaagttgctttgtaaggtcgctgaagaccaaatgagttagtatatttcacatactgggaacagcaggtgctgaataaattcttagctactattactcttagtccttggtatgacttttgtccactttctcagttgagtagctgagactacaagtgtgagtcaccacacccagcttattttttttattttattttttgtaggaatggagtctcactatgttgcccaggcaggtctgaaactcgtggcctcaagcgattctcccaccatggcctcccacagtgctaggattacaggtgtgagccacagcacccagccccatatttccctaaagactagcagaactcacctcaggctgcactgtcaggaggttgtaaagaagcctctttttgagggttcctattatctgtgttagaggcagaaacttacccctctcctttcattcattcactcagcagggatttattaaacctttatgaaatccaggcactgctttctgctgctctgaactcaatgctgatttgttattgattctactgctatattttggtctcccaaacaaggtaggacagctttccttaagggccttcaacccaccatgatgatagcagctattatttattgaatatttatggtaaggcattatattaagtgatgtacatatattattccaaacaatgtttttatatgcaaaatttacagatgaggaattcgaggcttaatgagtttgaaaaatgtgcccaagatcacatagttcataagaggtagaaccagaattcaagcttgggccagccaactgcaaaatccaagcctcttcattgctttactctgttcctcccatgaagtcaccctcacaatttctcatttgttctctcaagcctttgaggttagcctagatgttccttcagatttttcattagtatttttttgatttatatttagttaatgcataagatgttagaattattaatgcagttgctatgtgatttgctttgggggaagtatttatccagtagatctctactgaagacattggtgcttgtaccggttctctctccaagacaatactgatttccacacttccaaaacaaagttaagatgtaaaaacagagaatacagtgtgggaggaaatcttgaagacttgtgtagaggaatagaagcaaatgtaaacaaaataaataaattagcctccctctttcacactcccatattgcattgtaacactgtactgatttagagaaaaaatattataattaacagcatatcagggatagatagaatggtagaggaagaagaagctatacagtgattaaagacataaagtactgttttgattgaggtggaaaagcctgcagagatgattcacaaagctataaccagagcactggatgagcaagaaaagatttgaacatgaggtgttgcctctgaagtttccagaacagggaaggcttaggagaaagtcagtggatgaagagatgccaagtagaccagagggaaaaatggaatcacaagatcacctttcaaaggccgaagagagagggattgatcctgaattaataagaaagagaggtgtcccctgtgatgagtataaaggggaacaggtgacctgagagctgaaccagaggcaatatcaaattagtcaaggcaaggccgggtacagtggctcatgcctataatcccagcactttgggaggctgaggcaggaggatagcttgagcccagaagtttaagaccagactgggcagtatagtgagaccctgtctttattttttaaaaaatagaaaatttaaaagaaattagtcaaggctaaggtggtgtaatctgaataatcttttgaagtcctttgtcacctagataggctttttgtattctccacagtagttcaacactctgcatgatgtatgtagcatttcatgtcctgtgcaacagcagaatcacaatgtagcactaaatgccactttccttatgcacacccactgtccttaatgtgttacttagcatcagctctatgcatagggtacagcctccttcccagttttcagataaagaaactcagccttagaactgtaatgtaatttgtccagtagcccctagactctcagatttagtatttgtcagactaccccctaaagacagggtactttagtaaaagcaaaagcctgtgtccctaagatttagcctaaggagaaagttctactttctctgtttgttaaaacttgaaaatgcacacggcaacatggcaagaccccatctctacaaaaatttaaaaaattagccaagagtggtggcacacacctgtggtcccagctactcgggaggcaggaagattgcttgagcccaggaggttgaggctacagtgagccatgatcataccactgcactcagcctgagcaacagagcaagaccctgtctcaaaaaataaaaaataattgggaagtgaatgtgtccaagtgtcttcttctcttttattttgtcctatgacttctccctcccaatcctgcaccaatgccatagggaaaaagatacatgtatctttattaagataaagataatctcaatgtgctaatggggatgaagtctgttgttaaattcatcattttctaagtcttctgagaggtagtatttactctttggattgagctttcagacctatgcattgggaaaatgtcaggccatttaaactagaaaaagtagcttttaattgatgaagacctttgtatttattttccctgagtagcctcttgttccttaaaaccgggaaatagaaggcaatatttgtcacaaaaatacttctagcaagcaattgaaaatttaatttttctaggacccttattggggttgtgcaggagcccattctctgagtgacatctctgataatcgtaggcctgagcatgtttattcatacatctgaagcccagagagcaaatgcctgaacaaatggtattgcctgtgtctacagttgaaggatggttcaatgttaccagtttgttgatacgctgaaaaccaccaggaaattgcctccaaatacctttgacatagatttggacaacagaaatatttttacatcagttgaggtaactggatttaatcactggattaaaaaccacctttactaaccactatagagaacagatggaggttgctcaaaaaactaaaaataaagctaccatatgatctagcaatccaatttctggatatatacccaaaagaaagggaattagtatttgggagagatatttgcactcccatgtttattgcagcactattcacagtagccaggatttggcagcatcttaaatgtccatcagcagatgaatggataaagaaaatgtggtacatttacacagtggagtactattcagccataaaaaatcagtttctgtcctttgcagcaatatggatgaaacttgaggtcgttatgttaagtgaaataaactaggcacagaaagacaaatttctcatgttctagcttccacttatttgtgtgaagctaaaaattaaaacaattgaattcatggagatagagagtagaagcatgtaccagagactgggaaaggttgtggtaggggcaggcattgggggacaaggggatggttaatgggtaccaaaaaatagttagaatgaataacacctagtctttggtagcacaacaggatgactatagccaataattgtaagagttaatgaaagaggaaagaaacacaaaatgtggctggacagttaaagagagaattattttagataaaataaacttgagaggggcttctggccaattttggtcaggagcactttctcttacaggcttagagtggttttagggtgaggaggcttatcacaagcttagaatgtttctgtgtgagggagaagttttatggtggggttggactatctctgcctagaggggaggttatcttggggcagacatctttccagctcggaggagggttatcttaaggctggcatcttcccagagggtttatctcagggctagcatgtccccggtcagggaggagtttggaatgtttctgctgggagatgttatttggtttatagtcatgctgaccttagccattaggctgatgccctttggatttaggcagtttttgattacggtgaactttagaatgagcggcttgtccaagatggcgatgttcctgctctgtcaataataatttaattgtaaattttaaaataactaaaagagcataattgaattgtttttaacccaaaggataaatacttgaggtaagggatattccatttaccctgaagtgattattatatattgcatgcctgtatcaacatatctcatgtaccacataaatatatacacctgcaaaaagaaaaccaaaaaccacccgttctaagataccagtttaagtgtaaataattttaattagtgggtatgtgagaaggggaggagatttcttgtactacatagatggcttctaaagttaaactcctccattacgtttatagaaagaagaattggagtaaggaatgacttgataccaatattaccaatatgtgtattgacatcttgtgagctatataatattatgtctggtgtatcctgtaatacagaggttgacaaagtttttctgtcaagggccatgtagtaaatatatttggctttgaggccataagatctgtgttgcaaccactcagttctccataaaagcagccatgaacaattcgtacaagactaagtgtggccatgttccaataaaattgtatttagggacactgaaatttgaatttcatgtaattttcgcaacatgagatgttcttcttcttttgattgatttcaactacttaaaaatgtggacatcattcttagctcaagaaccatacaaagaggcagtggatcaacttaggcccatgagctatagttggctgatctctgatatagtctgtgtggttagagcggggaaggtatttttataccagcaaaaacgttatgctttctccacaagcctggtataaaaattgggaatgcgctacagatgccacttggtagaaagctgttttattaaggtttctgaaaattagacttgccaacacaaacattaaccttcgctccctttattcagatgttacatttaaatttttacccagacctgggaactgagtaaaattataattatgatagacacagggcccttgaactctttcttttggctgttttgaaaggtcgttgtcttcatgttaattaggagccaggaacattctgcttcagctgcttgttgggaaggcattatcattagggaaatgatctaatcaagagtttgcatgggaggtggggtgtgggcctggaggctaggaaacctgagaggttgaattacagggacacgcaactgataattataataaacttctccctagacctgaatgcacagcttggaacctgtcagttttcacattggaattattatactcaaccaatgacagtgtatttggtgatatgtcaacattttcattctgaatgagtgttaattgggtattttagtgcttgaaattatttgttaccaaaaacactgacacagcctgacattctctgctttttataattctgtagcacctataaaatttctttctctagatttaattgctttatacaaaatatgtacgtcaattaatcagagctgtaattattagactccacagttggccgggcatggtggttcatgcctgtaatcttagaactttgggaggctaaggcagggggatcacttgagcccagaagttggagaccagcctgaacaacatagtgagaccctgtttctacaaataattttttgaaattatacaggagtggtggtgtgcgtctgtgatcccagctactcgggaggccgaggtgggaggatcggttcagcccagaaggccaaggctggagtgagctatgatggcaccactgcactccagtctggggaaaccctgtctcaaaaaatagaaaatagactccacggtggcctgacggttaagtatgcctaaatcagccattcacaggtcagggggttctgaaaggggctcttcagaattataaacttcaattttaaaaccaaaaattacctcccttcctctttctgctcccaactccttagaacaaatttgagttgagtgcctgccagcccagggctgttctaggtgctgggggccaacagcacagaccagtgttccaaagccaggaacccgggctttcttccagcagacttttattgtaatgcatccatttgcttactagagagaatttcttctgtgtgtcagttttttattgtaaattttgaggcttactcttgagttctccacctgaaatcaaatttggctttgtcttttcttaaaaattattttattgtggcaaaacatacataatataaaatttgccattttaaccacttctatttatttttatttatttattttttgtttgttttgagacaggggtctcactgtcatccaggctggaatgcagcggtgtgatcttggctcactgcaacctctgcctcccaggttcaagcgattctcgtgcctcaggctccctagtagctaggacaacaggcgttcaccaccatgcccagctaatttttgtattttttggtagagacatggttttaccatgttgaccaggctggtctcgaactcctgaccgcaggcgatccgcctgcctcagtctcccaaagtgctgggattacaggcatgagccactgtgcctggccccattttaatcacttttaagtgtacagttctacagcactaatccatcacattgtcgtacaaccatcaccactacccatttccagaacattttcgtctttcctggctgaaactctgtgcccattaagcactaactctccattctcaccactccccagccccagcacccaccattctacatttctggacaaggggacagggtttcactctgtcacccaagcttggagtgcagtgatgcgatcatagcacactacagcctcaacctcccagtctcaaacgattatcccatctcagcctcccaagtggctgggactataggcatgcaccacctcgcctggctaatttttgtattttctgtggagacggaatttcaccatgttacacaggctggtctcagactcctgggctcaagcaatcctcctgtcttggtctcccaaggtgctgggattacagctatgagccaccacacctggcccactattctaccttctgttcctatgaatttgactacactggggatttcatatacatggaattatacagtaggttcccttttgtgactggcttatctcagtttgcataatgtcttcaagatttatcagaaactttacattcttaaaaagttttttcaatgtaaatttttagttttaattcaatcaggttaaaggtcatatctcaagaatgaacagtgttcctcattccttcttaaaatatttttaaaatgttttttgaaccaccaaatggcattttcattttgttttttcttagcaaaaaaataaaaattaaaaggtcttattggttgaaaacccttgaatattacagtctaactaggagaaccaaagtacattctttgcataggggtcaggaactattttaagaataaattcttctttactttctaaagtaaatgagaaattgctaacttgaaacatgtgtttttcttttttttttttttttttttgagatggagtctcgctctgttgcccaggctggagtgcaatggtgcaatctcggttcactgtaacctccgcctcctaggttcaagcgattctcctgcctcagcctccccagtagctgagactataggcacgtgccaccacgcccagctaatatttttatttttagtagagtcagggtttcaccatgttggccaggctggtctggaactcctgagctcaggtgatctgcccacctcagcctcccaaagtgatggggttataagaatgagccaccacgccccgccaaaacatgtatttttgaggttaggtttagagaaagatgcatcataatattcttaatttttcagcgcattaaagaaaagatgaataggaaaggagataaataacatcccaactgggggatcctacttttaaagaaaatgtgtagacttttcaccatgcgatcctcatacaatcttgatcttatattaattagcatatttcccctatgtgcggaaatctgtaatgcccttcctctgtggtgggctgccttgctttgaaaacaccaccaggagcccctctgaagaatgacagcagcaggtgttctgagagaaagtagtgagatggacagagctgtggatactaactgcagagaccaagtctccagacacagggccagctggggaaattctactgctggctgccattccttggttctgttgtcagtaatcacaggtcacaagcctcgcctctcctgcctactagatggttcattttggccgggtgcggtggctcacgcctataatcccagtgctttgggaggccaaggcctcccaaatgtatgaactctcgtacattactggtatataaattggtaaaaccatttggtaatatacctattaaggctaagcatgtgtatgccctatgatccaggtgtcaaaagacatgtataagaatgtagcagggcaccgtggctcatgcctgtaaccccaaaactttgggaggctgaggcgggtggatccggaggtcaggagtcaagaccagcctggccaatatggtgaaaccccgtctctactaaaaatacaaaaattagctgggcgtgatggcgtgcacctgtagtcccagctactggggtggctgaggcaggagaattgcttgaacctgggaggtggaggttgcagtgagccgagatcaggccactgctctccagcctgggcaacatgagtgagactccgtctcaaaaaaaaaaaaaaaaaaggttcattttaatgtaacttagttgactgtagaatttggaatgtgaagggataggattgtattaatgagtgttgtgttcgtatattacatcatgctgtacccacagaaacaggtcctaagaaatgctattctctaacaatacacattcatgatgtggctcacccagagcaccaaaaccctgctggccatagcaggtagggtccacttatccccggcatcgcctgggacatcatatggacatgttcttttacttggttcttcatgacaagcacaaaagcataacttgagaaggattgaacttacattagaatgagacttttatgtatttttataatatcgtcatcttaagcaaaattaaatgtgttataaatgatatatggtggacctctgatgttcatgtgtgtttttcacctcaccgaagaatgctaaaaattaatcttaaatatagcaaaattacagcaacaataataataaaatatacttgctcagaatggatcttgtgtcctccagcattgtctagaattttccagatttttcaggagggctgtctcgtctcataactctgtgaatgtatatcactccagaactgccttttttctctgcttagacagttgtatctttctttgtattgagtattcttcggtgagttagctcagtgcctctttttttaaaattttttattttcattttaagttcctgggtacatgtgcaggatgtgcaggtttgttatataggtaaatgtgtgccatggtggtttgctgtacctatcaacccatcacctaggtatgaagcccagcatgcattagccatttttcctaatcctctccttctcccttccccacccaccaacaggccccagtgtgcgttgttcccctccctgtgtccgtgtgttctcattgttcggctcccaattataagtgagaacatgcagtgtttggttttctgttcctgtgttagtttgctgaggatcatggcttctagctccatccatgtccctgcaaaggacatgatctcattcctttttatggatgcatagcatttcatgatgtatatgtaccaccttttctttatccagtccatcattgatggacatttggttgattccatgtctctcctattgtgaatagtactgcaatgtacatacgagtgtgtgtgtctttgtatagaatgatttatattcctttgggtatatacccagtaatgggattgctgggttaaatggcatttctggttctagatctttaatgaattgccacaagcttggtgtctcttctgtgttttcctagcccacaggatggcacgggtgctgtttcactcatgatggcatttcccactggtaggaaatatgcatgttatattatatgtgacaaaatccatggaacactcaccaaagccacagaagttgtatttttacctgcttaacagccggtgtcatccaaggtttgatgtgacagacacatactttattctgttagctacaaatatttattctggtacaggatgtgtttaaaggcataggcaaaggccacattatacaggtaaggagcatggattttaagtggaatagaaagaaattgaagtcttctagatagaggaatgaaacgatctgctgtatgtctgaagatgaacctggccactggaatatagaggggctagcagaagtgggtataagcagagagactaattacaaaggcaccgtaagagtctacgcagtacaggtgagtgacttgactagggttgtggtagtggagtgggaagagtgaggcttgttatgttcatagaggtgtataacagagcaatatcgtcttcatgtgccaagccctgtgctaggtcttggggattcagcagtgacagaggcaacacaaatccctactttcatgaagctttcatattagcagcgaggggtaaaccataaataaatacataagtatgtagatggtgcaccagaaggttggggagatattaagcagagaagaggaatacagagtagcgaatagagtgccattgtttttttttaaatggaatcttgctctgttgcccaggctagagcacagtggctcaatctcgactcggtacaacctccgcttcccggattcaagcgattctcccgcctcagcctccagagtagctaggattacaggcacacaccaccacgcccggctaatttttgtatttttagtagagatgggatttcactatgttggtcaagctggtctcaaactcctgacttcaggtgatctgcccacctcggcctcccaaagtgctgggattacaggcatgagccaccacgcccagccatagaatgctgtttaaaatgccacagttatttatgtaaaatctgtgatctttcacattgttaggagaaggtaaaaagtgcatccagaagcaaggttatcagggccaaagaggcaccgtgttcccaaggaacctgtagtcactggtagagtcagtactgagactcccgaagatcaataggaccagcatatggtgtcttggccatatcatcacgatctgtggtcatgttttgagggcaacttgaatatttttcatgataaaaatatagtgtacctctttttctgtaattgaaaaacaatttccaagtaatggctgtgtatattacgtgaaaaattaccacagaaatcgagagtggagaaaggtatcccaagtctttcatagaaaatgacctggaaattttccttttaaatgtctctttttaaagtagtatgaatatggttggccaggcgcagtggtttatgcctgtaatggcagcagtttgggaagccaatgggggtagatcgcttgagctcaggacttcgagactaccctgggcaacgtggtgaaaccctgtctctccaaaaaaagaaaaaaacaattagctgggcgtgatggtgcacatttgcaatcccagctacttgggaggctgaggtgggaggatcacttgagcctggaaggtggaggttgcagcgagctgagatattgccattgtactccagcctgggtgacagagtgagaccctgtctcaaaacaacaacaacaaacaaaaaacaaaaaaaacccacaaaaccaaaaataaagtaatatgaacatggtaaaaaaaaaaaaaatcaagcattacaagaggttacccagtgccaggttaagtccctcccatctctggctgctggttcctcagttttcttccccacaagcaaccacggtgaccaggttcttggtgtcactctggcattgtggttctcaaccttggctgaacagtagaatcacatgcagaactttgaaaagaacagttgccggctgggtgcggtagatcacgcctgtaatcccagcactttgggaggccgaggtgggtggatcatctgaggtcaggagttcgagaccagcctggcaaacctggtgaaaccccatctctactaaaaatacaaaaaaaattagctgggcatggtgacggacacatgtaatcccaggtactcgagaggctgaggcaggagaatcatttgaacccgggaggcagaggttgcagtgagccgagattatgccactgcactccagcctgagcaacagagagagactctaagaaggaaaaaaaaaacggttgccttatcccacctccagaggctctaattaaattgcttttgaatatgccatagagatttgtaatacccccccccctcgccccccacaggttttaaaaatgtgcagccacttaaatgttctagagctagcctacatactcataaatgtatgcattctttaaaatgcacttatcaaaaaattagctgggcgtggtggtgtgtgcctctaatcccagctactagggaggctgaggcaggagaatcgcttgaactcaggaggcagagcttgtggtgagccgagatcgtgccaagccgagatcgtgccactgcactccagcctgggtgacaagagtgcaactccatctcaaaaaaaaaaaaaaaaaatttattcaaatgacagcaaaacggtgtatttctaccaatgatagaaaaatactctctgatggttttttctttttctgatgcttttttctttttaacctgtaaaatacatcttggagattatttcacattagcatgtatcgctagagataacttatttttttatatgtccaaatgatatgccatcatatggatgcaacataattttatcagtgccctactgatagttatgttattcaaagtaatctgttatcacaaatagtgccataacaaatattcttatatatatatccttatgtacacatttgtatatatctataaaagtcccagaatcagaattagaattatggatcaaaggtaggttttcagttttgataaattctaccaaattttatccataaggggcaatgtgtgagaggaccacactaacagtgcattcgctttgcttgtaatctttgccaataaaaattaaaactagtgttgtctttgattttgccctgttttaacatcaggactaaacttaggcattttccattagcttaaaaccgtttctttttctgggaatgtctctccttcccctgcttttttggcctatttttctagtgggttgttggtgtttttcttattgattataagatgtattaatatatgaaggcatcaaacttttgtcagcatatgatgacatattctgtatatatcatcagtatatgagcaactttactgttgctcttttatttatgatttttttttttttttttttttgagacggagtctcactctgtcgcccaggctggagtgcagtggcgccatctcggctcactgcaagctccgcctcctgggtttgcaccattctcctgcctcagcctcccaagtagctgggactacaggcgcccgccaccatgccctgctaatttttttgcattttttttagtagagacagggtttcaccgtgttagccaggacggtctcgatctcctgacctcgtgatccacccatctcagcctcccaaagtcctgggattacaggcgtgagccactgcgccctgcctttatttatgatttttaatctgatatagtaaaatgtatagcttttatgttttggagtgtttcaagtatcagttggtaagagagctaggtactggaagctattggagaacagagaatatgtcatctatattcttagatcctcagtgcccagcacatggtagataattgttgacagaatagttggatgtaaatgtgatgatgatgatgaaggatcatgaaagttgatcccaggtattcatccagaagaaattaaggcagtaacagtattatcatcatttaattcccttcataattaaacgctccagcgtataatcacggtgtataatacttctggtataaactgaaagtactgagtttcagaaggcagatctagctgagtcgtctcagagccgtcatcttggtcactaagctcttgctccttagaaactcgaagatcctccaccccttcccattggtctttctgcctcggaatgttgttcccttgcctgtatctatgactgtttcctgccagctgcaaaacacagcctaaatatctatttccctttagaagcttcttctgagtcccatcttcatctccctgccatcttccctcatagtgtcccatggctttcctttatagtagttatcagaactgtcataaaataatgttttgtgttacagcctctgtgatgtgtctccctcactcgactgggaaccccaatcacttcttcttccctcatgtccactgggagtgctctgggattggggaacagaggtaaacaaaaaaagctccctgccctcctttgagtattacattctactgtatatatgtgttgggaaaaggagataataataatactgagttgtgcatcatttccaatgattgtcatttaaatgaagcagaaaagccagtaggtgcatttttggcttggagtatctgagtctggtttgtgtcttaatagtagaaggatctagcacataacatatgcatacactaccaggctgtgagactgtggtcaccctcgtgcaagtcaacagacagctgtcagcatagtcaccgagccatttctttctctctttttttttttttagcgacaggctctcattctgtcactcaggctggggtgcagtggtacaatcaaggcttactgcagccttcacctcccagactcaagtgatcctcccacctcagcctcccaagtagctgggactacaggtgtgtgctaccatgcccagctcgttttaaaattttttgtacagatggggtctcgttatgttgtccacattggtctcaaactgccgagctcaagcaatcctcctgcctcggcctcccaatatgctgggattataggagtgagccactgcacctggcccaagccatttctcatccttaccaaaatgtattcttaccaaactgtcaggccatttttgccctgcttgatggaagttttgctatcattaaagtccattacaccttcaaatgcaaaatagagcagatattttcatgcaacaaaagatgctttttcatttgcaagacaagaaataggatataaactacttttgaccaatggtatatgtccagtattttattaaacgttctgaatatagtctagattttctaatattaatattatatatctgtggcacatttccagctaaataatctaaaatttacagcctttttaaaacacagaggtgaatgaaccagattgtctctagttctgaaatcacctcctgaaggtgggtttgctgcttaagggatacattaactatattaggtccctagggtactttccagtgctttatttctgagtactccacaccactggcatttttccagacaaatccctgatggtgtagcctgtttttttaatattaagtctctctgaaccaaagtcatatctttccagaaggttagacttttagaacagtatattaatattttactaccaaattactgggtcattttggcctgcttaagtacctaacctagtaccaacaaattatttaagcaatcataggagaaaaatccagtatttcaggtagacacttaaataatcatttctatacattatacacagagaaatttacttcataatcataaaattttatgtctaagtacttttcttttaattattttcttgcctgtcataattcccatagcaacctttactttgttctctgtttttcatgtgcataaagaggctttcaggagacctggtccttgcctcccttccccatatgcaaacaactacgaaggtgaatcaattacagaaaatatgtataaatcatctcttttacaacatcaaaaatattttcagggtactttgtgagaaatttcaattgcaataggaagggccttttattcacaaacataggaacattacaggaaaagaatttaactgaactcccaacattttttgagaaaatggaatccaaccttatctcttctgttactgtttttgtttttttgagatgggagtctcactctgtcacccaggctggattgcagtggcatgatcagttcactgtagccttgaactcctgagctcaggcagtcctcctgcctcagcttcccaagtagctaggactgcaggtgtgtgccaccatgcctggctcatttttaaaatgtttttgtagagacagggtctccctatgttgcaaaggcaggtcttgaactcctgggctcatgcagtcctcccacctgggcctcccaaagtgctgggattacaggcatgagtcactgtgccttgcctctgttatttgttttacatacgtgaatgtatgtatatatagaaatgattcagttttgtttttgttgttgttttctggttttattaaatacagtcatcataaacatttgcctgtaatcatctttagtctttgtaactattttcaaggttatctaatagtctactaagcatgtgaaccataattttaaaattttcttaaactagttcctagaagtgaaattaatagcctaggtacatctaaatgcatgtctagttacacatagaaagtaaattgtcttcccaaagggttgcgtgaaagccaaaaactatcaacaaggtgtgaaagtatcaatttaagtgtgtccccctgacattgtgaattgggactttgcaaagagcattggtttaatgatggaaaatggtattgtgtttaatttaatgaggttgaacatcttttccagatgcttatggctaattgattttttcgtgaattttctattaatatcctttatttatatcaattcatttcttactgttttacttatcaattagtgtgccttttatatatgcaaagaaaatgttaaacagtaaaatatttaaggactgaagccatatcccttttcacaagtgtgtagttccctggagaacacagaagttagctgttcattcatgcctgtagattaattgttcattgccacccgggagaactcatcttggaaggaaagagcccagattcatttgtttgattgtttcgctgctcaagaaaaggcctggcacttggatgtaccatcttttgacatggcctttcttttcttgagacggagtctcactccttcgcccaggctggagtgcagtggcatgatcttggctcactgcaacctccacctcccgagttcaagtgattcttctgcctcagcctcccgagtacctgggactacaggcacccgccaccatgcctggctaatttttgtatttttagtagcgatgggggtttcaccatattggccaggctggtctcgaacacctgaccttgtgatctgcccaccttggcctcccaaagtgctgggattacaggcatgagccacggggcccagccaacatggtctttctttggtagtagagagtctattaagatattctagagttttatatttatttgtccagttattcagttgcattcctttatattacccaacattgcttgaagaaatatcttctccctgtattggcttgatttttgaaacattctgaattattataagttatatgtatagtcatattttctgctgtaaatttgaactccatctctataggaatgtcaggggtagtgcataagaagtaaatcaacagtcactcacacaatatgttatatttacaatatattcgcaaccatctgtaagaaaatttgcaagtgcattctttctagtagcttcaatttagtatactcattttacaaatgagagaattagccagagaattatttacatgccttgcctttggctatgcaatgagtcactggtacttttaggattggaactttaagttcctggaatgaagaagcagaattaatgggaaaagaagcttcacaaaaaataagttgtaatcatattttcaaaatataaagtctctcttagattcactggaaaaaggatgctaaacaaatttcaagtacaatgactgtttttggagtggcttgcttgttatgaaacatggttatttaatcaactggcctatagttgacatttgcaccaagttaattaagttggcatttgtggaggtttgtgataaaacactggggatagcttcaagctgaagcctttgttttattctttattcattataaatatttatcatccgttcatcatggaaagtcacatttctgtttgtgttttttaattaagaaagagacactagcacatttaggaatgtttaagaatgtttaggaatgcgaaaatggatcgggagagctttcttgtaaattgggagagctttaaactataggatgtaagagagaagaggttttctctctttcagtccttattcattcattccacaaatgtttgttgagcatgcattccatgcctggcactattccaggcacttgggatataggagtaagtgaaacatttaaaaaaatccatcctcgtgggtgttatatcctaatcaagggagacatatactaaacaatatcgtaagtaaattatatgttagaaggtaaaaacactaataggctgggcgtggtggctcacacctgtaatcccagcactttgggaggccgaggcacatggatctcttgaatccaggagttcgagaccagcctgggcagcatggtgaaactccatctctacagaaaatacgaaaaattagttgggcatggtggtgcgcacctatagtcccagctactcaggaggctgaagtgggtggatcccttgagctcaggagacagaggttgcagtgagccaagattgtgccactgcactccagcctgagtgacagagtaagaccctgtcaaaaaaaaaaaaaaaaaaaagaaggtaaaagcactatttttaaaaaagtagaacagggtaagtgagattggaaataccgctgcaatcaatgggggttacaatttgaaataggatggttgcagaagacctcattgagaaagattttgagcaaagacttagaggaggtgatagagttagaagggtagaaatctaggggaggagagtgtctggtacctctgaggaatatcaaggggcccaacaaggttagagccgaaagaagggagagcgaggtggcagggagagggtgtagagatcagcggaagaggacgttactaacaaaggagacttagaaggaacagccaatgggaaaagagaaagaccaagagggagtggtttcttggaagtcaagttgagaaaatgaagagaggacaggggatgatcagtgatgttaaaggctgctgattgctggagtaagatgagcactgagaatcagccatcgatgtagccttagagacatcattgatgaccttgatgaacagttttagtggagtggtaggaggaataggaggaagtatatttaagagagaacaggaagagaagagttagagggagcagagccaactttttctatgcattattttttctgcaaaggagaggggaaaactggacaagagctggcagagaaaatggagtcaaggaaaggttttcttaggaagagagaaataatcacgtgagtttgctgattcaaatgattcaatagaaaaaccctaagtgtagtgacatccatgcagtttctggagtacctgtaaccagcatgaatttctagaccaaaaattccctacatacaatttattcactccttttctcccatttcattgaattttctgcagctatgtattgagacagttcaactctcccaagccactatttttctgctccctgcctacttgttttcaatttcataactgataagatagtttgtatataaaaaattatattagcatgaaaaaattcttgtcattggctggatgcggtggctcacacctgtaatcccagcactttgggaggccgaggcaggtagatcctctgggttcaggagttcaagaccagcctgaccaacatgatgaaaccccatctctactaaaaatacaaaaattagctgggcatggtggtgggcacctgtaatcccaactactcaggaagctgaggcaggagaatcgcttgaacccgggaagcggagattgcagtgagccgggatcgccccattgtactccagcctggatgcagagtgagactccatgtcaaaaaaaaaaaaaaatcatgtcatctgtcatcatcagtagatatatattaaaggcctagaaaattttcccaaaacacacatacacatacataatgttctaattttttaaaattacttagcctatgactgaaatccaaaactcaaaataatatcaaaattgcccctctaattttaactttttcaaaatggttcctttggacaatgtcaaattttgcaaatattgagcagaggctcttctataaactgtaaatagccatcataccctcatgttaaggaataatttggtggtaacagcattttgatatgttcgttttttaaaaaaatgaaagtcacatgtctgaacttcttgcctactatttgtactttataataacttcagcttcagtactgaaaaccagcaactgttccttttgcactgaaagaagacacttgaatcctagccactttcaggcaggatgagctgccgaccagtctactgaaggccagcttgccaaagttctattcattttcagcaaagagagaaaaacttaaatagccggtgtcttggcttctattgttttccgattctaatctactttcccttgtagataagtaatgaaaagaatgcttggtgatgctgagatactctgaagtgaggaaaatttcagaggagcagccaagtctttccacaaaacagcattctattaatgaatgtaaaatgagccctcggtgtactttcgttgtgcctttttggaaagataaaatttgaaatttttgtttttccaagtaggagtctcactctgttgccaggctgaagttcagtggcacaatctttggcttactgcaacctctgcctcccaggttcaggcaattcttctgcctcagcctcccgagtagctgagattacaagcgcccaccaccatgcctggctaatttttgtatttttagtacagacagggtttcaccatattggccaggctggtctcttggccaggctggtctcgaattcctgacctggtgatctgcctgcctcggcctcccaaagtgctgggatttcaccgtgagccactgcgcctggcccaaattcgaaaatttatagatgtgtgtgagagagagcaagcgagcgtgcctaaagcttagcaaagacatagctaagcattacaaaactatcacgatgcctttatgatcgttagaaatggctatacctatgaccaacaaacagaaaaaacatatgcttttgattaacaaaaacatcagatgcatgtaggaatttgtcctagcttttctttttatgagcagacacatgcatggcacttgaaatttgactgctaaaggtttactcctaactctgtggatccaatttgttatatactcattttacaaagggaggaattagccagggagttatttatatgacttgcatttggctatgcaatgagtcccctgcttcgtggccttgctcaggtagcttctctatgtctcagttttctcatcagtaaaaatgaagataatcgaaattacattaggtaatacttgtgaatcagcacagtacctgacacagtgtaagcatttatgaaatatttgcaattattatcattaataagatgtattattatgtgcatagcctgatcttaattgattatcctcattatgagtataatataaaacaatcttcaaaacgcactcttttagcctctaagtaattgtgctggactgagaaggaagaaaatacaagaactctgtttatattctccggagacatcatgtttccagtaacgtggagttcactaacaacaacttaaatgtaactccgaattaaggaactcacacaggctgaaggagtttttctgggaggtaatcccatgttgatggagtctcacatgtgtattccaggagtgcctgagtatatatcacatgcagagtgagagaaaaagagaagggagagagagagagagactgaacaagtttaaataaatcttactaaaaattaatgttagcatgttagatacactgacctcttttcaattcctcagacatgcaagcatttcttgtacacaaggcctttgcatatgatgttctttctgcccagacatccctcttctcaatgcgttgcagggctgagttttttctttcatcgtttagatttcagcttagtgtcattgcagactgtcatctcattactctaactaaaataccatccctcccaccatcattttattatctcagctttttttcttgtctctcatagccgttatttttctggtgccttttaaaaaaaaatcagtttccttcactgagatattaagtttcatgacagaaagctttaatcttttttacagccctgttttcagtatttagctcacagttacagcacagagtttcaaagtaataagtactcaataattgcatgtagtttggggagttgttaaataaaatttaatctcttcattagtacatcctatagctatatgtttataaattttcatattgtcttgagaaaattgaaactgacattttggcttttacaggatcataaaagtatcacacagggatgaccctgcagcgatgtattgctatcacctctgttactattttgacactcagctaaatgataggtcaatcacatttgagattttcatcatcgtatgaatttgaataataattacacgacagtttgcaaactaaggtatacaatgtttatgcaactgtcccgcatcttggcacgctatgtcatttttcagtgtttagagtcaggatctctcatcagtacatagttgatgattttattgttattattttgagacagggtctccctctgtcacccaagctggagtacagtgttgtattctctgctcactgcagcctctgcctcctaggttcaagcgattctcctgcctcagcctcccgagtagctgggaccacaggcacctgccaccacgcctggctaatttttgtatttttagtagagatggggtttcaccatgttgccccggctggtcttgaactcctggcctcaagtgatctgcctgcctctgcctcccaaagtgctgggattacaggcatgagccagcatgcagcccatagtttatgattttatttatgaagaaaccagtaaagcagagaatagcaattcagatttcttgcatctacattgcaccagagaacagaaggtaattctaaactgtgaaaagagatgacaacaccatgaaaaatgaaagaattatctcccttcccccacagacaatacaagatagaaccctttccccttggtcctggcccgctgaagtctatcccattttgattgatgattgattgagacggagtctcgctctgttgccaggctggagtgcagtggcacagtctcagctcactgcaacctccacctccagggttcaagcgattctcctgcctcagcctcccgagtagctgggattatatgcatgtgccaccacacctggctaatttttgtatttttagtagagacagggtttcaccatgttggtcaggctggtctcgaactcctgaccacaggtgatccacccacctcggcttcccaaagtgctgggattacagttgtgagctattgtgcctggccccattttgctttattttaaaatatgtgggcctgaccagcaagcaatgagtttgccattgggtcagcatcgtcctatgcatgaggaggtggtctaaaatcttgaggattttgatgagttatagctttgtctagaatcagactggcctttggattcataaaaagttgattttgctcaagaacatggctttaaggcttcatataaagatttcctacagaaagagaagaacacaatttgggatccaagatgccgctatgaaataggcttacaactcttatcttttgggctttaaaagagaaaaatacaagaatgctccaaaatactgatgctgaaaatatagatgactgtgaaacagcagagtacagcatcaaaacagcaaagtatataaattttttaaagcattaaagaaaaagggtggccaggtgtagtggctcaagccagtaatcccagcactttgggaggccgaggtgggcagatcacctgaggtcaggagttcaagaccagaccggtcaacatggcaaaaccgtctctactgaaaatacaaaaattagccgggcctggtggcgcatgcctgtaatttcagctactctggaggctgaggcaggagaatcacgtgaacctaggagacagaggttacagtgaggcaagattgagccactgcactctagcctgggcaacagagtgagactatctcaaaaaagaaaaaagaaaaaagaaagggtgacgctttcttgtgtgaacgttagacataaaagtggaaaaacaatgaaaccccgtctctactaaaaatacaaaaattagccgagtgtggtggtgcacatctgtaatcccagctactcaggaggctgaggcaggagaattgcttggagccaggagatggaggttgcagtgagctgagatcatgccattgcactccagcctgggcagcagagcaaaagcgagactccgtctcaaaaaaaaaaaaaaaaaaaaaaagtggaaaaagaaattgaagagtagataaaagcataaattaatccagtgatatgcaattttcctatgagcaatgaacccacaaagtgagagctctaaggataaaaggtgatgatcctgggaggaactattagtacacagtagtacaagttacattttcagaaatgtccaaatagaaatgcaggtattaagatgtagaaaaggaaatctgggtagctgaaatgtgatgcactgacaaggacaaatactgcaaaagaccagctaatcacgttgtaagagccctagagatcaagggtacattttgtaatgaacctattccggagttatggaaacgaccgccagctgttcctgactgaagactacttgaggcacgatgacccagaaagtccatatgtttccaaagataaaagcttaattagatatatcacttctaactgaataaatccacactcccacaagaaaggagattaactgtaaggcatatgtcaggagggtgactttcaaacatgcaacagcttcagatactgaaacatgctactatttaactgtggctgtctttggatgggagactttcaggggatcgttatttgtgtgtctttcaatgctgggtgcatataacttctataacgaaaaatattttgaggctgggtgaggtggctcacacctgtaaacccaacactttgggaggctgaggcaggaggattgcttgagcccaggagtttgagaccagccagcctgggcaacatagtgagacccatctctacaaaaaataatttaaaaattagctaggaatgggagcacatgcttgtattcccagctgcttgggaggctgaagccggaggatcactttcgcccaggaggtcaaggctgcagtaagccatgattgcatcactgcagtctatcaagcctgggtgacagtgagactgtcacacacacacacacacacacacatacacacacacacacacacacacaattgtttttgtgtgaaagtatatactatcagagatacaaggaatgaaggtaatccagctctttctatgcttctatgaactactctaaagatcaattggtagtcacatcctgtattataaaatagtcaagccattgccaaaagtcattgaagagatttttgtttttaactgctatttaaacctggaaacaggtctcaaagtgactatgcaatgtaaaagctccatctgaatattagcaaaggactttttatatcttattttaaaataatgaatgagaccgggaatgcgaccgcgggaatgagaccgcacaaaattatgtgtgggtgttatgcggccctctctttatgtacttcctgtcattgctgggttcttactgatagaagctttgtcttttcattgaggtgtgacttgaacctgtagcggggtgattgggtctaacatggcaagactggtgacagtggggacaggggccccttatggggtataattatgcttcctggtaattttctactgtgctgctactactataagaagccctctaggaagatcaggaatcccctaccaggtgtgtatgtgttgacacactcatttctcccttgtaaatttgcttgaacgaagagtttgcagtgcatttttatcccccatgcattttacagtcacatcataacaataggtgatctattaatttacgtcaagataccacaattgaggtacaactgatcactaactttcattctgaaacccctattctacgtattttctagtatttgggtcttgaagattatattagtgcagagtgccaggtggggagggaggaagggtagaagggaggaggagggaggaagactttttgagatagggtctcactatgttgcccaggctggtctcgaactcatgggctcaagcaatcctcccactttggcctcccagagtcctagggttacggtcgtgagccactgcagccagctgtggttcttaagtattcttaagaacacttttttttttcatttttatttgtacaaaatattctcccaccacactcaaacaaatgcagtttagactacaatgagagcattttgtttatgtcaagaaaacaaagtgtatatttcttaataagtaaacttttaaaatgtaatttcattagtacaggaaattaataactttagtgtctttccttcttcagcctcactcacctcatctacaagcagagttgggactcaattattctgtgaattttaactccaactaataaattaaccaagctttgaaatttccttgtaagtatggttataacaattcacactgctgtttatgccagtggctttatttcaaatggtagtttctcagttggagaagcagttcgaagtcattttgagctcctttaaactcaacgctttataaagcggtgattactttcgtgtcctaattaaatggccacgtcactctcttgcatcttgtttggaaagtcacaagcaataaagaactgtgctatattatgactgatgagcattatttgatttttgctatgcaatattgcatatgatatttactacctgtgaacctccttgtggtataggacacacttagtggagcaggtaatggaaagggattattaaaggaaacgatctcatgctttgtttttgagagaaggtttcatctgaaacagaaacagacacacataccacgagcccgattactatagaaccgaagagacctttccagctgtttacacttcggatgtaaaatggcaatttgacatagactaacagtgtgatgtgagcatctgcgtaaaaaggcgacatatggagcatgcccagtgtgggagtgcgtcctcctccctccgcctcccccctccccctcgagatctccaaagataaggcttgaactttgcacttgcaaatgtcactgcatacgtttttgcactagtttttttttttttttttctgcgattcttttacaactaatttcttttaacaatttgagcgcagggaagagaatgtttagggttatgagatgcattaagtttagaacgagttgatgctcggcttttgaatgcacttgtcttctttatttttaaagcaatataaagcactcgagtgtgtgttttcagcccctcctggaatgggaaaataagaatctccctggatgggagtcctctggggcagggagtgaaagccccggaggcagaaagggacggagaacaggggcttgcccagagcatggataggaaaggagctggggttctccggggctcagcgcgcactgagaacctgtgcccggggctgcagctgcggacgataaaggcgctgtctggctcatgaaggccacctggatcaggcttctgaaaagagccaagggaggaaggctgaagaattctgatatctgtgtaagcgcaagggctttcgtttgtggggagaggttattttgtctctgcttttctgttgttgcagtgagtgcaggtagagagggtggtttgatttggttaatcggatcatgattgcaggagagggaagctagggagattcctctcattttttgagctccttttcctaggttgtgattaattgccagatgagctatcccaggcaggtgttttctgtagacggctttttattaaatctaggtaaaggtattttaaaatgtgttgctggaagatggagtgaagttagctgctagtgtcttacagttttatcagagaaaatagcaggtgtataaaaaggtaaacaaggctttttcagattaaagtgggaatcatgtcatggtagtgacattttggagagttcaagtttataactcagactttctttcatgtttttgttaagcttaatgtcctcctagtttcaaatacctgctttagcatgtagattgttcttgaagctatccttgaaacccatcgttgtccttcagttctgcactgcaccatcaagctgtttaattataaaaccaacttgttctggcttccaggaaggatagttttttggaatataaagcttgggaaggaatggcaactcagtagacacaactattctattgaatgtctgcaaaccagagcatggttttctagataggttgctgcaaaatgaattattttctcctcttttcaggaaagtatagaacaatccgggaagctaactgctgtgtcgatgagacttttccaatgcaaacatcatagactgaatctactttaaaatgtacattttcctctccagggttcggcagactcctacactagccgtccatccgattccgatgtatctctggaggaggaccgggaggcagtgcgcagagaagcggagcggcaggcccaggcacagttggaaaaagcaaaggtaaaatcgtttcctccctgccaagatctttgcaagttgtgctgtgcccctgatagaccacctgtgggagtttcccctaaaggttgtttgatctattagagaatttcattgtctggttttagaaaggtacaaaaaatggagcctagtttcttcccttggtagaaaaaggaagtgtggtatgtaagactggtcttctatgttgttttataatccaagcaactcttttctgtgggtggatggcttatttggacacatacaaaaggatccttgaatttgccaagaggaaaaactgcacctaatatcaacatgttttacttcatttccacagtaaactatatctctgttaagaaaaaaaaaaaaaacagactgacttcaagctattgtttattttcttagacttgaacagtttttcccctgaattttacttcataggtgttttatgttagtatcctgtattttcaaaatggattacattatgcttttccaaaagcaacagaggattttattgatttttaaaagtttcttctcttagaacatgttcttctccattccatcttaataaagtgtgtatatatggaggggagactgcaaagcagctatgaaatagatagttacaggattcatctcaggccatgtctcatttcagtcattgcagtgatttgaattctttctcccatgctgtccttggaatagtggctatttctaaagcatagattgttcgagttgaaggtggcttggtttgtgggatactcagtcacttctcaatgaacctattttaacatggttgttgattttcctttgaaaaacttgttttgaaaaaggctaagtgccttgttgatcatgctagaaataccaggatagcatttctactgcctgcctcatctctgagatgagtaaaatctatgtgtgttgctatgggaattgtggttaggagattctggtttgaatgcatggacagcccttatgtaatacattattcatgacctctagtgcggctgccatcatagtctactgaggaactgccaggagaccttgacttctaaaaagcagtacttttgtatatcagaatgatgttcttacctcgcctggcagggaaattttctccaggactgacagtcttctctgaaaggcagttcataaatagcagatgcagggagggttttgtgatggtggaaactgataaaactggacgtggcccagttgccatcaatgaatctgctctaccaatgttagccacgtagaacattgtgaagttgaaattaaataatgaagaacattaaataatgtatgacagtctgcattgtagttaatataggttgcagctgagagtctgaattctatattctatattttgcattgtgtgtaaagaagagtacaaaaaaactacaatttgtattccgaaaataagattgttctatttgcggctaatttattcatgtaagtttcacataccaaaattgaacagtttctcgggcttatatgccatcatgatacagcccaatagactgtaggtttggttttcaattgttatgtaattggggcatttttgttcatgactctgtggctgtgtcatgagttagatgacattgctgcaaagaacttttaaagtatcttttaaccaagcatggatcgaaatgttgctcctaaatcaaaccagggtcgtgttacttgtcctacagcctaaaaagatgatagttagaaatgatgtagaggataaaagaaaatgaagagactttaaaacaaaggcaaaataattgaaaaactatttcctatgtttaaggcaagatagtttatttaatgggtgagatgggaatggttaatgggtacccaaaaaaaaaaaaaatagaaagaatgaataaaacctatttgatagcacaatagggtgactaaagtcaataataacttaattgtatatttttaaataacttaaagaatgtaattggactgttcgtagctcacaggataaatgcttgaggggatagatgccccattctccagggtatgcttatttcatattgcatgcctgtatcaaaccatcccatgtacctcataaatatacacatctatgtacccataaaattttttaaaaaatagtttatttatattttttctttaaaattaggtcaatattttaaacctttgatgtattcaaatgagacacactagggtaagtgagaatttaaatatgtctcaaaagaagatacaaagatgagcattgaattttcctttatattaaaatcatggtttggtaagtctggtttattaatcccaatatccttgaagaaataatgcaaaatagggattgtagaaggctagttccctctataaatttttattgttatctataaaaataacctcattctttgccagaatttcatcttgccttaatgaaacctacttcaaaatgaaggcttaaagtttaaaaacataacaattcatgctatttaactttaaatagttaaaaacactttgcacagccattttggaagaatcagacattttctacatttacttcgtaaccatcgaagcatctctcaaacagaaagactctacaagtcagtgcttttactcaccttacagatcacatgtaataaataagtctgtgcagatgacgttagcagtgctttcagatcctggtcctgtataaatacaaacacattatccactaattgcctaataatacctctgtgaaataacgtgattagcaagaagtgagactagagatactgtcttttaaaatttaagtgacctacaaaaggttatataacgaagtactctgtgctgtcaataaacctattactctccactaccactttgttaaggcttttcttaaccactaaactgcagtgaacagattagatgttaattttgaggccaataaataccaactgacatgacattgttttttaacgtggtgttttctggttccaaatgtgtgttttgatgttgtacagttatggcatactttgcaaatcctggtcatttcagtttgtgctatctgatattaccttaaagacaagtaatatatgaatgtaatttattcccacgttgatcttctctttgaaaacaactttattgagatataattcacccatttaaagtgtataattcagtggtttttagtatgttcagaggtgtacaaccatcactataatcagttttagagcattctcattgccccataaagaaattccaagcctgttatcagtcactctccattctccccaaccatctccctgtccccatgcgtagaaccactattcaacttttgtttctacaggtttgtctattctgtatattgcatataaatgaaatcttaccataggtgatcttttgtgattggctacttttggacatctgggttgttttcaccatttaggtattgtgcgtaatgctgttacgaacattcctgtatatatttttttgtgtgtgggcgtatgttttcatttcacatatgtatgtactttggagtgaaattgctgggtcacttgatcatctctttttaattgaaataatgattttcttcttttctcctttgatcctcaaaaacgatgccttctgccctatatacagggactctgagttgggaaatctggatgtagaaggagttgaagcagtgataagatagactcagccaggcacaatggctcatgcctgtaatcccagcaatttgggaggccgaggcgggtggatcacctgaggtcaggagtttgagaccagcttgggcaacatggtgaaacgctgtctctactaaaaatataaaaattagctgggtttggtggtgtatgcctgtaatcccagctacttgggaggctgaggcaggagaatcacttgacgctgggagggaaaggttgcagtgagctgagatctcttgctctcacgtgtgcaacagagcaagactctgtcaaaaacaaacaaacaaacaaacaaacaaaaaacgatggactcaatgtgatcttcttagccgaatagaataaccttcaatcttgagtccattgttcttttatcatcgaatatctactatattaaagaaaatgttaggcccagttggtgaataggagagactgcaaggccggagccacaaagaagaaattggcaggtcttttgcctgcaagaagcttccattgtttgttttgggagaaagttgtggtcataaaaggtggaatacaataggttgtggggaagggagggatagagaggtctgtgagcacccaggtttagactgcatcctactggcaggaagagaaaatccttcttggaggaggtagtggcttaaaagtagacctcacagcaggggttcgtattctgttaggaaccaggctacacagcaggaggtgaacagcagcagccagacaggaagcttcatctatatttacagccactccccactgctcacataaccacctgagctccgcctcctgtcagatcaatggcagcattaggttctcataggagtgcaaacccttttgtgagctatgcatgtgagcgatcgaggttgcgcactccttatgagagtctaatgcctgacgatctgtcactgtttgccatcacccctggatgggaccatctagttgtaggaaaacaagctcagggttcctactgattctacatgattgtaagttgtataattgtttcattatatactacaatgtaataataacagaaataaagtgcacaatcaatgtaatgtgcttgaatcatcccaaaaccatccccaaaccccagtccatggaacaattgttttccctggtgccaaaaaggtggaggactgctgccttagaggatggacaggtgaagtttagctcttgaagtacaaagagggaagtaaagaagagagaaatgcctcccaggccctggaatacagtgtatgcgacggtcagtgtacgtaaaggctgtgcagcaagaaaacatagaccctttcagagaaaggttagtttcttgagaaaatgtctttattctaccttcacaaattagctggttatagtattcagaatgaaaaatgtttttctgcagatttgtgaaggtttacttcatggtcttctaaagtccagacctgctgttctgtctttttttttttttttttttttttttttttttgagacagggcctccctctgtcgcccaggctggagtgcagtggtgccacctcagctcagtgcaactccacctcccgggttcaagcgattctcacacctcagccttctgagtagctggcattacaggcacgcaccaccacacccagataatttttgtatttttagtagagacagggtttctccatgttttccaggctggtctcaaattcctgtcctcaagtgatccatccgcctcggtctcccagagtgctaggcttacagatgtggcccaccatgcccggcctgttctgtctttaagtttttgatttttgtttttttaaaatctctaatattttgggaactgatcttcctttggtattttgacattttgacatgacatgccttggtgtgcacctttttgtttattgtacttggcttctcatgcattcattgtgaagggctgatcagttcagttctggaaactgcccctttttttggaataatttcttcccctatattgtcctctttttactggctctctggtttgtgcgatatttgatttgagcctctgtgtaatcatttttctcactttttctccatctttttgttgtacctgaatttttctcaacttctaacccatctgctcaaattatatttgtcaaaatgtctaatttccaagagcattcttcttttcttcatttatagcttcttgtttttattccatagccataatattttctcttatgtctctaaagatactaatttttttgaagttacctgtgctgtcactgtttattaagcttctttaatatttgatgttactttttacataatggagacttttttcaaatgtttgatttctaatgactatatttattatttcatatatttgaagtgaaaataaagtgtaagaagcagcaaaagcatgcaacttcatgaagattatgaagtggaagcacctattgtagagggttaaaactgagttatcctgtaggaagtgcaaggactacctacacaaagatcatcagaggtgaaattattgactgccttttggaatttatacatcaacaaaaagttttcaaatgaacttaaggaaacattcactatccctgactttttttttttttttttttttttttgagatggagtcttgttctgtcacccaggctggagtgcagtggtatgatctcagcccactgcagcctcttcctcccgggttcaggcaattctcctgcctcagcctcccgagtagctgggactacaggtgtgcaccactgcgcccagctgatttttgtatttttaatagagacagagtttcaccatgttggccaggctggtcttgaactcctgacctcaagtgatctgcccaccttggactcttgaagttctgggattacaagcatgagccactgtgcctggccatacccccaacttcttagctagggagtataggtgagaagacatgagaagatgttgaaaatctcttacaaacacataggtttacaaaacacaagcctaaaaccaagatgctcaggcagtgctgaaatttgctcttgggaggaaatcccagtttcatgatgtttgaaaacattctttctcttgctggatcacgtgtcatcagatagagaagggccaaaattgtagtataaaaggttctttagggatgagattatggacgcaaattttttcttcaagggaagagtattttttcttactactagttttcttcaggtttgtttattattatttttttagacaaggtctcactctgttgctgaggctggagttgcagtggcatgattactgcttactgcatcctcgagctcctgggctcaagtgatcctcccacctcagcctccagaatagctgggaccacaggcatgcgccaccatgcctcgctaacattttttaaaattttttttgtaatctcagcactttgggaggccaaggcagatggatcacctgaggtcaggagttcgaggccaggctggccaacatggtgaaacccgtttctactaaaaatacaaaaaaaatagctgggtgtggtgttgtgcatctgtaagcccagctatcccagaggctgaagcaggagaatcacttgaacccggaggcggaggttgcagtgagccgaggtcgtgccattgcactccagcctgggcaacaagagggaaactctgtctccaggaaaaaaaaaaaaaaaagtagagacaaagtctccttatgttgcccagcctggtcttgaactcctgggctcaagtaatcctcctgcctcaacctcccaaactgctgggactacagatatgaaccactgtgccctggagtttattcattcagttttgacctgtcaaacttctctacttccaacaagttcagcttatcacttatcttgactaaaagaaagcctgaaggcttgaagtttcgggaaaggccatccgctgggctgagactctgtctgactctggacaatgtttaatttttgatcatctattcataattaagaggaagacattgtaaagctgattggaagctccaaatgcagtggcaaagcttcttgacaggtcatcttgtatagggtaattggggagggactgaagaactggtaggagtgggcaccattatcttttaatctggccaatgccccagagaggactcccccagtctcctgtcttgctctattggaccgctcacaggcttttggcagttgtccaagaaaaggtggctagagtttcatcacttaggatggagatcttataattatttaatcctcctatgttcagtatgtcactcgcctttactctcagctatccttctgattgtctgaaatctcctggtcatcctctccagagaataaacctttggtcttctggaagtgaggggagagagaaagtggattctgataagtccaatgtccagtcagtgctgttttcagccccagccatacttcatccttcagaggtgcctgttacctccagttccacctccttgccagggccctgcagctgcaatcagctttctactccttagccgtcctgcccgcctcttgcaggtactcttattctaacactttctactctgctagttaattagtgcttgttcattgtgttctatattctatgtttccacatactctcatctggtttcctgttcttagtatttgtgggtttatactttttctaaaaacatattttcaggaggaagcattagttcagttgaccatgttttgttcccagtagttttcagtaaacatactacaaaaaagaaaaaatatttctcatcttgccttagttcataaatgccttacagattgagagaattcccctaactagcctttgaagaagaaagaagaaacatgaacatctttacgtcccatcagcctgaagatagtttatttcaaaaaaatattaaacatgttttaaaaatatgtcttattgtgaacattatatgggaggtaggagagaaatatacacatatgtctataatgcgtatgttcttaaacctacaagatagactactggagaatccagagaataggtggcaggtgtgaaactagagggctacttatggggaaaaaaaaaatgtgttggctgggcgcggtggctcatgcctgtaatcccagcactttgggaggccaaggcaggtggatcacaaggtcaggagtttgagagcagcctggccagcatggtgaaaccccatctctactaaaaatacaaaaattagctaggcatggttgtgggcacctgtaatcccaactactctggagactgaggcaagagaatcactggaacccaggaggcagaggttgcagtgagctgagatcacgccactgcactccagcctgggcgacagagcaagactccatttaaaaaaaataaaaaagaaagataaaaatccagcagcgataccttatgaaaaacgcaagcacaaaatatgtcacacattcttattaaaatattttaggctgaaattattttcacaatgtacattttcatgcttcttgctttaaaaaattgtcaactctttgcttataagcatgtacctttcaagtatagttagaaaactggctgaatatgtctaatttctagccgcatgcgtttgtttattgttcaaatacgcattagcttagattgcgtttttctacctgtgataaataaaaagagtgcagaagcccgctggacctctgttaggcttctcttccctgttgacatatacttatgactgggtaggtaacaatcacacacattggtactgtcgttcttccactcacctctaatgttaattgatgataatattaataatgacaacagtaatagcacttaatgcccaatcactgctcattatagacaatttgaaagatataaaaggaaaaggcaaaatttgtgtctttgagcattttttttttttttttttttgagatggaacctcgctctgttgcccaggctggagtgtagtgccaccatcttggctcactgcagcctctgcctcctgggttcaagcaattctcctgcctcagcctccggagtagctgggattgcaggcacctgccaccatgtgggctaatttttgtattttaagtagagatggggttttaccatgttggccaggctgttctcgaactcctgacctcaagtgatctgcctgcctcggcctcccaaagtgctggaattacaggcgtgagccactgtgcccagcctctttaagcatgtagaaatatatttgagcagtcatgaccttacaatacatacagcactgatgactacactatcagcaaaatccttactctcgaagttcttgctgcaaaacaaacagatctcagcctagtggcattaagtcaccattttatttaggttacacttctctgccacacatccctggccagctttctggttagttggtgaccaggtgacctgggatggcttgtcacatgtgtctggaggctgatagctgtcagcatgtgtgtctcgttctcttccatatggttgtttatcctccaacaggctggctagggttcgcatgctggtcccagggctgcttcatgagagagcaagctccaagggggtgataatcatatctctacttatgtcatgtttgctaatgtcccattggccaaagcaagtcaccggcctaagcctggagtcaaatgggaattaccaagggtgtggattcaggtgggatatgttgcaaccactttctgcaaacaacctgccacattcatcttttttcttccttacccctttggaagaagaaatatctgcatgccttgtgaaataaacaacgctgtcctcccttctgtcctatttttttcccttctttctactgccaaccttatcaccccaggctttattctcctgcttcaatttcttccctacttactctttaacaccgtgaaactgatttctgtctccatctctttactgagggtctctagtgacttcctaatcacaaagccactgaccttttattaaacctccccttgacatctctgcaaacttcaatttgtttttcttctctgctaagtcacttttgtcttgcaggtgctggtacacacaaagtctacttctactaccactctggtggttcctgttcagtctcttctgtttcgacttttagttccctcacctgaaatgtggaagtccattcaaccaaatgctcaggccttggcctcctgatgtttgttgctttaggcatgtcattggtttccagactgagctctgtagagccccaagagatccatggattcttctggagtcactgcagaggcttagggatgcccagcaggctgtggtctgtgcgttgtacccaggattcagccagaacaatgctaccttcacatgttttattttattgtgttgtatttttattttttattttttgagatggagttttactcttattacccaggctagattgcagtggcacgatcttagctgactgcaacttctgccccccgggttcaagtcgttctcctgcctcagccttccaagtagctgggattacaggcacatgccatcacacccaggtaattttttgtatttttagtagagatggggcttcaccctgttgaccaggctggtctcgaactcctgacctcaggtgatccacccacctcaacctcccaaagtgctgggattacgggcatgagccactgtgcccagccacacatattttatgtattgggacctttatgtgcattttcctttgaatgaagggtttcacctcaggagcgagctttaaaccactgccatcttcccttctattctctcatacttctccaggcttcagccgtcacttatagttagtgtctttggtcttcgcctctctccctagtgcttggatctcaggtcctctttttggatctctgtcggttctgccacccacttaaaattgagctcccagtcttttcctttaaaccctttcttctctgcattttccatttccattctcattacctccatccttccaaatctgaaaccttcgtcgaagggtcaacaaatcttttcctgggaattatcagaagggaaatattgcaggggcaggggtcatgcattctctatgcaactgctcagaaacctggatttggattccatctctgccatggaatggctgcctgactttttgataaattacaggtgaagctaagttttgccatttgtaaaaggacactaacctctgtttgacaggattccagtgataattgaataagctgttacgtataaagcacaaggttcctggacctgtctttccctactctagcccttgtgatgggcacaggcaactgggacacacagcacctgccgtggagcagttcagggtgttgtgaggaatctgaatggaaagtaatgaaacaagtgtctttgcctcctctgtagttatgtgcggtcttacactattttacatggtcactatcagcttagttgtttgtcacttgttggtgactgctgtaaggtagatttgagatgtccagggactgcagagctgcctgggatatgactggcattgacacacttgcttgatctcacagcagttgccatggcaggtcaggttgcatccccacccatcccagtgacgaaggcatgggccttgtctcctgtactctaactttgagatgtgctttctgcctcttagtcacatgggtgcagatctctgcctgagttatcaagagcaattgaactctctcttgctcctctcacaggctcttttctgagtaacaccaagtacttgggaacaaaattacacattgctctctgtttatttatggttatatttatcttggcaatcgacctgttaagctagttttaactttcttatgggtaacagtcacatgttttaaaaggaacctgatggttccagaatccttgttactactaccttttttttttttttttttttttggagacagaatctctgtcacccaggctggagcgcagtggcacaatctcggctcactgcaacctctgactcccgagttcaagcaattctcctgcctcagcctcccaagttgctaggattacaggtgtgcaccaccacagcctgctaatttttgtatttttagcaaaaatggggtttcaccaggttggccaggctgctctcatagacttctggctattttaaaaccataaatagattaaggaaggattattataaattgcagttcaagctttttttttttatcttagagcactataactgaatgtctttgttgtatcattgtaaacacagcaataaatatgcagttcttccctccctttttctccaccagatgttaacagggaacgacatgaagacttttacgcagagcttaaaacagtcaaccctctctgttcttacaagtttttgccccatcaatggctaaataaaagatgttgaaaactgtggaaaaaagtagaatgtatttaattagcaaacatttgatgagtggtatcatgctatcgagttggaatttaaggaagggaaattgaagatgtgttagatgtggtggtttcttcctcaagaagctcatggtctaatggtcatgctaaaaatgtgtatcactgagtaatgtggtagctatcagacttaaagcactgtaggcttggcatggtggctcatgcctgtaatctcagcacttcgagaggctgaggtgggagaaaagctttaggccaggagtttgagatcagcttgggcaacacagtgagatctcatctctacaaaaaataagcaaaaatagttaggtatggtggtacatgcctgcagttccagctactcagaaggctgaggcaggaggattgcttgagcctaggagttagaagccacaataagctataactgcaccaatatactccagcctgcatgacacagaaagaccttgtctcttaaaaaaaaaaaacaaagaaaagaaaaaaaaagcattatgagccaaatggcaaatgggtggaccccaacactgctggagaaggcagtgctgatgaccagagaagggcactttaaattatataagcccccactgttagtgactgaccctctggaggcagagcctacgttaaccagcaatgtgattctctctaaggttagcaagatgattgctaactatggggtccaacaacgcctgtcattttagattattttcattttaaatctcaattcgcaatttacttaatggcccaagcattttttcatcctcataaccattcgtaagtgtacaattgtatgaagtatttcacactgttgtgccacagatgcctagaatcttttcatcttgcaaatctgaaactctatatcatctgaacaattccttatcaccctgccctgcctcagccccagacaactaccatgctacaattttttttttatttgctcaaatttatggggtagctaagacattttttacaggtatataatgcataatgatcaagtcaggggactcagagtgtccgtcacccaagtacagcagttttgttgagtatagtcatcctactctgctgtcaaacactgaattgattccttccatcttactgtatgtttgtaccctttaacccacctctcttcctcctccctgcaccccccactcacccttttcagtctgttatttttccactctttatctccatgtgttcaatatttgtccctttgtgactggcttatctcagcatgatatcctcaagattcatctatgttgtcccatgtgacagaatttccttctttttcaaggctgagtaatattccattacatgtatagaccacatttctttatccatttatctgtcaatgggtatttgggctgcttccacctcttggctactgtgaataatgctataaagttttgtttgcttctttgttttttgagacaaagtctcactctgtcacccaggctggagtgcattggcacgatctcagctcactgcaacctccacctcctgggttcaaaggattctcctgcctcagcctcctgagtagctgggactacaggtgtgcgccatcatggccagctaattttttttagtagagacagggttttgccatattggccagagtggtcttgaacccctgacctcaggtgatccaccagccacagcctcccgaagttttctttaaatcttcaactttttttcaatgagcctgtcaaggtggactgtcagcaagcaggaactatagcgtatgtttcacagcggctcagtgtttaacttcccgttgtattgttttgcttggtctttaacaagtactaagtagggaagtggaagcagatatagttaccccattttatggatgagcaaactgatggtggatactgaaggatcttgcccaagctcactgagctcataaggggcagaattagggcaaggacccaggcttctgcctcatttttttttttttaatgttctttcacctcatcaaggagctgcttttagaaagacacaggcttatgaaagcagaaagtgcattaaaaaaaaaaagacaccagctgagaatgcattaatgtttcctctttgtttcatgctctagagagattaaggaaataaaagcttttttttttctctttaactataaaagcaaaaataaagcagggcagctattaagacaattttaaaagtataaacatcttcgtgcaattttttttgctgttgagtctggatagagtttacaagcaaaaaactcaccttttgtcctgctttttaaagtttagtttattgtcattacaccattgatgtgaaacaagtcaatttttacacttcaacattatttaaacaaaaatcttgagctaaaaattccttttttttttttttttttttttttgagacgaagtttcactgttgttgctcaggctggaatgcagtggcgcgatctcggctcactgcatcctctgcctcccgggttcaagcgattctcctgcctcagcctccctagtagctgggattacgggcacacaccaccacacccggctaatttttgtatttttagtagagacaggtttcaccatgttggccaggctgctctcaaactcctgacctcaagtgatccacctgccttggcctcccgaagtggagataaaaattcttgaatttaatatgttgttagttaaaggaagaccttccaggatgtgctgtgtatatccttttcatggttaaatggagatacaaatggaacgtacttaatactatttgaatatgccttttcctgtagagaaatggaaaaataatcaaatatctaggaaatagattgtatgaagaatgctgaagaaacaaaatttaaatagagcaaggaagagaaaattgaagttaaaatgaaacgatttaaaaaaagattttattaagtgttgcctattcgtaaggggaaaaaaacgaaaggaacaaactaaaaattacagcagccaaaaatataaagttagatgtaacaattgactagagaaacatgaagacgagttataaaggaagattaggagactgctgtagtgcaggagtgcagggttgtggttttttgtttgtttgtttatttgtttgtttttgagatggagtttcgctctgtcgccaggctggagtgcagtggcgccctcttggctcactgcaacctctgcctcccatgttcaggcgattctcctgcctcatcctcccgaggagttgggactacaggcgcacgccactatgctcagctaatttttgtatttttagtagcaatggggtttcacgatattagccaggatggtctcgatctcttgacctcgtgatccacccgccttactaaactccatttttaaggaaggaaaatgaatcgcacaatccgctgtcagttgtttattctgatttcctactaaaaattatttcaattgatatttgcaggattaacacatgttaaagcaaactaaatatggcctgagaaggcctccttacttctacatttgagtcctcgtggatgaactgtaatctagcttaataggcagataagattgaaaacctaacttggaagtatgtgcctgtaacagtaactgagtcttggccaatcccagcggccgtacttcaaccactcacagactgctaagtgttcaaactgtgttcaaataagacaaacgccaatatgtagccagtccagctatttctgtacctcactgccgatttctgtatgtcacttcccttttttttggtctataaatgtgttctgaccacagggcatcagggcgtcagttcttgaatatttgacaccagtatcatggtctcatcctgccctccctagactggacaggaagtgaattcaacaggaagtaggcaaaaatgtacagtctaatcttctcgtctttggctttctcgtttcattccctggatttttaaacaaccaactatccctttgtcttcttagaggaactgtaatcatccctgaatgaaatatttattggatcagttgtaagcttacatttgagtcaacctacattccttacagttgagggttaagtttcaagatcctttatgaggcaactcagtgacacgcatccccaggcagaattaaaggagatctttggctgtgacaatctaaagctctttggctatgacagaacaaggaaagttaccgtggttgaactagatgggaagaactacttgcttctcctctgagcgtactgtgacttgcttaattctatgagtttaagtagcctgaggattcaataggtcacataatggatatgcaaaatggagtatagaaaccctttaataagtaaaaatctccaggtgctgtattcagcatacttgcatggatccctgacactgtggtgtatgttaggctaagacatagaaaatgcaatagtaactgtattataatgtacacaaccattctcttcaactctttactttaaaatgagagagagagaaggtgacacggagccctagtcacacagctatgattggactaaggttatgaactagtgtccattttaccacatggtccatctactgaattggagtttcaggggtggtagttgagtcaggaccctcttattcaaatgatcaaaagtccaataaaggtgtacctggaaaaggggtcttgtccagaccccaagagcgggttcttgaatgtcacatgggaaagaattcagggaaagtcacagaatatatttaaaacaatttattagcaactgctgtattacagagtagagcatcctcagaaagaaaggggaggaatgtccctatcttaaatggaatgctggcttatatgggttattaaggttaagaatagtgtactttattacaaaagcttgtgatcagctgtgacaggctattagtattgttattttcctatgttaatattgatttcagcaagaatttaggaatgcactactatctctaaagcaaaacttcttattaaactaagaatgttttttctgtttaaaatatcaggacatttctataagttctaggtttttatttagttagttagcatcattaactcgttccctcaactgtaagtatcttatgaccaggcgtgcccaaccccctgggaatgtaacccagccagtttggccttatctggcctttgttcaagatggagtcactctggttaggatgcctgtgaccaaaggacatagccaaaacttgaatgtttcatctcagcctaatacactgatgaatgtatactccagcattaatcttttgttatgaaaccaagatctattctttaagtagaagtctgtgtattagtctgggttctccagataaacagacctaataggagataaacacacatacacacacacacacacagagagagagagagagagagaagtatatggagatttattataagaaattggtgcacatgattatggaagctaagaaatcccatgatctgatctgccaactgtaactggggacccaggaaggctgatggtataattccagctccaagagcagagaaaagatcgatggatgtctcaccacaagcaggcaggcagaaagaaaaatgagtgaattcctccttcttctaccttgtattctattcaagcccccaacagattggatcaagctcatccacattggagaaggcagtcaacttactcagtccaccaattcaaatgctaatttcaccccaaacaccctcacagacatacccagaaatattgtttaaatttgcaccctgtggtgcaatcaagttgaccataaaattagccatcacagtcagctaattgaagttattactctacttatatgaccatcttcagtctagaatttagttaaacattcgagttggaccattatctgtaggaatttgggttccaggaaatacaagaagaactgaaaataattttttaaaaaaatttaaaccatagtcatgtttatgcctgaaaataatactttaaattttttcctaaatattctagaaattaaagtttaccaaacatgaaccatttgttattaatattatacttttgatgaatgacttgataaaatacaaaagaaggaaatgtattttttaggagaggaatttgaataatttttccccaaaaaattcatatgtatgtaaaatatcttcatcttagtaaaggtccattagcccttgttaactctggtccaagaaaatctatcaattcaagttagaaaaacaggtactcaataatcttagcccttgacatttttctttaaatttctctgaaatacatatttttttttctgtttccttggctgaaaaatgttcattgtaatattaccagtgtggttttttttgtttttttgtttttttttttctaagacagaatttcactcttgttgcccaggctggagtacaatggtgcaatcttggccccctgcaacctctgcctcccaatttcaagtgattctctggcctcagcctccggagtagctgggattacaggaatgcaccaccacacccggctaattttttgtattttttagtagagacagagtttctccatgttggtcaggctggtctcaaactcccgacctcaggtgatccacccacctcaacctcccaaagttctgggattacaggcctgagccaccgtgcctggcccagtatggtatttttaaaaggttttttaagtggttatttttttctggctcatgaatatctttgaatatatgatatgaatctgtgagccttctccaaaaaatagcttatatctaaacagcttggcttatatttccagggtctccacaggcctctgaaacaaacctatataccctaagggtatacaaagtacaagaatctcttgctaataagcccagcctttttccttttagagtggctgatgcttgaagaactatggaacgttggggtgtattcctttgctctcagatacttgaggagatcaccacataaattcttagagttctgggtttagctgtagtgtttagtctagtgtcgaagcagaggttgggcaaatatacactactgtaaatactttcttgtgctatagctgttaagcatgttctagtttaaacagttgtcagtgattagcgattttgatgttccgttttaagattttgtaatggtctagacgaacatgaacaaaaccaaaagaccgtttcaagttcagcagatagtaggagctaatcttttctgtggtttggtttggtcgcctgccttaggttggtttactagtctgtgactttctgagttgctttatcttgtgctaacttctatcagatacaatctccatattgattcctgtttattcttgcctggatgatctattccatttagatagctagaacattcagtagctctcttgagggaatcccacctgtgggttgcagaagggtaacctacagatgcccgattgtcctttttccctggattaaaaagaaaccatttgccatttttctggcttcttagaaaaataaatgatatatgaaatgtttgcagcagcagaactttttcctgcccaaaggtttaagattccatggacacatctcctggtctagcatgctattgctctttctcatcaactttccatctctcctcactcgtcacctcccaccccaaataacttgtttgtgtattcctcttacagcctttttcacagcatattgggttatttgtttctcttgccaaacatgtacaatttggcgtacctgggactgaggaatggcctgttgacacttcaaaaaaaattttttttaagatggagtttcattcttgtcacccaggctgtagtatgagtgcaatggcggatctcagctcactgcaacctccacctcccacgttcaagtgattcccctgcttcagcctcccaagtagctgcgattataggcatgcgacaccacacccagctaattttgtatttttagtagagacggggtttcactatgttggtcaagctggtctcaaactcctgacctcaggtgatccacccatgttggcttcccaaattgctgtgattacaggcgtgagccactgcgcctggccaacacttaaaatttaatttctttgtagaggcataataaatatgtgtggactgaatgaatcacatgatctgagtgataggaagtgtgtgaatggaatcctaaacgtttggaggtcatcatattttgccatctttatcctttatcttacctgttttacctgttttatggggttatgtcttgtctctacaattacatgtgacctcagtgaggaatcaggattgtcaattatgtctccattcccagtgtagtgagtgatatgtagaatgacttttggttgcattatgacactctttagtgaaaagtaatgattaaatagtttggggtggagataacatgaagagatctttttagaaactttctgtttggtgcagtaggttaccaaggcatgggccggaggaagatatagtaggaggtggtctctgccaggagaaagaattccccctgtaggaagccaagttcctgactagcagttgccaaggctttctgtgtcctgccataagcaacggtcccttcaagcccagttcctgcaaagctgttctgttacataaagatgaaattataaatacactggggtatctttcaagtaaaattaactctatatattaaaattcaccttatatgtattccacaagcaaatgtcctgaattcttggtccatgtgaagtttgattattgcaattttgggaataattagggaagagaatatatagtaacataaaggactcaagcataagacatacaaatgtctaatattcccccctccatgtgcagactattggattattccatttgcttttgtaatatgggaatacagctgaagaataaaatgcaatgacatgacctcatgattactggaaagagttttttctcttatttactgataaatctgctataatttgagatcaatatgtaataacatttttctgcaggtgttgactacaaatatatccctatataataaaaatttattgaaaataggatgtcatcttgtcttctcaattttttttgaaaaattaaataatatataagagtatttattatagtgggataaaaagaaaaaaaactcatgtacccacctccacaattacagatacagagtgtcactaatagctttgaaagctttcatgttatccttccccaggctaccctgattcagagcagagatgccccaaagtggagcttagcccactgagttcttggatttgcccaggaaagaattcaagggcaagccagagggagaggaaaacagctttactgaagaagtgttacagctcctctactgcccctgcagagcaaggctaccctgtaggcagagagtaacagctgaggggagttttgcagtcgtattcatacgcactttcaattgcatgcagattaaggggctattcgtgcagaaatctctaagggagaagtagtaatcattgggtcattgccacggaaaggtgtggtaacgcctgggtgttgccatggcaatggtaaattgacatggcacactggtgggcgtgtctgattgaaagctgctttcccctgggccctgttttaactagtcctcagtctggtcgggtgtccgagacccccacctcctacctcaaccccctctatcagagtttatcattatgctgaatgtggtgtttcccactcccttcctgttcataacattatgtcttaccatctatatttattttctacatgacatactggttagtttttctgtgttcaaaccattatttaagtagaataatcaaggtgttcttttgagactgcttttttggctcaacattaaatgtgtaaaattcattcttgttgatttgtatcaccataatttctttttaccaatatgtggtcttccagtaggggatgtggcacaatcaatctgttctctgtccatgggcatttaaggaattgcagataatcccagtctggaagcatttatccgtgtctcctgatgcatgtgtgcaagagtttctcttgggtatgttaattagcagtggaattgtaggttgataaagtatgtgtatctttacctttactgggcagtttttaaagtgtttgccttcatttacactcatactatcactgtaggagagttttcactccaccattactttcattgaatacttttcatatattaaccttttgttttcttctgtgaaatgacagtgcatggctttggacttctttttaattattaaattgtatttttctataaacgtacaagaggactttctatattttatatgtcattatttttgttggttatttgtattgctgaaagggtttaatttgtagctgctcttgtcacatttatatagcattcttaataccaatcaagtccgatgtatctatcttttctgtcactatttttgcttttgggctcttgtttaagaaattctttcctggccaggtgtggtggctcaatcctgtaaccccattactttgggaggccaaggcaggaggactgcttgagctgaggaatttcaaaccagcccggacaatctaacagtacttcgttactacaaataattgaaatattagctggccaatggtgacagacaccactggtcccagctacttgggaggctgagttgggggggttgcttgagcccaggaggtcaaggctgcagtgagccgacattggaccactgcactccagcctagacaacagagcaagaccatgtctcaaaacaaaacaaaacaaaaagcaaaaaaggaaattctttcctaccttagcctcataaagaattcttctatctttatttctaacagttttaaaatttcatctttcatctgtaattcctcgatctttctggaactggcttttgtataaggagtgagataggaatctgacttcatgtagaatacctgtttgttccagagctattttttgaatggcttcttatctccccttggtctgaaatgcctgctcagtcataaaccaattttccacatatgagtaggtctgtatctgagctgctattcatgtttcaatgccatactacctgaatttctgtagttttaaaataaagattgatagagtttggacatatcaacccatcatatttttcaggattgaactgactattcttggacctttctgttccatataaattttagataccatatatgaagtccaacaaaaaaagaaaaagaaaaaacacaaacataccctgctgacattttgtttggggttgcatttaagtctgtagatcaacttggaggaaaatgcctttgttataatattgagtcatcttacccataaataggaactatctctccattaatttagctgttgaatgtcttagaatattttcgataaaggtcatatattttttagatttgtttctagatatgttaattttttagttactacagtctctctcacctttctctctcaagttacagtttctgttggctaatatggagaaattcagttgattttgtctgaaaagctttgtatttatcagtctttctaaacttattaaatgcttatgaattttctgtagattcttgggttttctatcagacatagataggacagtcatagcatgtgaataacggaaattctatttctggttgagcacagtgtctcacacctgtaattctagcaattttggaggccaaggtaggaggatcacctgaggccaggagttcaagactagcctgggcaacctggcgagaatgtgtctataaaaaaattaaaaataaattaaaaaataaaattctgtttcttccactccagtccttttaacttttcaattatttttcatcttaccgtactggctagactcctcaccgcaacattaggttattcttgtcttagtggtactctttaaaagcatgtatttgatttgggttttctatagaggtactttagcatgttaaggaagttttcttctatttctagtttgctgtttttttcttaaaaattatgaattggtactgaattttatcaaatgtcccttttctacatttttttttttttttttgagactgagttttgtacttgttgcccaggtgggagtgcagtggtgcgatctcggctcacggcaacctccgcctcccgggttcaagcgattctcctgccttagcctccctagtagctgggattacaggcatgcgccaccacgcccggctaattttgtatttttagtagacacagtgtttctccatgctggtcaggctggtctcgaactcccaacctcaggtgatccacctgcgtcccttttctatatctttaaaggtggtcatatgatttttttgttgaatttcttattgcggcaaattttattaatagattttctacatggaactgtttacttggataaacaacattttcatgatgtttttaacatcacctttttttaacatgtcgctggatttgactcttgaagattttgggggagggtgggggacttactgtatgtataatcatgagggaaactggcctctaattttcctttcttatcctttcctcaagcgatttgacactgaagcttactgctgtcttaaagtttttgtttgtttctttgttttgatctctcttcttgggaagagtttgttatgttctgattatgtattccttgagtattttctataactcactgggaaaattcctaaacgtactgtgttttttgtgctttgggaagatttgactattgattcaaattctttaacagaaccctttagggttttcactctcttctcatgccagtttgggcattatagcttcctagttctttttctatctcatctagattttcagaattttaggcatgaatttataatctcattttcttactaatctctgcagtatctacagttacatcttttccttctctcaatttttactcaataaatctcactatatatttttgaataattctattttctatttcattaacttctcttctttttaaatttggttctaatttctttttcatttaagtcagttacttagctcattatttctcaaagtatcttctgttaatcacacaagctttttacatttctttttgagaacctggttttctgtatctcacaaaatttcatatgtagtatttcattattgttcagttctaagtattttctattttcattttgatttttttattgggatggtgagttatctataagtgtgctaattcccaaagatatgcaggtgatcctactgttgtcatttctgtctctgatttcaggtttgtacatttcaaatgggagagagctcttttttttatttttttagtttagtgggacaatatttatctttttaaaatgtagcatttactcgtcttactttggttgtgattacacatgtttgcacttagtttccactacaatcttattttgtcctttttgcatgctgcagtttttcttcatcaccccttatctccctatttctttctttaagaattactttctggccaggcatggtggctcacgcctgtaatcccagcactttgggaggccaaggcgggcagatcacttgaggcctggaggttgagaccagcttggccaacatggtgaaaccccttctctacaaaaatagaaaaattagccagacgtggtggcggacacctgtaatcccagctactctggaggctgaggtatgagaatcgcttgaattcaggaggcagagtttgtagtgagcccagatcacaccactgcacttcagcttgggtgacaaagcgagacactgtcaaaaaaaaaaaaaaaaaaaaaaaggaatgattttatttatttattttaatcaggtttttaccctttattagtttggaagttacacattatagttctgggcttgtttaaatggataccttagaaatttcagcatgcattcttaaaatctaaagttaaccagttaaggactttggagcatttaaggctgataactcctacttgatttatatttttgccaataatttggttttatgttttcttaaccttacacaccaaatatttttaccatttaacttttaaaagtaagtctgtatttgtttacatttattcacttaattactactgccttttctaaccatttctttcacatatcaaagattccttttgatatcactgttgttcttgaagcttgtcattgacaagtttctttcatgagaagatttttgacaatgaagtctctttatgtgtctgaaggaaacttatttatagaagatagttttgttgaaaatgattgtaggtttatactttttcctggaacttgaaagatggtatttgattgacagttggcttctgactgttgaggagtcaactctcattataaccatgtcagctctttgtatgcagtctctcttcctaaatcctttcaagtcttcttctctgtctttggtgtggtgtcatctcactgtgatccatccaggtactggtttatgtttcactttttcctgcttcggattcattgtgcctcctgaatatgaggatttgagaattttgtcaaccctggaaaaccctcaaccattagctcttaaaagttgaaaagtaaatgaagtcatccagcattgttaggtattcttcagtggaatgtttgttcaaaatgtcaagttaggccaggcatggtgactcatacctgtaatcctggcactttgggaggccaaggcgggggtatcacttgtgcccaggagttcaagaccagcttgggcaacatagcaagactccgtctctaccaaaaaaaaaaaaaaaaaccaaattaaccaagaatgatgttgtacacctgtatcccaggtactcaggaagctggggtgggaggatcacttgagcccaggagttcaagaccagcttgggcaacatagcaagactccgtctctaccgaaaaaaaaaaaaaaaaaacaaattaaccaagcatgatgttgtacacctgtatcccaggtactcaggaggctggggtgggaagatcacttgagcccaggagttcaaggctgcaatgagctgtgatcgcgccactgcactctactgtgggtgacacagaaagaccctgtctcaaaaaacaaaacaaaaaaagtcaacttagctccattgccagaattcgcagatacatgaatgaggttttaccccacattattttatctgaattttggtataatcttctatttattttacaattatttacttaagcagaaaatcaagaagatgttaaaaaaaaaaaaagggacatattacctaaaatactagggaagaagaaaccgtgttttttaagtagaataggccaaatgtcaacagacatccagggtactagaaaatattgagacgcgtctaaacacacaaacctgtcttcgaacctctagtcacacagcatgtttgcattctatatttccatgaaacttggagtgaggagggagagaaaatacatttatttttatcctctttagttaaaattgcatatcaggatttctttttttaggagttgcaggttaacttctaaagttatctcccacctgcactacatagggagaccctgtctcttaaaaaaaaaaaattaattaattaactgggtgtggtggtggaggcctatagtcccaggtatgtgggaggctgaggtgggaggatccctggagcccaggaggttgaggcagcagtgagccgtgattgcgccactgcactccagcctgggcaacagagtgagaccttgtctcaatcgatcagtcaatcagtagtaaagttatctcattacagttcaatgtctcaacataggactgggtagaaggaagccttctgtcctgtgatctgtgttgctctgatacattcctaaaaagaaactattaagaggggtagatataattctaacatgcaaatgtgttgagggaaaggtgaaaagtacatattacttgattactatttattcacatggaaaccatttttgtatttgcagttagtgtcaactgaagggattaagaagataatctctatcatttatatttgggtctggtcagatgcttttgtaattatatttctatttgatgcctcctttatctgagattttatatatttttttaaatctggagacaggatctcactctgtcacccaggttggagtgcagtggcatgatcatatagtagctcactgtaatctcagcctcctgggttcaagcaatcctctcacctcagtctccagggtagctgagatacaggagtgtactactacatctggctaatttttaaatgtttttgtagcgatggggtctcggtgtgttgcacagcctcgtctcaaactcctgggcaagtgatcctcctgccatggcctcccaaagtgctgggattttaggcgtgaaccaccattcctggcctgtctgagattttataatacttaaaacaaccacacagtgttggctcatttaacttcttcatccattcacatttgcttgtgggtccagaatgaatctgcttttctactgatgcctcaagtaggtcccaacttcttttataaatatgtaaaaatctattgccttttcctgtggttactgcttgtgagagaaaacatactcgatttatacctagaatgaacttcagcaaagttagtgaaaatgtcaacataaacacaggctttacctctgaaagtctatgatatgaaacatcaagagctgatcaggctttttccctttaagagctttacatataaattacaatattttcctccttaaaaaagccaaaatgaggaagttaacggagatgaaattacagtccactcatttgataaaaaagccaagaaacaaaatggataagcatggataagccccaaagatatctttgttgacctcattgaatctcatttctttttctttttttttgagatggagtctcgctctgttgcctaggctggagtgcagtggcgtgatctcagcttactacaacctctgcctcctgggttcaagcaatttttctgactcagcctcctgagtagctggaactgcaggcgtgtgccgctatacccagataatttttgtatttttagtacaaatagggtttcaccatattggccaggctggtctcgaactcctgacctcgtgatccgcctgccttagtctcccaaagagctgggattacaggcatgagccaccgcacccggcccaagactattatttatgtttgtaaagaaatatcaattaattttagaaatagagatggtgcttccaagtcttaggggggaagaaaagctctgttttaattatccaaaatgtcaagctattcactaagatttttcccttgacttgtagctagcctcagtttaaacaaataccacatatattctatttgaagtaagatttaaaatgttaaatgtggcaacaaatctgtcacccaaaagcttcttcacagtctttgataatccttccctcctgccccttctgatgtcctgatctgctcataatcttggttgtggtaatggtttcacagataatcacataagttaaaacttaacacaaattgcactctgtggagggatggatgtgtgtgtctctgtgtgtgtgtgtgtgtgtgtgtgtgtgtgtccctgtccctatacctcaatactactgttaaaaacaaaaatataaaaatacattttcaaaaacattccaggctgggtgcagtgacttacacctgtattcccagcactttgggaggccagaggcaagcagattgcttgagctcaggagttccagaccagcctgggcaacatggtaaaaccttgtctctacaaaaaaaatacaaaaactagcccagcatggtggagtgtacctgtagtcccagctacttgggaggctaaggcgggaggatggcttgagccaggaggcagaggttgcaatgagccaagactgtgccattgtactctaccagggtgacagagtcagccctgtctaaaaaaacaaacaaacaaacaaacaaacaaacaaaaaactgtagtaaaaagaaattcattgatgttgtatttcaaagcaataggaaatatagccaaagaaaatattttaacacctttgagataaaagagagatagagatgactggtgtcagctatcttttatgactgcccaaatatcgcttccctttgggcttcctgtttctgtgtttacatttttttttaccttgttagaaagtaactgtttagataacactatttattcattaaaataaatatatgtatatgcgtgtattgatatatatatatatatatatttgaaatcctattaagtacaaggcagtatgccaatgccacatgcagatagatatagcaagatgatcaagatagagtatttcatgcaaggggaccggcatattcccaagagcaggagagagagcaagattggttttagaaatggcaagcagtttaatataactggatcagcgaccacaaaaaaaccagtttctcttttataaagccaggctactttacagcatttctcataattcaattttagtggagaccaggtgatggattaagcatccagttttgccctgcacagaactctgttgattgtattgctgttgttatccaagaccaagcacttaggaaaaatagctgatgtttctgcaactcagaagctttgtatgagttgccttggtttattatagagtgttaaggaggtgtaataatctgtgctggtaatagctggtcttggtaaagaaaagccctttctcatgcaaatactagatgtaatgaaatgatgggtctgtgagtgatatttaaggtttataactatatttttttcttaagctagtcaagtacagtgttgagaaggaggaaagagtggaacaaggagtccaatctgtaacttgtagctacattacaaaaataagaattatgtaaatacttatagggaacagtaaacgtgttatggcaagtttgaaactgtctatcccctaatccttttttctaccatcaaaactattgtcttaaatcagattttgttgttgttgttgttgttgttgttgttgttgttgttgttttaatagcttggaacttcttggaacacaattgtgttagaacatactgtgctacagtattcctatccattccagcaagagcttcggtagagttgtatataaagctttaccagttaattttgagctttctctgaaaagcatatggcatgttttatacagaaaaaccattttaaaacatagaacattgggaattttggccatgaactgaaagaaaatggtttgaagatatgatcttctaattcgttataggagtggggaagaggtttctcatatggtatgattttaaagatctattaaaaacaaatttatattatagagttcatatataaatcatgacctctattcatgatttagtcaggaagacagaaagcacttcaaatatttcagggataaagtgatttaacatagggaattaggaatgtacaaaatctgaaaggactgaaggaataaagtcagagaaacctgccagttctcagtgtagccagtagaatttggggaatcaggaagtttccagaattactaaaaatcattgctgataattgcagctacctaaggcattggttgggtgattttcaggacacaacctggaatagcatttcccaaatgttttagtctcgtgaccactttacattcttaaaaattaatatgatgatgattattatattttttatagagacagggtcttgctaggttgcctaggctggtctcgaacttctgggctcaaacaatccacccaccttggcctcccaaagtgctgaggttataggcatgagtcattgtgcctggccctaaaaaaattattgaacacctcagtgagcttttgcttgtatagcttatgcctaatggtgttttttgcattagaaattaaaacagaaaaaaataaattacaagaataaggaagcaggcactcccctagctatcagagtgataaagtcatcacaggtcgtgtaagtatttgaaaaattccaatctaccatcatgagagaacgagaatattagaaggcaaatgatgtcttagtgccattaagaaaatagttttgaccttgtggaatccctaaaagggtctctagagcttctaggggttcctgagccacactttgagaactgctggcctaatggaactggaaagtctctggtctgctggagcccacgtagatgccttctgctgatggtggcttctcctctgccttctgcatgtcacacaaggataatctggcttctcctctgccttctgcgtgtcacacaagtggctctcattgcaaggagtccaacctggaaccctgttggcagagaatctgaaaatatcatccgtaggaattcatgctctttgttagatgggaaagtataaggcaggcggaggcatagtgccgagctgacaataggcaatccaacatatttcgttaaaaaccgtgaaaatccacctgagttgacaataggtggcatctacatgaacagaaaaatttctgagagtagggtcttcacttttcctgaaactccctactcctttccaatgatcacttctttccctcagtctttgacagtaataagaccatgaaataactaccaaatcaatctttgactgctttcccctgcataccttttttgatatagggtctcattctgtcacccaggctgaagtgcagtggggtgaacatagctcactgcagcctcgacctcccaggctcaagcgatcctccctcctcagcctcccaagtagctgagactacaggcacacactaccatatccagataatttttgtatttttttgtagggatggggtttcgccatgttgcccaggctggtctcaaactcccaggctcaagggatccatccgccttggcctcccaaagtgctgggaatacaagcatgagccactccacctgccccccaaccaacccaaaatttttaataggtttgtttatcctgaaactttgttttatgtgtgcacctatatgtaaaatcactcatcaaaattattgagatctacacagagctcaaccaattctgatcctctttggagggcccagagcatctgtgagcccagaacacagcggttttgcataaatgagcttttgaaagtacgatgactttaagtactctaaaatgcttagatcatttttagagaattgataagtttaacaaaaggagaacttcagaatgaaaattattattccaccttctatgaggaatgttttaaaagataaaagttgttggctattaccttgaaaatctaaagctatgtgcagtaactcacaaatagtgaattaattgatttaaaatttatggtcattaatgatgagtttgccagtaagagtttttcccctctttggtggagaagtttagaaacttctgtttcatttcaactttgaacaaaatcctagaagccatttcaagtatactttgctaacccagaaattttggcaagaaagtataaacttgagccttctcggatagtctgttcatggagaacaaagcagagaatgatagcaaaaacaaaaatctaatcaaccaatcagaacaatgctacttcttttctattaatcattgccacatttctcttccctgtcctccatcaatagatcaaaattagaataggacttgtaggtaaaaattggcccttgagaaggtatgcgtggattacttttatttgacttacatgtggctttatagtcagaagtactgttgcttgcaaagcatatttgtttgtttgtttgttttttaactcaaaagcacctgaaaaaataatcagaggtttttatacctacaaaatgttactgggttcccattccatgtagatgccaaagccaaatgagcttatacaactgaacaaaaataaatcatgtttattttttccatatgcacttagagaatatgcaaaaataaatgtccagaaataaaaatttgccaaagattgccacatatgcctgaatataagatgaggcttttttcccctcagaattattcttcagaaaagagagagtcaccttatatttgaaatctcacaagatctcccatggtgcaagaagtacattttccattactttattttgaacaacaatgtgctgcttgctggagatacatgggcctgcatgatgtcaatcaatcttattttggtgtgtttatataagtcacctgatacatttgacttaaatgtttaaatagagatttaacatttacttctagagacatgacgtcacacttgtaaatattggatgctatggtaaactcaaacattcaaaacaaatactgtttccaattagttgaaaggaagttcccattagaaaggggttaggtgacccagtatctctcctgatatccacaagacagatgagaagttttcagaggattttttaaaaattaaatatggataaggatgtggagagagggatacttctaagttagtgcagttggccattgaacaatgagaggttatgggcatggaccccctacaaagccaaaatccatgtgtaacttttgactcctaaaaaaaccaaatagcgtatcgttgacccaaagctttaccaatatcataaaaggttggttaacacatattttgtgtgttatatactgcatactgtctccacagaagagagaaaacatgagaagatcacaaaggtccttttgttgccaggctggaaaatggcaggcatcattctccacgcatttcactggccaaaattcaatcacgtgggccaatctaactgcaaggaaggctagaaatttagttgtctgtattctgaggaagaaaatggagttagtaagcatcttggatctctgccacagtatctgactatctttgacagcactgagagtcagccacaaggtatttattctttgttaaatgtgacatcaccttatatttggaatctccttctatttgggcatatatagcagttgcctcaaaacttcgaagtcatagaaaattatttatggctagatcttttaaagagtttttgtaatcgaggcaaattgacatagaacatggaaatgtatctaaaatgattggaaacttattataattagaaatgtattaaaactcaggggaatggccctgagtctgggggtgtcgggatacctggcccagttggatttttttttttttctctttttttttttttttgagatgaagtctcgctctgtcacccaggctggaatgcagtggcgctatctcggtttactgcaagctccgcctcccgggttcatgccattctcctgcctcagcctcctgagtagctgggactacagccgcccgccagcacacctggcgatttttttttttttttttttgtatttttagtagagacggggtttcaccgcactagccaggatggtctccatctcctgacctcgtggtccgcccgcctcggcctcccaaagggctgggattacaggcgtgagccaccgcgccctgcccccagttggatttttatttccaaccactgctaaagcattcctatgccatttgctctgaaccctggactctcaggaactgggttggccaatcaccgatttaatccatcttgctgtgatggagagaacttatgcccaaaattgttgattggcagtcaaggcccaacagccaatgggcggtagctgcagcctcgcggtccctcaccacctgtgctctgctcgtgtttaccctgcgtgccgccaatagtgattcaagccagttatccatctgttctcccacaccacatcttcccaaaaaggccgtttcttctcctcttggctggaagcctgtgccctctgctcacagttctgttagagcattcggatttatatagaacgaaagtttgctttgctttaaaacatcaattccttgatcccagttctgttctccctgggccttatggagtatacgatcaccttcttcctctttagattttttcttctctgggctaaaaatctcaaagtcctcatgtgacatgtttttatgccctcttacctgatttcctcccatgtgagtgtgctataaatacagctcttccaaagcagaacacatcagattaaatacttgtgatctggcagggcacggaatagaatggcgtaggccagcacgtgaattggtggtaaactgaaggtcatcggggagaaaataacttctctaccctcttcggtgtagtatttaaggccagtgaattaaactaacaaaaggcacatctcacaggatacgagacatgcaattttattaacattttacatgcactggagttcacagaaaaggagtgaaagtcgaagtgggaggattgggggcttatataccattttaaacaaagaaaagggtgtctgcatttcacgagatgctgaattgcaggaaggtgactaggaagaatatgcggaagctaatggaagatgagggttattttagtaaggtgtgtttctgcatctcatctccatgccaactcaccatctccagcagtaagacacaacttttctgttcctggtacagcagaggggaattttacaagggaaaatttgagtcctggttttaggtagatgaggggaaggcagagaatttctcctgcatttgtagattctcagccaccttcagttcaatataatccttatggcaaggtcgcatattttggggatgacctcttctgatccccttcaaggtacaatttgaaaccttctccaagtattctgaattgctttcctctggagacattaatttccccacctcccgctatcacctttgaaatcatgctctaagtaacccttcatattatcacactgtaaattgggatgtttaaagtttggttgtttatgcagttataaatcagcttaattatttgtcattcagcttctaatagcttctctgcaagaataagaaagctcatctgatactcggctgaaatccagattcgctcatccttcctccctccctcccttctgcctactgcatgccagtgatctcccagccaccaggaacagagtaaacaaaacaaagcccctgccgtcagtaggattacagtctagctcggagaaataggccacatgcaaatatatatgtagataatgtgttgtagcagtaagtgctaaaaaatagtctctgttctgctgctataatattttcacctgagtgatttataaacaataggaatttattgatcacagttctggaggcagagaagtctaagatcaaggcaccggtagattcagtgtctggggaaggtttgatctctgcttcacatgtggcctcttgttgctgtgtcttcatgtgggagagggagtggaagggcaaaaaaggatggacaggctccttcaatcccttttataaaggcataatcttattcatgggggccccacactcatgacctaactaccttgttaaagccccacctgctgataactatagccttggagattaagtttcaacatatgaattttgggggaacatgttcagtccatagtaaaaactaagaaggtaaagaggatgaggagttggggagtgataaaaatggcttctgtgggccaagcgcagtggctcacaccagtaatcccagcatttgaagtgtctgaggcgggaggattgccagagctcaggagttggagaccagattgggcaacatagtgtgacccctcatggcaaaaaatcaaaaattaactggcatggtggtccacatctgtggtgccagctactcgggaggatcacttagaggttgcagtgagttgtgatcatgccactgcactccagcctgggtgacagagcaaggccctatcccccaccccccagagaaaagcttctgtgaaggtgacatttgatcaaaattgtgaatggagtgagaatgtgtccatgtggatatttgaggatagattatttcaggcagtggaaaccataaaggcaaagctctgaagcacattctaggaacagcccagatcccagtgtgtctgaatacagagaaaggggaaagagaggcaggtcaaaggtcacacagggacttgcaggccagagatgcaggccatggggaagcctttggactatgttgtgaatgttagaacatctgatggaaggtgctgagcaagagtggcatgatttgatataaacttcaaatcttaaaagccctcataaaagaaaaacactgattgctttgtggggaaaaagccatgggattgggaaccagtgtggaagcgggaaatgggtcaggtggccagtagttgaggggtgttgttgacctcagtccttactccagtttaataaccatccggctgggtgtggtggctcacgcctgtaatcccagcactttgggaggccaaggagggtagatcacccaggtcaggaggtcgagaccatcctggccaacatggtgaaaccccgtctctactaaaaatagaaaaaattagctgggtgtggtggcgcatgcctgtaatcccagctactcaggaggctgaggcaggagaattgcttgaaccagggagtcagaggttacagtgagctgatatcgcgtcactgcactctagtctgccgacagagcaagattccatctcaaaaaaataaataaccatccaaaaactgaactatatggcttccttgatggggtttgtttttcatcaacttttgctggctcctagcaattctgcttttcatctttttctttttgttactacaaaatttccttttttcttttttttgctggctttactgaggtataattgacaaataaaaattgtatatacttatgatacatagtgtgtgtggttttctgggatttttgttgttgctttttaaattttttttaaagacagggtctcactgtcgcccaggctggaatgcaatggcacagtcacagcgccctgcagccttgatctcctgggttcaagccatcctcccacctcagcctcccaagtagctgggactataggcatgcgccaccacacccaaataatttttatatttttaatagagacttggccaggccagtctcgaactcctggactcaagtggttcacctgctttggcctcccaaaatgttgggattacaggcgttagtcaccgcatccagcctcagtgtgatgttttgatatacatgtgtgttgtatacatatacagttaaggtaattaatgtatctgcttttattttctaagtacttgcaagctcctcgcctcataattccttctagaactttccttgattgaaaatctagtcccctgaatgaggtggacataccaagacaggatgagggaggtggaaaggatctgttccttgtagtggacacacctggtttgaatctggctattcttttttttattgagacggagtttcactcttgttgcctaggctggaggacaatggcgcgatctctactcactgcaacctccgcctcctgggtaccagtgatccttgtgagtcagcctcatgggtacctgggattacaggtgcctgcaaccacgcccagccaattttttgtatttttagtagagatgggtttcaccatgtgggccaggctggtcttaaacccctgacctcaggtgatccacccacctcggcctcccaaagcgctggaattataggcgtgagccaccacgcctggccgaatctggttcttctttagctcaggcagagtaatcgtattaccttttttttgttgttgtcataaaataagataatgcttctctaagaaataagtaggctgtgcacagtggctcacgcctgtaatcccagcactttgggaggccaaggagggcagatcacgaggtcaagatatcaagaccatcctggccaacatgatgaaaccccgtctctactaaaaatacaaaaattagctgggcgtggtggcacgtgcctgtaatcccagctactcagaaggctgaggcaggagaattcctggaaccagggcatcggaggttgcagtgagccgagatggcgccattgcactccagcctggtgacagagcgagactccaccttaaaaaaaaaaaagaaagaaagaattatagtggagactattaaagagcttgagtgtatccatgttgttgggtctacatgtaaaaacaatatatatatatatatgtatatatatatatatgtgtatatatatatatgtatatatatatgtgtatatatatatatgtatatatatatgtgtatatatatatatgtatatatatatatatatatataaataaggaacttaactatacataattttctgcagtatgaaggctgaacagatcttaattttttctacacatttttgtttttactttagcatgcatttgactgagtcgtgaagtttttaagggtgtgagatatgcttttttatgttttaatccccaattcagtgcctgaatgctgacgggtgctacacagacagtgaatcagtgggtctgtgcaaacgagggccagtgagaaacaccctagtgtcctaactgaaggaagaggccatttccagtgacagcacactcatcagttcacctggagtaccggaggcacgttttcaggttgactagggaaccaatgaggcttctgacaagcaggggacttgggtgcagggccagcaggagcccaggcctcctttctagcaagctgtgctgttctgctgggcttctcctgctatgggttattgagttctgtttcctgagaggcataaggggaaagtgtagacccaactcctcagattgtcttaaataatttgagtaactaataggcattaagtaatttgagcaaatattgttctccagaggttgagaatcctttattgtccctttcctcccaggaccactcagtataatgttggaagagagccttctgtccttatccaggtgcagggaatgaaccagatgattcaattcctacataccttttttttttttttttttaaacagagtctcactctgtcacccaggctggaatgcagtggcatgatctcagctcactgaaacctccacctcccaggttcaagagattctcctgcctcagcctcccaagtagctggggttacaggtgcctgccgccacacctagctaatttttgtatttttaatagagacgaggtttcgccatgttggccagactagtcttgaatgcctaacctcgagcaatccgcccgccttggcctcccgaagtgctggaattacaggcgtgagccaccacacccagccacgccctttcttagactagaccctgaaaaaggatcccttttcatcactcccactgctcttaaggattctccctgctgtggtctaaatgttcgtgtccccagaattcaaatgttgaaatcctaacgccaaaggtgatggttttaggagggggtgccttagggaggtgatgagctcatgagggtggagccctcatgaatgggattagtgcccttagaaaagaagccccagagagcttcctcatcctttccaccaggagaggatgcagagagaaggtgtcattctttccactgaggacagtcgagtgcaaagagccagaacgatctgggttaacatcccaattctatcacttatttcactgtgtgtccttcagcaagttactgaattgattgtattttctgtttatttaacaaatatttatacaaagagcttaccattgccaagcattattctaagtccttcacagatgataattcatttaatgcttgcaataactgcaaaaaatagaaactctcagtatccaagttttatggcgggagcagtggggagactgtgaagtcacttgtgcaacgtcccacagctaggaaaaaagtaagcaggactgcaacctacgtatttagtactagaggtgtttagtacccgagtgagttcacttaatccgctctgctatgctactctagatttccgtaatttgtaagtaatttgtaaaataacagcttgacaaagattgctgtgagaattcagccaatgctagctagcttccttctccccttccatttcatagagagggtaaagtaacacactggtttgagtattagtgaaagatgatggcatttagaattgtaaattgagggaacaaagtaatcaatgatatcatgagaagcaaaaaagacttttttggacttttgcagttgtactaagtttctatggttttaccatttgttttctggaaagattaaaaaccattttgttgaactggtaattccaagcttttaattttgttttcaccaagtgtttgttgctcatttattacacacattgaatttgccccagtttttccctaccacaagtatctaatacagtgagataggtgttttgcttctgcccatggttttttgggtaatacctgacatgctaacattattctgttattttttcagttcattattaaagttgtttgggggaatttgaacacatctgattcctctcaggaacgagaggggaaattgtctagcagctggcaccctgagaactggtacaaattactatgtccgatagtttatcttgaactacggtgtttataactaccaacagagcatcaatttaacaaaaattgcagtacttagtattaaaagaggcttgcactttaaggaagaatgtggagaattttcttttccattacacacgtactggccatattttggcaacagagtttccagtgtcattggctctgaattgaaaaacatgagtgagtatcctttcctatgtacaggagatttccgaggtacgtaatgtgattgttattcattattcaggttacttctagagctctctaagcaagatgtgcatggggaaataaatatgaacgagagagaccgtctgtgtccttctgatgcttcattctgaagacggaaggccagatgtaacaagcacagtgaatacagtgctctgggatgtcaaaaagagaagggataatttatgaccggggcaccaggaagccctgtagaagtggtgggattgggccaggtgtgatggctcacgcctgtaatcccagcactttgggagaccaaggcaggcagatcacatgacgtcagaagtttgagaccagcctggtcaacatggtgaaaccctgtctctaccaaaaatacaaaaattagctgggcgtggtggcacatgcctgtaattccagctactcaggaggctgaggcaggagaatcgcttgaacccaggaggaggaggtttcagtgagccaagatcacaccattacactccagcctgggtgaccagagtgaagctccatctcataaaaagaagtggtgggattgtagctgagccttggagaataaataagacttggagaagttgtgatgcctgaggaagactttccatgatgaaataaagaaacagccacagccagagctcagatgagaggaaatttaaggaccaggggtccttttggatgaagcatgaagcacagaagaatggagggaaggaaagggatggcagtctgcatgagaaaggacctgaaatggtattttctgtgtgattgactattttctttcattgagtgaaggttttgaaccaggaaatgaaatcatcagagcagaattttaagcaaactaatctggcttgaaactaaattaggctggagtaaatgttcaagagtgtgaaagtgaggtcatctgttgcaatacttgggcagtaagtagcaggggcctgacatgttaaggtgactataagactagaaacaagatctctgcaaggaaaagaatcaatgaggctggacaaataactggagacaagagaggagatgggtgataaagggagtgctttctaatgtgtattggtagatgtttccagtgacactacttagtatcacagatgttactgagactttgctcaagtcaacttgtaattgcatgcactgattttctctgtaagacttctcagagcctataatatgctaacatgcgctgtgacactccaagaagaagatggtgttgtctaatttcccatacttatttgtccacagaaactcttttttaaaaataagctaggcacagtggctcatgcctgtaatcctagcagtttggaaggccgaggcaggaggatcgctggagcccagaagtttgagaccattttgggcaatacagtgagaccctgtctctaaaaaaataaaaaattaggtgtgatggtgtgcacctgtggtcctagctacttgggaagctgaggtaggaggattggatgagcacagaaggttgaggctgcagtgaggctgtgattatgccgttgtactccaccctgggtgacagagcaaggctctgtctcaaaaaaaaaaaataaataaataaaaagttgataggtaaatgtggaaaggatctaggattttctggaacactattttgagacatggtgtactacatttggaggatgatggtgtgatttataaaaactgggaagttgacattagaatatggtttccactaaagataagttgacatcaccttatcttgttgttaaaatgtgttaaatttgaggcaccatagaccgtgtatttggaagcatggagaaagttgcatgttttgtggaagtagagctaagatgagagatttggatagcaagattaatctggggttatcacctaggggtgatcattgaattcataaaggtgaaatagtagggaaaggagaatttgagtggagcgaatgacagaatgttgggaaagatctgtaagagacagaagaactggcaaaggctaagaaacagtggtcagggagaaggagaattcggatcttgcattttcagcaaactagaataggactttgcagagtcagggagtgttcagcaacgtcaaatgctgcagagagaggagtgggggagctttaaagtttggaaaataagacatgatcactggctttggaaagaattgttttattagaacatggtaggtgtggaagcccaatttaagaaatcttggagtgactttgaaaaaaaaaaaggcatgaacagaaagtacatcacatccctggttagagcattgttaatgatataaaataaagatttaatgaaagtttagaggaagaacaagattcagatttctttttaaaaaaatctttacattttgctcaacacagggaaattctttgcctccaaacccgagagctatttttgtttttttttaagggcatgggcaaaatgaacaggattaagtagaagaaaagaagcagaaaagaagggataatggagagggaaagacactttctttttgttttttaatagagatagggtcttgctctgttgcccaggctggagcgtagtggtacagtcacagctcactgtagcctcaaactcttgggcttaagcagtcctcccacttcagcctcccaaagtactgggattataggggtgagccactgtacctggacctactactaaaatccctggaatggtagttcttaaatgttagcttgggccgggcatggtggctcacacctgtaatcccagcactttgggaggccaaggtgggcagatcacctgagaccagcctggccaacatggtgaaacaccatctctactaaaaacacaaaaattagcagggcatgatggtgggtgcctataatattatccagctactcaggagcactgaggcaggagaatcacctgaacctgggaggcggaggttgtggtgagctgagattgtgtcattgcactctagcctaggcgacaagagcaaaactctctctcatttaaaaaaaaaaaaaaaaaaaaaagaaaagaaaagaaagaaaggaaagaaaaaaaagttagactacagaattccctgcaggacttgtttaaatacaggcttcctggcctcagccccagagtctctgttcatcagaaactgggtacagcctaagaaccggcctttctaacaagttcccaggtgatgctgatgcagttgacctggggatgacaatttgacaacctccaccccagagaagggaaaaatgtagaatctaggttgcaggtcaaggtgtgccctgggagagagaaaaggcacatctttgtcaggaagttaccaggaatgaaagaagaaagggtgaataaaaatacataacaatttgaagtgcagttagaagagagatgacagtcactggaattggagaattatgtcctagagtctagaaagttgtcactgtagattgtgaagttgtgacagtgaagatggacaggtagagatgatactgtgagcccagtgctgaaaccatctaggaaggtgtctgtaagtgaacaaatggaccttatgaagataggtcatgtcctatggtctggtaatggtgttggggcagcagagcccctaccaaattccttatgctaaaacgagaacgtgcccaggtgcggtggctcacgcctgtaatcccagcactttggggggctgaggcgggtggatcacgaggtgaggagatcaagaccgtcctggctaacacggtgaaaccccgtctctactaaaaatacaaaaaaattagccgggcgtggtggcgggcgcctgtagtcccagctactcgggaggctgaggcaggagaatggtgtgaacctgggaggcagagcttgcagtgagccgagatcgcgccactgcactccagcctgggcgacagagcgagactccataaaataaaaaataaaaaataaaacacacaacaacaaaaaacagagaactccagttctacctctcctgcaacaagtcgggaggaacttgctgtgatgaagctgaatttctctttaagccaagacagagtcagagggggtttgctaagaaccgtagatacttacatcgtgctctgcaaaaactccctttttctgtcctcacaaggaccctatgggattcctgctattatctccattttacagttaaagaaataaactaacttgctaagttcacaactactgaatgaggaagccaggaacggagtccgagcagtctatgggaacttgacagaatctctctctgactgttggcacgtgggacttcccacttcccttaaccatgttaaaggaacccggagcatatcccaggggctgcactgcatgccatagggttgttcccagagtggcactgtatgattgaggatgcaggccagttacagcagagaaggggcctcagaaaggtcacacaccaggaccagtgttgagaacaagaggtaggatgatgcaggctggctcagggcccatgaagggctggagcccattctcaccagcgtggaagacccggggctggcggcatgaggcagaaagaaagcacttcatcaggctcaatggcaacaaatctcttcagtggaaaagttctgctgtttcctctgtatatcccttgggtctgtatcattctcaaaatgagaagtctgtaaagcccaaaactatccggttaatgtgcagttccaaccagcttaaagaataaacggtaggtaaaatgcctgtgtgttgtatttctctttatgtctgccttttaaaaactgaaagtgcatgtttactaaatcacagggtttgagttgaggaaaacactaccgttgtatgcctacaggcatgcattaagtagggctaaaagcatcctttagcaaaagtagtttcctcttttccttgctaaatatcttgtatgcattgtacctgatcacctaaaagccagtgcttttagtaattattgaagaataagaagggcctgtggtgaataatgtcgaaacagtgtgatgggggagctcacacgtggttgcagttgaaggcagagaagatgtgggccgtaaggaatcccccaggactgggtgttccttctcactgcttcttcagaaaagcattgtcagagtacgggagagggagcaaaatagtgtaaaaatgaccctcgccagctccagctgcttttttttctttttttttttttttttgaggagtctaactctgtcactcaggctggagtatggtggtgccatctcggctcactgcagtcgccgccccctgggttcaagcaattctcccctctcagtctcctgagtagctgggattacaggtgtgcaccaccatgactggctaatttttgttgctgttgttgtcatatttttagtagagacgggtttcaccatgttggccaggctggtctctaactcctgacctcaggtgatccacccgccttggcctcccaaagtgttgggattacaggcatgagccaccacgcccagccccgtttgctttttttatgaaaagaatcactaccaatattttaacatgttacttgggacatatttcagcagctaggataacacataataggggaatcactgggaaattttatcatcttacctatacatgcgataaaaatctattaaagtcagctctatatcttggagcagaccttgggggaaaattagtgcagagctgggatttgaaggatggtgggaattggacacatttgagcatttcctcagtggttcttgcatttctccttatttatcagcctcctgatgtgagaaaagtaactacttaatgaagagatccaaaataaagaagcagccatctgggtagtttaatcttataaatacccagctgcaattttaagaagagatttagaagcatagtggtgtgtctcgggttcctggaccaggtagacccacaagctgtcacctcccacctggcccctgctctgtttcagattttgttcattgcagtcatggatagagagtttctgtcatgaagacacatcacatctgccacatcagtttagcactgttctaaactaggttgcgacagaatttgttcaatgtgaagtttttctgatttggtgtatattaggaaactcaatgtctttagggctgtgtttttccgataaacacatttttcccctgcagaggatgtttgaccattttctttgttactcctctcccagaagagaggaaacttctcacctgcaaggactttttgctccgcagttcccttcacactcacatattctcctgtgtcacagctctggggtatgtcttatgctcacccatcacgtagttcgttatcaccactacagatattgacaagctagtgaaacctgcgttttcattgcatttaactttgaaggcacacatctttgaacagaatgctaggtgctaatgtcatagcttacatctagatagggctctatttatgatgctgttatgttgtcttcataatctattgtggtattcagtttagctcataacagctgtataaattcaggttgccaagggtaaaagaggtgacccaacctcccatctggctgtattccccttgcacactcatatacctgtctcttctcaatgccctaattctatctcctataaaaagtttgcatcttcatgaattattcctatcttagtaaattaataaatggcctttcagaacaagtcataataaaaatacagctgggcatagcgatgcacacctttaatcccaacactttgggagactgagcaggaggattgcttgatgacagatgctcgagaccagcttgggcaacaaagtgagaccctgtctttaccaaatagaaaaaaaattgaatgggcccacgtggtggggcatgactatagtcctagctacttaggaggctgaagcaggaggattgcttaagcccaggaggctgaggctgcagtaagtcatgatggtaccactgcactccagtctgagtggcagagaaacactgtgtctcaaataataataagtagaaccatagcacatttaaaaaaaaattatctagctaatatcacatcaaaagactatcttcaattaatctttgcaaaaataaaggttatcaaggttgaccttttttaatttaatattttaaagtcagggtcttgctctgttagccaggctggagtgcagtagcacaatcatagctcccctgtcacctcaaactcctgtgctcaagccatcctcccaccttggcctcctgaggagccaggactacaggtgcacaccaacacaccgggcaaggttagccttatagacagaagttctctacctaggatgatttctatatttttgttcaccaaaaaaggttctctggcctaccagcagcaccctggctgcttttgctgactctagtcattccttaatgagtatacctggtagattcttactggactataccttagtgcagaaggatattagaatatcccacgcttgatagcagacctggttgaagaggccaacacaaaccagagtcagggataaaaccaagataaaaatctcatctccgctgacatcatagcatccatgcagttgctcaagccgaaagcatcctcgattcctctctgtttctctcccctgctcagatgatctgtactgatccacttttctccatctctgctgctacctcattagtccaagccatgttttgtctccctggaactattaatattagaacagccttttgacctgtctcctcctctctctcttgcttttcctgattttctctccccacgacagctggagggattttcttaacacttaaattggatcctgtctctgtcctacctaaaaacctattgtgactgtctattgctcttagacaaatcaaactccttctcatggtttaaaaggcagtacgtaaactagctcgtgtcagcctgactttccagtgtccttcctgccagtcccacctcattgcctagcaggtactcttgtctccctccatcgcctccacaggcctgctcccttgagctctttctgtccctccatgaggcttggaatctctcccctcctacctactcactgtcatctatgtcccaactcattgtctcctcctcagagacttcttgagcactgccgctcgtatcaccctgtttatttcctccacagaacattaatgaaagagttcatagattgtctcgtacacatacttaccaatttcttgccttattttattttgagacggagtctcgctctgttgcccaggctggagtgcagtggcgcgatctcggctggctgcaacctctgcctcccaggttcaaatgattcttgtgcctcagcctcccaagtagctggggtcacaggcgtgcaccaccatgcctggctaattttttgtatttttagtagagaccaggtttcaccctgttggccagactcctgtttgtcaaacttctgacctcaggtcatttgcctgcctgagcctcacaaggtgctgggattacaggtgtgagccaccatgaccagctgattacttgtctgtttttaaacaagtagcatggaggtgcctggaggcctgcgtttgtgtttcacttgtttctgattgtactcccaggaacaagcccagcgcctttcccacaataggtattgtataaataatgaatgaatgaagacagtctctattctcttgaaatgtaaacaggacagtgaggggtaaaataaaatggacagttatcatgtagagtgatgggtgctttgatgggagaagggttctgtcccttaggaacattcaggggaagtagtaccaaatactcaggaattagagaaagggtccaacagaaaatgatatctacagatttcaaggatccctaataagtacctatattgtgttactgtattaacattaatgtttcatttaaaaccagcgtttttcaacctttgtcattaatcgcccccttaaggggccttttctaggcagtttttttcctaatcaccatccctccctccataaaatttcataccacagacatgtctataccaccgtgtatttttctaggtactgtatgtgtatctctactttatactcaaaatgagtaagattgtttttttaccccctaagaacaaacgtttgcccccttggggatgagattgcccctgttgggaatgcatatattaaagcatttaatatcaatcataggaccaagttttaaagaaaatgcagttggtacgtctgcacagtacttgcactttaaatgtcaatggactgtgtagtatttcaaaagcacacacatgcacaattttctttccaatggaggagacagatgatactggttttttcaaaagtgtgatatcgatggatactgtggctcacgcctgcaatctcagtattttgggaggccaaggcaggagaattgcttgaggccaggagttcaaggcctgcctgggcaacatagaaagactgccccccgctacaaaaaaattaaaaaattagccagacgtgatagcaggcacctgtggtcccagctgctgtggaggccaaggtgggaggatcactggagtgcaggagttcaaggctgcagtgagctatgactgtgccactgcagccttgggtgacagagtgagacccaatctcttaaaaaaaaaaaaaaaaagtggtattcatactcattgacgtgaaaagtcaacaccaaagtcataatgagagttcacataataatatccaccaatatgtgcctctggaaaaagcattaaaaggtgcatcagaggaacttatatttttaggaaaaagtgtgacagacaaatgcacagcagtcattgcacagtttggaaaggaacatgtgggggctggttgactccaagagtgcttggtgataggttgggttggtgacttagtaagaaagtgttgcctaagactttgatttagaaacggcacttaagttattaggtagatgagtgctgatagagttacttggaagaactgaggtaggagagctgtgtttgaagattcctggagataagaaaacattttcagagaaagagtgagtaatctggtttacattctgctattgctgttgttggaggttaattctgttgggaacacctgtgttcacacaggtaaataccaactggctcttccttaggggataaatagtgtataaagttggtgtagaaaatgctggtgaaggagtttttagtaatggaacttagcccaagggcaaattgtatatcactcaacacttttcacttgcttatctttcaggaattttaagaaggttaaggcactaaggttccttaagtgttttaactctgcaggccccatctgtgttccagctgctgttctgcaactgcaaatggattctgctttagtatgataataagaaggtcataacccagcaaaagtggtgggcttctaactctatccttttagcagaatttcttttcattagctgagtagaattgagcttcactggttggcagtgaaatgaggcatggcctagcttgatggtccatgaaggatgctcactgagggtgacattttgttccattaaagctgatgtttctatttataccaaggatagtttgtgcagttacaccggaaataagatatttcctgcgtttacagacatctacatgcttgcctttttttccatttcccactgaaccagtctcgttgttgtcaattattcttcttcctctatttaatggaatctttactttcttgacagatgaatgtacatgaccactttcataatgcctctcccttaagaaactgcctactgatcttggccaggcacggtggctcacacctgtgatcccagcactttgggaggctgaggcgggcttatcatttcaggccaggagttcgagaccggcctgaccaaaaccccgcctctactgaaaataggaaaattagccaggtgtggtggtacacacctgtaatcccagctacttgggaggctgaggcaggaggatcacttgaacctgggaggcgaagggtgcagtgagccaagatcacacccactacactccagcctggatgacagagcaagactccatctcaagaaaataaaataaacaaccagttctcatgagaatcctatcacgagaacagcgccaagatatagtgctaaaccattcataggccacccttatgagccaatcacctcccaccaggccccacctccaacactgaggattacaatttgacatgagatttgggtggggtcacagatccaaactgtatcactttccattcctccaggcctagcaaccactattctactttctgcgtctatgatgttgaccattctaactacctggtatgagtggaatcatatatttgtccttttgtgactggctaattttacttaggataatgtcctcagagttcacccatgttatagcatttatcagaatttctttcctttttaaggcagaataatattccaccgtatgcatataccacaattgggtttatttgattcatctattggtggacattcgggttgcttccaccttttggctactgtaaataatgcagccttcctcctgttccctttctccccttaagggcccttcagacctctgccttctaccactgggcatagtctacacacagatcatgacttttggctactgtcagtaatgatgctatgagcatgggtgcacaaatacacctccaagaactttgggtgtgggtgtatgtttagacagagtttcactctgtgtccaagctgcagtgcagtgtgcagtcatggttcactgcaggctcaacctcctggggctgcgtgatcctcctgcctcagcttcctgggtaaccaggactacagacatgcgccaccacaaccaactaatttttcattttctatagagacgggacctctgtatgttgcctaggctgattttgaactactgggctcacagtatcctcctgccttagcctcccaaagtgctggaattacaggcatgagccaccacacttggccctccaagaacttttgaaataaactctattaattatattcagaaaacttaatgctatcaccttagactgtatagcataaattaagttcctcccacatagcaatgcctccttttaagatgctgctgggtaatagtccttagtttaaatatgtcccagctctccttagcacagcagcagtcttttacattaactttttagagtaaaagaaaaattaggagagggccggtcgcggtggctcatgcctgtaatccaagcactttgggaggctgaggtgggcggatcacctgaggtcaggagttcaagaccagcctgaccaacatggagaaaccccgtctctactgaaaatacaaaattagttgggcatggtggcacatgcctgaaatcccagctacgtgggaggctgaggcaggagaatcacttgaacccgggaggcggaggttgtggtgagccaagattgcaccattgtactccagcctgggtgacaagagcaaaactccatctcaaaaaaggaaaaaaaaaaggagaaaatgtttggagaagtactaaatataaaaatcaacttatttttagtagaatgtatttgttctcaacacagctaattgttttagataattaccagccttggactacagacacatttcactaagacagaaaattatttttgaaatattttgatgatgcagagaaatcatttaaccaattctgctatctcattgtcttttatgaaacactccctttaaaaatatacaagtattttagactatgcaaacatttacgcttgtttgaaactaagtaataaaatctattaaggttttctgttgcaaatgaattcatatcttcctgtggagtcataatttaagataaaaatagtgagattcaagttcaaaaacaaatttggcaaatcaagtattgtaaaagtctaggaaatgtgaaaattttattctagttgactttcatgttttactattaatttgcatgtggtgaattcctacttgcattgattctaaaaggttgtataaactgtatgaggatgggaattgtgtctgtttcatttactgtatgctcagtacatactagtactcaacacatactagtctcaatacatgctgggtacatacaaatgaataattacaacagtatcatttagaaactcttccatagtctttcttcatgccttaacatggaattaataaacaaaattttaagaaatgtcctacatataagacaaaaaggtcccaaaggatataaataatagtcctaataaaatcaagattttttttcacttgttattagcatcctaactgcaatggccaactaattcaaaggcctatgcatactattatactattaacagtaggaaaaaagtaaggtgaacttttttttttttttttttttgagacagagtctcactctgttgcctaggctggagtgcagtggtatgatcttggctcactgcaacctccgcctcccaggttcaagcaattctcctgcctcagcctcccaggtagctaggattacaagcacccgccatcatgcccagctaatttttgtatttttgtagagatgggttttcaccatgttggccaggctggtcttgaactcctcacctcaggtcatctccccgcctcggcctcccaaagtgctgggattacaggcgcgagccactgcacctggcccaagatgaactttcacaaacattttttaaaaagacttctgctcctgttgatagctcaacattgaagatactatgaatttttagttaaaaattttaaaaacatacagttttggcttctgtcaaaagaatattgctgcctcattgtcacagctatagccaagaacattaaaatctcatgtcctaatgacactagaaacattagaccaattgtcatttgcccctcccagctatcatttttctgtttcttctgcagaaatatcactatcctttggaacaattttgaaggaaggaggtggctgagattatcccatgggacttgtggttttctggactgagaccattctttcagagtttcatggggctgaccgccaccacaccacaaatcacctcaatgctgggaatacctgaatcatccaggctttacacagccatacagtggtgctgccagttaggagctaagaatttctcacctggctgtggtgctctatggcatgaccaatgcttgggtgaaattcaccaaaaacagcaaatagttatttctcccttttttattattatgtatcatattattgctaactaaaaagatccataatgttctagatatgttatgtagttatttgggcagttcttactctccagctgtttgtaaaagtagaatgctggccgggcgcagtggctcacgcctgtaatcccagcactttggaaggccgtgatgggtggatcacctgaggtcaggagttcaagaccaacctggccaacattctgtctctacagaaatacaaaaattacctgggaatgacgatgggtgcctgtaatctcagctactcgggaggctgaggtgaaagaattacttgaacccaggaggccgaggttgcagtgagccgagatcgcaccactgcactccagcctgggcaacagagcgagactccatctcaaaagaaaaggaaaaaaagtcgaatactaacatatttgggtttcatttaagaaaatcatatcttacattattatttatgtatgtatatgtccatacatatatacacacgtacacacatattctcaaatggcaagtgggatcatggacatctataatcatgcataaaagaaaggcctgggagagattaggagtgttgttttaattcatgttttacctctttgtttgtggctgtcagtagattaacataaagcatgttggaaagaaccagggattatcttctagcccaatgtattcaacttctgtttgcacatttacattctttctctgaatgatgagctctcggaggtttagtagggataagttccaagggaagcctttctcaaattcatcacttacaacatttatacacacagctctgatagttaagtaggactgactttttctaatatgtgtagggatatttcaaaattatttctattttttcctgtgggagttctgatgtatacaagcctagagattgagtttagtgatggtgccagggaagattttcttttcggcaggttaaaaagtctttgaaaccctcccatttaaaaaaataaataaaggattctggttgggcatgctggctcacacctgtaatcccaacaccttgggaggtcaaggcgggaagatcacttgagcccaggagttcgagagcagcctggacaatgtagtgaaaccccatctctacaaaaaatacaaaaattattatgtatggtagggcacacctgtggccccagctactcaggaagatgaggtgggaagaccacttgagcgtgggaggttgaagctgcagtgagctgtgatagtgccactgcactccagcctgggtgaaaaagcaagatctttccaaaaaaaaaaaaaaaaatccactttttgctctatttcttttctttcctttttcttttttgagaccgagtttcgttcttgttgcccaagctggagggcaatggcgtgatcttggctcactgcagcctccgcctcctgggttcaagctattctcctgcctcagcctcccgagtagctgggattacagtcatgcgccaccacgcccagaaaattttgtgtttttagtagagatggggtttctccatgttgatcacccatccttacctgatctgcacacctcggcctcccaaagtgctgggaatacaggcatgagccactgcgccctgcctttcttgctctatctttacaccagcatcccttcttcaattacacacaattctttcgatccctatcctcaaggtgccaggcgttattccacctttatcttttgaactttatccagagtgactgtcttgctgtaacagatcactctctggtcagacccctttcaaggctttaactttcttgtttgatagcattctcccttttcagttcctttcaaatccagtgttcatgacttccctgattctatcaagatatatttatattttttgaatgcgtgtgctttaagccagtggtccccaacctttttggcactagggaacgagtttcctggaagactatttttccacaggtggggagggggtgggagatggttttgggatgaaactgttccaccccagatcatcaggcattagttagagtctcaacctagatccctcccatgtgcagttcacaacagggttcacgctgcaatgaaaatctaatgccacccactcacccactgctcaccgcccccagctgtgcaggagacccctgctttaggcatttcgataaagcttttttttttttttttttttttggcgttgtaccatcacccaactctgcaactcctcgaacagtatgagtgggaaatgccagtggcttccaatctatcctttggcactcgaggagggagtttatccagtatctgataagacatagctgccttggcatctgcaaactttcctggagctctggagagatgtctgaaattttattttttccatgttggttgttcacttattttaggaagagatacctctccaccctcacagccaggaatctatcccgttctagagaatcggtactgtgttttgctcattttccccatgcacacgaacttcttgcatgagattcccagcagtcttgatttcataatctttctccagagctttgtaaaatgtccaaggatcctgggacagaatattcactataagaaattattaagctgtctaaaaacagaaatagcttttacactgcctgtaagacagcaaataggagcgctggttggttgattgattgattgagacagcgtctcactctgtcacccaggctggagtgcagtggtacaatccgcagctcactgcagccttgaactcctgggctcaagcgatcctcccacctagtcttccaagtagctagcactacaggtgcacatcaccatgcccaggtaatttttgtattttttgtagagatggggtcttgctatgttgcccaggctggcctcataattcctgggctcaagctatccttccacctggacctcccaaagtgttgggattatgggcatgaaccactgcaccttgcctaggaactatttattaagcaaatgtaaacagtgttcactttcatatcatctgagaggacttttatacctttccctgtccctcaaactttgtattctcttttgctttcagtatttttagcatctctttttactgttaaaaagtgaaaagtatctctttcattttttagtattttatattttttacttacgtattttattttttatttttatttatttatttttgagacagaatctcactctgttgcccaggctggagtgcagtgacacgatctagtctcactgcaacctccacctcccaggttcaagagattctcctgcctcagcctcatgagtagctgggattacaggtgtgtgccaccacgcccagctaatttttgtatttttagtagagacggggtttcaccatgttggccaggctggtctcgaactcctgacctcatggtccacccaacttggccttccaaagtgttaggattacaggcaagagccaccgcacccggccacttatttcatttattgacctcacttcatgctccactaagaaataaaaacttcacagatagcaacagcctcatcttgccaccaccaaatctgtaaacctgcctttatctgtgccccttgtgtgttctccttcttccctcctgttagaagaagcatctctcctcctgtcagaatcctcctgttcttggccaggcatggtggctcacacctgtaatcccagcattttcagaggctgaggcaggaggatcatttgagcccaggagttcaagatcagcctggacaatatagcaagacctcttatctattaaaaaaaaaaagtttttgtgttctttgtttctcaccttccaagactttttctttctctttttggaatcaaggtcctgctttgtcacccaggctggattgcaatggcacaagcatagctcactgcggcttcacagcttcaacctcccaggttcaagtgattgtcctacatcagcctccggagtagctgggattgcaggtgcacgccacaatgccctgctagttgttttttttttgttgttttttgttttttttttgtagagatggggttttgccatggtgcccagactgtctggaactcctggtctcaagtagtctgcccaccctggcctcccaaagcaggattagaggtgggagccaccgtgcctggccccaagagttcctatcctgcagcatctagtcatcccctctctactggatcactccatcagcatgacatattatggacattatggagtggcccatgatcagagcccaaaacaccacatcccagctcctcccgctccatgcagcctcctagctctgccccccttcccagccaggcctttgacaaatgagtggtctgcacttaacttctcccttcctctcctcttcatgtccagatattcctcccacagctctaacacattgctcccaacaaggccactaacaacctctgtgctgtcagagaagtcataaacatcgtcttatcttacccaagctgtcagcggccttcacaatcgttgaaccctacctccaacttgacatgttctctgctcttggcttctgagacaccatgttctctggacatctcttgccagttctttttttttttcttttggggagggagtggtagggacagacagactcctatccctctgcataacttctcaaagttagggttctttagcacttagaacctggctcttttcattagccaggtgtggtggtccatgcttgctacttgggaggctgacatgggaggatcacctgagcctaaggaggtcgaggctgcagtgagcagtgatcacaccacagccttccagcccgggcaacagagtgagaccctgtctcaaaaattaaaaaaaaaaaaaaaaaaaaaagaatttggctcttttctctttacttctcactcttagattcaatttttatttccaagcttccccacttgtatattcacacggacctcaaacttacccaaatcggagcacctgattgcccacctctaccacccaacatgttcttctctcaggctcccccttttcaataatggccctagccatcaataagccctgttgtttctataataactctaaaatacacccagcttcaccactaccacacatctccaagccaccatccactctcatctggactctgcttctgctcttattcctttccaacgtgttcaaaaagttaaactggagaaaattgacagcatctgcatttacgcaggggcggtaggaatgggagaggaggggaggcattttaaaactatgtatttagtggttagaacatgcagattctagtgaaccaatgcaaagtgggaaagaaccaagaggaaggagtccaggttaaagggatattcaacagaatggggcagatgggaaggccaggctttgaacaggtgacttcgtcttgggacttgttgagctgtgggaggatcagatggatattcttggaggtggttggatatagaaaactagaaacagctgggcatggtggctcacgcctgtaatcccagcactttgggaggccgaggcaggcagattacctgaggtcaggagttcaagaccagcctggccaacatagtgaaaccccatctgtactaaaaatataaaaattagctgggcttggtgatgcacacctgtagtcctagctactcagaaggctgaggcaggagaattgcttgaacctgggagtgggagtttgcagtgagccaagatcatgccactgtgttccagcctgggcgacaaagcaagactctgtctcagtaaaaataaataaactagaaacaagacttcagggctaaatatgtacatataggaatcatccatgataggatgtacttgaagccatggaggcaaataaaatcacctgggaaaaaatgtacagatgagaagatgagagtgtaatcctgcttcttgccgcaggttgagtttttggagcaccctcgttccaccttctagtcccaagcgtgtgttcctcttctctccatagcattaccctaccttcatgtggtcctggttacttcctcccaggatgcatgcaaaaggaagcacagtgttccacattcccttttagtcttgttgatcccaaagataagtacgtcatccaacttcttcttttttttttttttttcaagatggcctctccctttgtcaaccatgctagagtgcagtggcatgattgcagatcactgcaacctctgcctcccaggttcaagtagttctcctgcctcagcctcccgagtagctgggattacagcatccaccacctcgcccagctaatttttgtatttttagtagagacagggtttcaccatgtttcccaggctgctctcgaactcctgacctcaagtgatctgcctgcctcagcctcccaaagtgctgggattacaggcgtgggccactgcgcccggccccaacttctttataaaggttttgttactgaacattttggcacttaataaaattatctaaacctcccaagagagtgacaacacttgacaaacacatacaggcacacctccctaccctggggatgacttatctgacattccagttacggtgcacgaagccaagaatccctaagtagcaaataaaacctttcaaccattgaagtagagttataacttccagacactaaagctggagttcgtcttttgcctatttaatctatatattttttattttttagagacagtgtcgctctgtcacccagcctagagtgcagtgacatgatcatagctcactgcagcctcaaacttctggactgaagcaaccctccagcctcagccttctgcatagctgggactacaggtcccagcacaccaccatgcccagctaaattttttacagagacgaggtctcactatgttgcccaggctggtctcaaactcctgaccacaagcaatgctcctgcctcagcctgtcaatattttacctgtatttctcatcagcttggttttttggtcatggttgttaatttttgaattatatgaaagtcctacatagaaggttctctcctggtgttttggcagatgtaagaaaattgatttcgtttgtagctgttaatttgagaatccattgtagatactagcaatttctgaaggaataagagattcacactttaatgggacttcacaatctttcatctaaaaattctagctcctggtagggagacaagttccagacccacaactattagaaatatgttaataaactgggccccggattgaagcatgtctaaacaaactatggaatttaataatgtccgaataatgtggaaataatgttttcagtggaataggatgaggctgggtgtggttctcacacctgtaatcccagcactttgggaggccgagacgggcggttcacttgaggtcaggagctgagagcagcctggccaacatggtgaaatcctgtctctactaaaaatacaaaaattagccggtcatggtggcaggtgcctgtaatcccagctgctagggaggctgaggcgggagaattgcttaaactcaggaggcggaagttgcagtgagccaagatcacaacactgcactacagcccaggcaacagagcaagactctgtgtttgttaaataaataaatggaataggatgaaacagaaaaacattgtcattttttgaaaactctgaaataatctattctaaagtaattcaattgaaataataaattcactttgcattctccttttgccacaagattcaaatatttactaactggcatcaacactggtgttcaaattcagtattggcaatttcacacttgaagactgtctgtgttcccagagagtgttaagtctaactttgaggtccacaaatatttattggtgtctggtgtatgccagcaactgggaaaacaataggaggtggttcctacctcaaaaagcttgcagtttggtgaatttacagtctagtaagactagacctacgtaaaagatacagagcaatgcaaaacagtagatgtcagatgccatttgactaacatacgcgttaattgctgcaggatttctagggaaggagaatctggtgggctgcagtaggagaaattggaaaataatttactattctccattgacagtggcagtcaggaacctgggagcccaatttatttgtcccctcaacccaactcaaatgggtcctcccttgggaactttgctgccaacttgctcctcttctaaacccctccccaggcacagtctatcaaccccaactttgcaaaacttccattttttgttcttaactatgctaaagtactcacaatgcattgcaattgtttgtaagcctgtctcctctacaagattctgatttcctgttttgttatgttcatctttgaattcccctactgcttagtatgatacatacaatattgttagtgtccccaaaaagtgtttttttgtgaattaaagaaatgaatgaattcacaatgtatgacttgggccttaaggaagatggcattcctacatcttaaaattagtaaacagcatacctttaccaggcacatgttgatcagaaataaaggaaagtaagtagcctgtagaactggggtgctcaaacaccaatttttctcaggattactgaaaaacttaaatatacaggccaggtgtggtggctcacgcctgcaatcccaacattttgggaggctaaggcaggccgatttcttgagctcgagtttgagaacagcctgggcaacatggcgaaaacccatctccacaaaaaacactaaaaaaattagctaggcatagtggcatgcatatgtagtttcagctacttgggaggctgaggcaggagaatcgcttgagcctgggaggtggaggttgcagtgagctgagatgacaccactgcattccagcctggagtcagatcctgtctcaaacaacaacaacagtaaaaacaaaacaaacagacaaacaacctttaagttatacagctaaatataaagttcaccccaaacttagtaaatctgaatctgcaggcattcaggcaaaactgcagactgagcgtctgattttttttgttttgttttattttgttttgagacggagttttactcctgttacccaggctagagggtagtggcacaatctcagctcactgcaacctctgcctcccgagttcaagcaattctcctgcctcagcctgtggagtagctgggattataggcacgcaccaccacacccagctaattttgtatttttagtaaagatggggtttctgcatgttggtcaggctggtctcaaactccagatctcaggtgattcgcccgccctagcctcccaaagtgctgggattacaggcatgagccaccatgcctggccatgcatctgaattttttaaaggtgccataagtgatatacagccaggtggttactataaaatgtttgcagataactggcactggttgctatgaagaagcaaatatttttaaatttaataatattaagaattgtttgacccaggagtgcaaaagcagcctgggcaacaaagcgagaccctgtctctacaaaaattaaaattagaaaatcagccatgcatggtggtcccagctactctggaggctgaggtgggaggattgcttgggcccaggtggtccatcctgcagtgagctatgagtgcaccactgcactccagcctgggtgacagagggagaccctgtctcagggagaaaaaaagagaaagcacagagcctagtttgttatatcacccttgggggttcaaggtcagcaccatggacatcgccattggatgggttggtttttatcattccttccttcacaccagtctgtcaattaccccatcttcctttatttcgttgctaatatttatgcctctctagtgtcatcccacttgatgtatttaatatgttgttggcaagcatggcagttagctcaactttttagcagctgtattttgaatgaaaaccaacctcatgttccaagtcctcttgcttaattctagcaaattcctaaaccgtatccaaatctagaagtctgacccctatgtggggtggttcttaggaaaacttatttagactgtattacaagtagttcggttctaacctcttaattttacatttgtacaaattgaggctcagagagatgacgttcttgagatggagagttactgataataaactaagttcaacagtgttttcatggtttggtccagaagttactataaaatcgtaaccacatccatggaaggaatatctagttactaataaaaataaatctaatggttgatacagtttctctaaatcctccctactctttattaaaacctatttaaccacatttatacatgtttatgtacaatgttatccaccccaataagtcctgggatcttgaggttaagagtcctggttctattcatctttgaatacaccccaacaacaaaaacagagattaattatactcatattttttctttatcatgctataaatccactttgcagttaatatctatgaaaattaatgaacatttaaaataaagtattcaacttaggaattgaatatatattatatatttattgaatgcgttttcatctctatttaaggaaaccagataattgcactagccaaaataaaaaaatttaaaatccacattaaaaagaaatgtattcagggccaggcatggtgcctcatgcatgtaatcccagcactttgggaggctgaggctggaggatcacctgaggtctggagtttgaggttggcctggccaacatgtatataatatatatattgtatataatgtatagtatatatcatatagactgtgatatattgcatatattatatatagactatgatatacagcatgtgttacatatagtatataatatatggtgtatattatatgtggtatatattatatagagactgatatactgtattgtatatattacatatgatatactggatagactatgatatactgtgtatattatatatactatttacgttattctgtatatattatatatacactatatctctcacctttctatctaaacctgcttcagttgcattgcatggagcctttgcatacagtttgttcacccctaaattatacatgcagttcaccagatcctattacgctatgtctgttccccctttaaatcgatttttcacaagcacttagcttggtgtcttcagcgtctggcacctggtaggcattgagatgtttgttgcaatctttctcaaatgctgggtgtggatggtggtggtgtcagcagcagaattaaaagataaaggaaaccatctgtccttaaaggaactcaccctggtcacagagactgacatgcaaggggaaagggtatgaatgtatgagccaagcatgccagtgtccgttctcctggttcccaacaacagtgttaattttatggtagatgccatttcaagtcccacagccatcgatgtggtcaaatgaaaggtgttacacagggccgggtgcggtgggtcacacctgtaatcccagagctttgggaggccaaggtgggtggatcaccttaggttaggagttcaagaccagcctggccaacatggtgaaaccccatctctactaaaaatacaaaaaattagctgggcatggtggcgggtgcctgtaatcccagctactcgggaggctgaggcaggagaatagcttgaacccaggaggcggaggttgcattgagccaagatcatgccacagcactccagcctgggcaacaagagtgaaactccatctcagaaagaaagaaaggaagaaaggtattgaacagaattgaaaagtttgtcagatgagtgtttctggaagaccttaaaattaagaaattatttgttcataataaagactacccttttccctacagaatgtaattaagatatttattttttataacctaaaaattcgtctttgtcagtatcattttctgcaagataggaagctattatcctgcagccactggtttttgtgaaactgcccatggtttacgcctttgtatttttttcctgtgtcctctggagcactagttagccaaagtctaaaattggagcagaaattatggggcagtggagttggaattacagcttagactcctgtctctaccacatgtaactatggcctgccatctgatgttcttcatttgcaaagtgggaataatagtacttaatatacctgttgaaaatatttgactttctgactcagaagggatcttaaaaatgtccttttataattgaggtaaagaagaaatcgctaggtaggaaatgtatgtagtaaatgatgaaatctgtaaagatgttttaaaaattgtaaatacctctacaaatatcatatactactcaagcaacatcctaacatcactaggcatttgttttctgtttaactgcctttggaagacctgcatgtaaagtaacaaatatgtctcaccccagacgtgttcaactcccgtatctccctttttcattacagtcatctctctggctccttcactgcccccattcctatccatctgctctttgatgtcatatgcaccttacaggtttcagtttctcttcccggctttgctttcttttctgcttgtcttgagccccatggttgactagctgaagcattctcgaataaggagtctcaattcctttaatatccggcccacttttcttctttttttttttttttttttttttttttttttttgacatggagtctcgctctgtcacccaggctggaatgcagtgctgggatctcggctcactgcaacctctacctcctgggttcaagtgattcttttgcctcagcctctcgagtagctgggactacaggtgcacgccaccatacatggctaatttttgtatttttagtacagatggggtttcaccatgttggccaggctggtcttgaattcctgacctcaggtgatccgcccgccttggcctcccaaagtgctgggattacaggcatgagccactgtgcctggcccccagcccatttttctacgcttcttgcctaccttggttccatgataaaagccacctccttagcctgttaacccatacaatggaggtttagggagtgggtggaagagctttagtgtctttggtttaaatttaggtctgttttaaaattgtgtctgatacaaccacatctccttaataaacgtattggtttactattttcagttcagtctttagaaaacaagcagcctttcaggaagaatttcagagaggtttggttctcaaattttgtgtgcttctaaatattctttataccttgcttcaaaatgtagctacctgagctcacctttctgtagccatttcagtttattaggtttggggtgaaatgtgccatttgtattttcaacaagccccaccccagctgctgaaaatgatgcaaaatcaaatttgagcatcgctgctgtagaatacattctctctttcttccaatggagagttccattcctgaatgtgggatatgttgaaatggtgcagccaaatttgcattgttgttcggtaatatcagtggttcttaatcaaagacatgtatgagaatcaactgtggtgcttttgaaggtcatcactaaaaattgtccacgctttagctccacccactggcaattctgtgaaatacttttcaggtggggccccgctcgcctgttaacgtatcacaggtgatttctacttggtataatatggtatgacccatctgcagtggaaacaaatgcctgttttggataggagtatttcaattcaagttaatatgaattgataaatacacaggtaatatttgggttgttattcaaagaacttataaaagtcatatcttgtaaaagtctatagatttattacagccttttaaaaaatattgccaggccccaagccctgaaaatatgttgcgcttgctccttcccttactgaaatcacatttaaattcagaatcaccagtgctagtttactttcagttcaagacagcaagcctgaaaatagccttaatgacgcatgcagagcattttcctaggaacagactctggacttattagtgtctggagccatcagtcaatacttttctggtgcactggtgtgttagtaagggatgccagaaatgcgtgccttctcttatcagtcacccggagaattcacgtaacttgctttaaatagccgaagtgaagaaggagattgactttacagttgtgtttgcttctttaaaaaatatacttatcttttcctagctgtaaaatagcaatcgaaaactgccatctaaagtgaaaaataattccctaaggtttcaatagggtttttcttgtatcagaaccagggccagggtgtaactggatttaagtgccagacaaggagctagaagctgcaggtgcagctccccgccacgctgctctctgtgaccttgagtgagacacaaaattgctgggcttccgtttttcattttaaaatgcgagggttggatttgctcgctaagagctcttttatctctaatagttaagatgatggaacatgatgttttgagatgttttgctgaaatttctcacatagaaaatgggccttctgaaaacatataattatagttttgggtaggaagaagctgtcatggtggcgaaggggaacattgcaaatctgaacatgaccgcagctggcgggagaataatgtgttagaattgaaaggcaccctgcagacttgctgtttaatgtacaaagaagcctagggccggaggggcagggggactctcagggacagtggaatctggctcaacggtcaccctctggtagcaagcaagacctgtctctgtgacaggtctcaatcaatggagaagcttattttgccgacgttaaggacatgcctaggctcagcgtcctaaactaagccaagtgcaccaagccaggtgctcaggctcctaaactaaggtgcaattaggcaatcagcatggattgttagactgtacaaaggtggagatgccaattccccaactgttttcctaggggttgtgttcccacacacgcactttctccttagtaacagcgcacggctcctgacctggatgggtggccttagatctgtgaagcacatctaccttgccttgagaaagatgcaactcaatgttggcttccttagctccgtgccactcagcattgcagcaccgaaaggaaaactgtttcctctctactctcccactactctcaattcttccaacaacagatgtgggttgttttcccccccaacagcaagcagttctccagttctctgcagatgctaatgccacgtcctgcaattcaattctgaccttatctacctggagttagtgcagacccaacaggttgaaggctgagtcccaaaagactgtccccacttcagatgccagtcgcacaagtgatgagtctccaggttatcctcaacttctgtccaactcaactacagatcagaggttcccatggccccctactcaggttctataatttgctagaagggctcataaaactcaagagaacagccgacttactagatgactagtttattataagaggatacaactcaggaacagccagaggagagagggatgggagagggtgcagaacatccatgccatatctaggtacgccacccttccagcacggccctggggtcacacacctggaagctctcagatctccatccttttgggtttttatggaagctttgttacttaggcaccattgactaaatcactggccactggcgattaagtcagtctccaacccttttcctgtctctagaggtcagggtgttggggcggaaagttcaaacactttaatattacggttggttcctctggcacccaggccccatcccaaggctctccaggagaccccagccaccagtcattcattagcatgccaaaagacacttaacactttggagagtataagagttttaggagctgcattccagtaaacaggtgtgcagatcagataagcatttcttattgtattgcagtatcagagatgatgctcaccgctggaccacattccaagatatggctccacttattgatctttgaatgaaggggtaccttattgatcctccccctgaccttaccccaaataacaaatcataccagtactaaactggcagaactcaagattggttaggaaagatcctctgaaacttcgtataatgacagttaccttgttttgagtgtgtcccctgtgccaggcactgtgctgagagctttgtgtgttcagactcacttcacagttacaaaaccctctttaatatgtgggaactgggcttgaaatggtttaggtacacggtccagttcatagccaatgttgtgttactagaaagggatcccaatacagaccctgagagtgggttcttggaccttgtgcaaggaagaattcagggcaaggccatagagtaaggtgaaagcaatttgttagagaagttaaaaaaagaaaaaagaatggctactccataggcagagcagcagcatgggctgcttaactgaatatacttatagttatttcttgattatatactaaacaagcagtggattgttcatgagttttccaggaaaggtgtgggcagttcctgaaactgagggttcctcccccttttagactatatagggtaacttcctgacattgccatggcatctataaactgtcctggcactggtaggagtgtcttttaacatgttaatgcattgtaattagtgtattattgttacagtggagggtgtccacgttcttggcgtcttcaacaaagaattggacaaaacccacaaagcaaggaaagaatgaagcaacaaaagcagagatttattgaaaacaaagtatactctacatagagtgagagcagccaaagcaagcagctcaagagcccggttacagaattttgtggggtttacgtaccctctagaggtttcctgtgtttgcttggtatacacgctatgtaaatgaagtagcgactctccatcagtctgattggttgtaggaggagactaatcagaggctgaagcgatgttatgaagttgcaccctatgcacacatctgattggctacagaaagtgaccaatcagatgctgaagtgaagttacaaagttatacccctttgtaaatgaaaacttggccccagaccagcctgaatggttgcaggagggttctaaacagaggtactttcaatttcagaggcagagcatggtggcttatgcctgtaatctcagcacttaaggaggctgaggcagcccaatcacttgaggtcaggagttctagaccagtctggccaacatggtgaaactccgtctctaccaaaaatatttatttaaaaaactagccatgtgtagtggcacacacttgtaatcccagctactcaggaggctgagacaggagaatcacttgaacccgggaggcagagatagcagtgagccaagattgtgccactgcactccagtctgggtgacagagtgagattgaatctcaaaaaaaaaaaaaaatacagttctcatctgccacacagaaaaaggagggggagggtattgcaaagggcgtagcctttggtccttttgttatttgagcgtggaaagttggggtttttcttttgatttagttttaggaagtcagcgtgaatcagccttaggttccctgtctccaggccctattctcctgcctcataataaataataataataaacagggaagacgaccagagatcactttcatcaccatcttgatttaggtgggatttggccggcttctttactgcatcttgttttatcagcaaggtctttgagacctgtatctggtgctgaactcccatgaataagaatgcctaaactcttgggaatgcagcccagtaggtctcagccttattttatccagcccctattcaaaatggagttgctgttgttagaatgtctctgacagctggactcatccaaagcctttttagtaatgccatgactgtgtaaatccagaagtctctgtgacaggtctcaatcaatttagaagctcactttgccaagattaaggatatgcccaggagaaaagaacatggaatcactaaaacagtctgtggtctgggcctttctccaaaggtgaatttgagggcttcagtatttaaaggggaagagtgggctgcagagggaagatggagggtgtggtaattcacatattgcaggaggaaaggggcaggttagggaagagtcacttatatattcctccggctttcagtaaattggcacttttcaaagataagatggacacagagtaggaagtatttaaccttttagttgtagttgtctgcttaggaacaaaagggaaggcaacttcttgcatggctcagctttcagcttcatttttttttcttttggcagagtgaattggggttccaaggtttgtttgttcgtttgtttgagacggagtttcactcttgttgcccaggctggagtgcaaaggcgccatctcggctcactggaagcacctcctgggttcaagtgattctcctgcctcagcctcgcgggtagctgggaatacaggcagcggccaccacgcttggctaatttttatatttttagtagaaacgggatttcaccatgttgcccaggatggtctcaaactcctgacctaagttgatcctcccacctcagcctccgaaggtgctgggattacaggcgtgagccaccatgcctggccggagtttttattttccttttacaagtgcttcctcttctatttcccacagaacattctggaaaaccaccagggtagaaccctgacttctatttgaccacagctcaccattcttatatgttttgtgattttcattttcccttaagaattgtctccaattgcgacattcttcagaacttattaaagatatctgaagtgtatacggtgaaaaatgtatagaatggtggtgtcaccacttgatgttgagtgtgaaatgtgtgggtagtaaacttctgaagctgctgctgtaagggccaagggaaacttccccttcaccctgtgaaagtttgcagaaaaagcaactcactaagacaggttaattggagaaaaggcatgcaaatgtatttaacatgcacacggggagaatctcagattacttattccctaatagagttaagaagcttatacagcatcctggccaaacaagttatgggagtagggagaagaggaattccattgagaggatcactagggagaatgaatggatccaggaacagagataaatttgtaaatagtctcttgacagttaaggtttggttgcattcttggtattaacagggaggggaagcagaaaccattggtctctttggtgcctctgggtcctgggcagatacagcctttgctgtgggagggatgtgggggaccttgaggcggcttcttcatttcagcaggccaactactcaggaggctgagtcgggaggatcgctctaagcccagtagttcaaggttgcggtgagttctgatcctaccactgcactccagtctgggtgacaaagtgagaccccgtatctaattaaaaaaaagaagacacctcttcaaattttgacagagtttaactctttcatcaaaatacctatatattttatgtaatatggatcatttatatatacacatatctgtgtgtacatattgttatctgtatacgtatatctgtattatataacatatataatctgtgtgtatatgtatatatctttttatgtgtctatccttcctgacacccattccctgaattcttttctgccaagataaatgcaaagagccagaaaatctgtgatcctatctcttaacagatctgtgctgagaaattactgtaggtatacctggagttcttaataaaaattctagttagatgacttttgagaaccataaaaaaaaacttaagagaacttctgggatctctagtagggactaactttctctttacaaatgttgacaaattgttgagattgtctgcggagatagtacatgatatggtttggctctgtgtccccacccaaatctcacattgaatggtaatccccatgtatcaaaggaggggcctggtgggaggtgattggatcatgggggtggatttccccctttctgttctcatgatagtgaggttcttatgagatctgatggtttaaaagtgcgtgtgtctctctctctcgctcgctcgctctctcgctctcactctctcttgctctcctgtgataagacatgcttgcttcccctttggtcatgattgtaagtttcctgaggcctcctgttaagcctgaggaagtgaatcaactaaacctcttcataaattgcccagtctcaggtagttctttatagcagtgtgagaacagactaatacagtatatgaggtacacaagacagctcattacttttagagtcaagcattgtttttaatttaaaaatgttatctcccaggttgatcataggctgtattcattcagcttggctttgagtgactctgggctgtttgctaaaactaatttgtcctcaaaggaaagcgagttatgaataggggcattcaaaattttatgactttggttctgatgatactttcaaaaaatgaattttaaataattttcaaatgagagaaacaatcctcaaatatatgttcatttttttccaagggttttttgaaggggttcccattcacttggataggtttgtatatgcttgacattttttaattactcaaattatttgaggatcacaattcacttttaattttttttttaatattggagatgtgggatttgtttttttctcttttggttgtcaacctggttactaacagactgattctccttgagcatccagaataagacaagcccgttggtttaatagttatctgtggtaagtaccgtcatacacagtgtgtctcctttgtaaaacttaagtgcaatgaatgatgttgttactagtccaacgtgtttctctcttgctagaataatagcctcacagagcaaaatctctgtcttgttgagttctgtgttcccactgccaagaaagtatcctgagcctaagaggcacttaataagcacttaatgaattacaaaagaaatgatttgattacagaactaagtctaccaagtgtagctagttcagttgcagaaaacagaatccagaacttttatgtttccagtgcatcattttgtctctaactgcttaggaactatggttagggctaagagaaaatagacgaatttatcccctgctggtgggcatgaaaattagcacatctccctggaggaaaacttggtaaaatatttatcacatcttttcagacgtaaacactttttctaaccacataggagacttacataaacatcttttggtcaataatttgtctaaggaaataaggataaaatgttttagatatgtttttaatatcaaaagaaatgtctaataacagtgcagacccctcttacgtaccccttgaggtcctctcagcctcacctatctgttccacccctctctgtggcaattcctctgcataaggccaacaggtcttccttgttggccacaggtggtgtgctgtgaggctgtgctcatcacgcttgtgtgcacaaagcactgggcagacacacccagtgcagaaaatctttgaccaagaggtgaccaaaactgataatattacatcttcgctatatatatatatatatatatatatatatatatatatattttttttttttttttttttttttttttttttttgagacagagtcttgctctgtctcccaggctggaatgcagtggcatgatctcggctcactgcaacctctgcctcctggcttcaagtgattcttttgccttagccttccgagtagctgggactacaggtgtgcaccatcatgcccggctagtttttgtatttttagtagagatggagttttaccatgttggccaggctggtctcaaactcctgacctcaagtgatatgcccgcctcggcatcccaaagtgctgggattacagacgtgagccaccgtacccggcccatcattcctttaacagagtgtcttgagatgtggcttatggcttctcagaagatagtccagaaggattgagccatcaatcaatcacacctagtagcagccaagtctattacagcccctcagatggtctcttcctctccttccctgattccttctctggcccctctcttctattccctgagattgtactcttatataagctcagtgcctcagtatctgctgtctggagagctgagaagttgtcttgttgattaaataagctatatcatcttttaagtggctacagatatggacagccattacaactgacatgaaaaggcaataaatgaaataagctggtcacaattttttttctgagacagagttctgttgtgttgcccaggctggagggctggagtgcaatggcgcgatctcggcttactgcaacctgtgcctcctgggttcaagcaattctcttgcctcagcctcctgagtagctgggattacaggcgcctgccaccatgccctactaatttttgtgggtttttttagtagagatggggttttgccatgttgtccaggctggtctcaaactcatggcctcaagcaatccatctcggctttccaaactgttgggaatacaagtgtgagccaccacaccttatctcttattggtttttacagagactaactgagatatatttaagcaacaggacttctacatagtaagcacaatatagttgcaaattaaggcagttattaattattacagtctaataatgtctgaaaaaaacaagtctgtttatcacgctgaatcacatctgtatactgccacaggtatacctcagggaagttcagattactacccaagggccaaccgctgcttctgaaacatcaactgacagaagaacctacggaagttataatatctcctggctagactgaagatgccttgagcagatatttgggtgtttttttctgttttttgtttgttttgtttgttttgagatgcagtctcgctctgtcgcctaggctggagtgtagtggcatgatcacggttcactgcaacctccacctcccgggttcaagcgattctcctgcctcaacctcctgggtaggtgggagtactggtgcccgccaccatgcccagctaattttttgtatttttagtagagacagggtttcaccacgttgggcaggctggtctcgaactccttacctcaggtgatccgcccacctcaccctcccaaagtgctgggattacaggcatgagccaccacgccaggcctggggtatctttattaaagacctttagagttactacatgttattctcagagtttatttgtagatgttccaatgataaccttgcctctaacaatgcaccccagtcatagtggagcatctgtcattttagaaaagttttcatatattcagctcatctgtgccttcctcccgtgtctgctctttggaccttgtttcggccccttcaaacagagcaacaattggtcactaagctttccttcagaaagtctctcaacactgaagcaagggcagcagcaaaggttttaagagtttctagagagtgagtgatcacatggggtttcatgttcagaactcaccacccacaactctctgcactaatctaatccctgccaaaacatttggtttgggtcatggggacactcagctcaatcattttcgtttaaaaaaaaaaaacagaacaggctgggcacagtggctcatgcctgtaatcccagcactttgggaggccgaggccggtggatcacctgaggtcaggaggtagagaccagcctggccaacatggtgaaaccccgtttctactaaaaatacaaaaattagctgggcatggtggcgggttcctataatcccagctactcgggaggctgagacaggagaatcgcttgaacccgggaggcggaggttgcagtgagccaagatcactccactgcactccagcctgggcaataagagcaaaactctgtctcaaaaaaaaaaaaaaagaaaagaaaaaagaaaccaaaacatgagtataaaataaatgatgaaataaaatcgctgaaatttgtataacttctgatcgctagacctctgtgaacttagctaaaaccgcagctgttgcagtggagaagaaagtgaagattaccgaattaacataaaatataatgtgtctccccgtgcttgtcagcatgtactttgtaaaggctttccctggtgtttgtttagaatgctgctttggaaattctttgtagtgtataattttctaaataagtacagaatagacattttataacaatttaaatgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactcagtgttcagggtactgtgaatatttgctgggccacatttcgtgggctgagactcttcaaaaaatgatgtcactggtgtctagcaagattgccttatatcaggctgcttttcattttgtttttgaaatgtttgtagtttaagaaaaacaaggccaggcacagtggctcacacttgtaatcccagcactttggaaggccaaggcgggcagatcacttgaggtcaggagttcaagaccagcctggtcaacatggtgaaactccatctgtactaaaaatacaaaaattagccgggcgtggtggcgggcgcctataatcccagctacttgggaggctgaggcaggagaatcacttgaacccgggaggcagaggttgcagtgacctgagatcacgccactgtactccagcctgggtgacagagccagactctgtctcaaagaaaaaaaaaaaatagatacagtattagagaaaaccaactaagaaatgggagagctaagtgagtgaagtgtaactgataagcaaagagaaggaataaaaataccaagttatcactcaggagttacaggcagcagctacacaaaagatgtagccaaccaagggaagaagagagtgctcaaattagtgtgaacccagacacctgagaatccaaacttttcaatcgctgtagctaaagttctttggcccagtgtagacacaagctccctcactggggtctcaggatataaggattcaagccctgtctctcgtgccactctgtcctttcaaccacgcagtgctggattttaaacaggtagaaagtaaaatgtttattgtatttacccctttgcttaattcttaatcattttaaattttaataaatatctatatacacttgcacttacatatatatatgttgatcatataaaacaaaatcctggctgggcgcgatggctcacgcctgtaatctgagcactttggaaggctgatgcaggcagattgcttgagtccaggagttggagaccagcctggacaacatagtgaaaccctgtctctacaaaaaatacaaaaagtagccagatgtcatagcgcatacctgtaatcccagctacttgggaggatcatttgagcatggaatgcagaggttgcagtggggcgagatcacaccattgcactcagccctgtgtgacagagtgagaccctgtcttaaaaaaagtatatatttgtttcaaaacatattgtaggaacttttgcccatatataaagaataaaataaagttgaaaagtttccttccttaatggaaggattatttattatcattgaaagttagcaagatgatagagagaagttataatcagacaaggataactagaaagtaagatatcagtaagtgctaaataaagcagatggctatgacctggttcctgtaagtatagtcagtacctcttcagttcctgggtgcttcctatataagacttgatagctacactcccacctgaggcatttaatataataaaagagtagaacaagttttataagaagttagtgtacacaacaaataagtggataaaaaaaacggattagatcttcttgacctgtcttttctatagtccctctctctctctttttttttttttttttttctgagatggagcctcattgtgtcgcccaggctggagtgcagtggaacaatcttggctcactgcaacctccacctcccgggcttaagtgattctcccacctgagcctcccaagtagctgggattacagggcacccaccaccatgcttggctaatttttgaatttttagtagacctggttcctaggtctactaaagtaggttttcaccatgttggccaggctggtctcgaactcctgacctcaagtgatctgcccacctcggcctcccaaagtgctgggattactgatgtgagccaccgtgcccagcctcccatagtctcttacaatagggatctgggtcatttttttttttttttcatttctctaaaaagagcaaattgagagtagttaatatttaagacaaatccattatagacattaaaacaaactatgaattttccttttatgttattagcaattgacagtttcaggatgaaaattgaaaaccatactttgctatttagcatagtaaaattcacctttgtattaggaaatgaagaaatcaatgcataaaaatctaagtaactatattaatcatgatcagaaatttatttctatccttgagtgaatttcatttcactttttaatcataggtattcattctatcactggcacatttttattaaacttaggtatgcattgtgttatagcgttcaaattattagcttcactattaactcattagtcattgtttagggagaaaagctagaactgtagtgccatgaaattataatgtgtttattctatttcataaccaaagatatttttaagttaattatctcctcctataataattggtgcttagcagccttaggcctagtgattccagaaggctgtaagaaaataaaagttcttccttttctaaacattaaccaccttctctgacaagagcctgtgggcctccacacagcaggcctctgtggagcaaatagagtttcctttggatgtgagaaaaagcaagtcttgcggccaaaaagctgtccactaatatccttccagccctgccagattagttcttgcgtatacccatctgttaatgacagggtccaggcatctgtctctaggcagaaaagagcatacggcagtgagatgagggacttcaaggccaggggatagagggcatgagtcagggcagaagcatggagaaggtgggaaatttggggagcttgaacagatgtttctggaccatccttttgggtctgtaggccagatagtaatgaagcattattgtgtggggtaaatatgtgaggttcattgtctcacggcagggaaatcgaggacgtggacgtggaagaaatgagtttaagagcggaggtttaataggtgaaagaaaaagagaatagctctctctctctcttgcaaagagagaagggctcccaagtgcgtcatctggtttcatggtgaaacgcatggggtttcatagttgagcttgagaaggcgctgtctgctttacatagggcgcgagagattgttcggaccaggtgtgacatttgcatggtgcatgaagatgctggccagcccaccctaatctttcatgcagatggggtctcaacctggccagcaccatgttgtctgttcctcactgtacttgtggttgacaaacaaaagggaagatggagccaccaggttgcacatgcctggcccccaggtagcctttatctattggcacagctgcggcatttacctgtgcagacttttagcttgtttatctatgctttctgcttgatttttcaggctgctttttgttagaaaagaaacaatatgggggctgtgtttcattagaaggaagccttaccgaggactctcttaccctcactgtttgctgaaataatttatttctagctcatatatcagtaatagtgctggagtcagggtgggaagggaggtggtgaaaccaggtggttggtctcttcagcagccttctcaagatgagtgatttgtggaggggcgcggtggctcacgcctgttatcccagcactttgggagaccgaggtgggtggatcatctgaggtcaggagttagagaccagcctcgccaacatagtgaaaccctgtctctgctaaaaatacaaaaatttgctaggcatgttggcgggcgcctatagtcccagctacttgggaggctgaggcaggggaatcacttgatcctacgaggcagaggttgcagtgagccaagatcctgccacaaattgcactccagcctgggcaacagagcaagactccatctcaaaaaaaaaaaaaatgagataggaagacatacatggtctcatagtttataaaattccacaccaaggaccctgcacaggaaacactgaaaggctgctgcagcgaccctagttttacagagggaataaaaagtcatgcaaattgtacttttagtagagacagggtttcaccatgttgcactggctggtctcgaactcctgacctcaggtggtccgcttgcctcggcctcccaaagtgctgggattacatgcgtgagccaccacacccagccattcatgaaatacagctttctagatggtgaaaaagagatgtgaagagagaaacggaagatctaaataaataaaaataatgatttgtgccgggaactgtggctgacgcctgtaatcccagcattttgggaggccgaggtgggcggatcacgaggtcaggagatcgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacgtgaacctggaaggcggagcttgcagtgagccaaaatcacaccactgcactccggcctgggcgacagagcgagactccatctcaaaaaaaaaaaaaaaaaaaaaaaagaaaatcaggatttgacatcgctgttgatttcctgaacctcgagttttttaagtgcatctttgtacttaaaaggaataggttacctttatgagggacacccatcgttctaacatgtgaaggtgttcatttagtgtcacacgcaaggcagacctgggcccaatctttttttgcctttctttataccaaccaatttttagcattttgtaaattataactttcaagtcttcaaaatttcacataaacatgtaaatgttgtggaactgccatctacacacccctttaaatgaaaagcactctagtactgtaggagaaacacaggctttggagagagagagattttagcaccagctctaacgcttatggcctgggagaacatataaaaaaaaaaaatcttcagccgggtacggtggctcatgcctgtaatcccagcattttgggaggccaaggcgggtagatcacctgaggtcaagagtttgagaccagcctggctaacatggtgataccccatctctactaaaaatacaaaatattggccgggcacggtggctcacacttataatcccagcactttgggaggccgaggtgggcggatcatgatatcaggagatcaagaccatcctggctaacacggtgaaaccccatctatactaaaaatacaaaaaattagtgagccgcgccactgcactccagcctgggtgacagagcgagactctgtgtcaagaaacaaaaaatacaaaaaattaactggacatggtggtgggtgcctataatcccagctactcagtgggctgaggcaggagaattgcttgaacctgggaggcggtggttgcagtgagttgagacctaaccattgcaccctagcctgggcaacaagagtgaaactccatctcaaaaaaaaaaaaaaaaaaaaaaatctttcacaaatgttgtcttaaaatttaactttttttttttttcagagaaaggatcttgcaatgttgcccaggctagattcaaacccctgaattcaagccatcctgttgcctcagcctcctgaatagctgagactacaagcgtgtgccacagtgaatggctgggagaacttttttgagcctcagtttcttcaccttggaataaaacaattgtagctggggttaaatgaaatgtagcaatctatgtataatatacagcacattgtttgtcccttggccgacattccgaaagtggtagctttcatcattttacagtaagtcctgtcatgtacaaggtaaagaaggacctagaagaagagaatatgaatttcttaacatctcttatcacttacacattcccttctcaacaaatattgattggaaacatactggagacacagtgttgaacaagacatggccttggtgttttagtttcggttttttgagacagggtctctctctgttgcccaggctggagtgcagtggcgtgatcatggctcactgcacccttgacctcctgggctcaagcgatcctcccacctcagcctcttgagtagctgggaccacaggtgcacaccaccacagatggcttttgtttgtatttttggtagagacagagtttcaccatgttgccctggctggtctcaaactcctcggctcaagcaatccacctgcctctgattacagatgtcagccactgcactccaccaaacttggtgtttttaaagcacttttacattattgtctagataaagagatgccactcttctacaaattggtacttacgaatttattttgaggatctgttcggctttagtccacaaaccaatatgccacaaacttttaattctttatcccaaaaagggggctacaatgcatagatgatttaccagtcgccctcatgctatgtagcatgtgctcatacgtcatgtcgaaagtaccagaaactggaaaaggaatcaattcctttttttcttggcttggaacagggagaagcaaaaactggtagaaaagtctgacatcacctcttgggcctgaccctccatagccacaaaacaagttggccaggaatccaggtagaatctgcaaaagcagactccaggtctcacactggcctggcaataaagtctttaggatgttaatagaggttgagtgaaagtgaaatgaaggaccatattgtctcccaaccaacgtagtatcctaatgattctgtagagcaggatgaatctaaatctaaatgtggatttcaatagaattccgcaacagccatccctgaagctccttctacaggatcctacctagggctgtgggctatttctgtatctgtgctttctgcttttcttccccatcttactctacagctatgaccaagcctttctgataaacccgggccggtgggggagggggtagggtggagttaaagggtggcaggaaaaggacagcttgaaggacaacctattaactagagtgcacctcagttacattgggccttgggatctggaatagcttcgctttcctcaagatgccagagccctcttgtgtcccagcatgtcccagagcactgtgtcagtttcttatcacagtgcccactgttcctggtgttcccgtgaaacctctggaacaccaagattttttggcttctttttgttcttgcttcttgggactcttctttaccttaaggagaaagcacaataagaagaaagagtaaatggcccactggcctcaaacattcatatccaagaatcagttctattcatcagtatttatgatggaccatgcaggagtgaactaggaatgagctgaaccatgccccagggccatgatgctggaaaaccataaaaatctggtagggcagggtgtggtggctcacacctataatctcagccctttgggaggccaaggcgggaggatcacttgaggccaggagttcaagaccagcctgggcatcaaagcgagacctcatctcttcaaaaagtaaaaataaaaattagctgggcattgtggcatgaggctgtagtcctagctactcatgaggctgagactggaggattatttgagcctaggaggttgaggctacagtgagccatgattgcaccacttcgttccagcctgggcaacagaaagaccctgtctgggggaaaaacaatctggtaggcttccagaccaaaagtaacttttgtagttcgaacaagggcaagagccctgaatggtaagaggaaagagttccatgtggctctttaccattctgagattaagccaaaaatgaagatgtcaacttaaaacaggatatatttgattaacaaatggtttcatggataaaaattcaatgattccgtaagggatattcccttggaacttcaagttggttaaaaaaaaaaaaaaaaaaaaaaaaaaaaaaagcctgagcgtttgaggactatcaaagaaaatcagaatgaaagagatatgtatcagtacattcttgcattgttacactgttataaagaaatacctgagactgagtagtttatcaagaaaagagatttaattggctcacagttctgcaagctgtacaggaatcatggtgttggcatctggcttctaggggaggcctcaggagacttacagtcgtctaggaaggtgaagggaaagcaggcatatcatacatggctggcactggtgcgagagagaggtgggaggtgccacacatgtttagacaaccagatcttatgagaagtcttatcatgagaacagcaccaaaggggaaaatctacccctatgatccaatcacctcctaccaggccccacctcccacactggggcttacaattcgacatgagtctggccagggacacaaactcaaaccatatcaagatagaacactgtaaacaaagtgaatatgggaaaacctggccgggcgtggtggctcacacctgtaatcccagcacttcgggaagccgaggcaagcggatcacctgaggtcaacagttcaagaccagtatggccaacacggcaaaaccccgtctctactaaaaatacaaaagttagccgggtgtggtggcatgcgcctgtagtcccaactacttgggaggctgaggcaagagaatcacttgaacccgggaggcagagattgcagtgcgccaagatcgcaccacttcactccagcctgagtgacagagcaagactctgtctcaaaaaaaaaaaaaaaaaagaaaaaaagaaaagaaaagaaaaaagaaaatgagtatgggaaaaccttaccatttgctcaagtcccagagaatatgaaagaatctatatcacagaaaagcttcttgactttaacagcgagttagtttgtgtcgtgcatgtggcagatattaaactgtgttgatgagtttggtttgaggacgtttacagtggaagaccacccaggaaatgacttgtcttgggctttaatggggggtaaatacagagaaatatttacttaggtgtagcatttactttggtatatagcaaatgcctattaataagcacttactgtatatagttagccctctttatccatgagttccacgttcacggattcaaccaactgtggattgaaaatgttaaaaaaaaattacaacaataagaatgatagacttaaaaagcaatagaattgaataactatttgcatagcgtttaccttgtattaggtattataactgctctagagataaagcatacagaggatgtgtgcagttatgcgcaaatagtacgctgtctttctctttgtttgagatggagtctcgctctgttgcccaggctagagtgcagtggcacaatctcgggtcactgcagcctccgcctcctaggttcaagcaattctcctgcctcagcctcctgagtagctgggattacaggtctggccaccacgcctggctaatttttgtatttttagtagagacgtggtttctccatgttggtcaggctggtctcaaactcctgatctcgtgatccgcccacctctgcctcccaaagtgctggcattacaggcgtaaaccactgcacccatccaagtacactgttttatatcaaggacttgaacatctatagattttgagggtcctggaaacaatatcacggcagttatcaagggatgactatacacccaatactagcctggcctggtgcaatccattttctgtaatcccgttaccttaaagaatggcgctcttacccttgttttagccatgtgaacttatgcttaatgagactaaagaatttgcccaggccactcacctaataaatggcagaatcaacatccaaatccaggtccacttaaaatcccttgttcttgaacccatatgaatgaaattaatatggagaataccttccacattgtagacacactgcaagctgaagtgagaccagggaatcagaagtgacattgtcactggcctctttggtttagcatcctggggtcttttatcttggctacatctgtcccccgcatcccttgactgtactctaattttagaaatatagttcctgaagtaaagatattgaggaataggtatctgctgctcttgtttcctagttctataaagctaattcccatataaaccacatctaatggtagcatcattggttacaggaggtgaggcaagaaaggaggcacgttccaacttaacatcttaatctaagagcataaaattattacctgtggtctctggaattatacaccaatttccaccaccactttaatttctttttcctttttcagtcccctctttctgctactcagatgattgaaaagtgataaaaagttggtagaagtcataagattttctatggggtcttctgtcgagtcaggcattaaaaatgtgtcttacattgatgaaaaactatatgtgatgcttaaactctgtatcttccaaggaataaaagaaacatctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcctgtaatcccagcactttgggaggccgaggtgggtggatcacaaggtcaggagatcgagaccatcctggctaacacggtgaaaccccatctctactaaaaatacaaaaaaaaattagccgggcatggtggcgggcacctgtagtcccagctactcgggaggctgaggcaggagaatggcatgaacccaggaggcggagtttgcagtgagccgagatcgtgccattgcactccagcctgggtgacagagtgagactccgtctcaaaaaaaaaaaaaaaaaagaaaagaaaagaaacatctgaaagatgtgaaagaccatgctacaatttttttttttaaatcttggatctatacttttgtgatcagaaacttttctgaataatggatggatctactaatggaaattgtatttctagtggtaaaactgagtttgatgaagactacatccttaggaggctgaggggggaggattacttgaggccaggagtttgaggccagcctgggcaacacagcaataccctgtctctacaaagtttttttaaaaaaaataaaatgtaaaaactttaaaatatttttaagattacatctcactaaaaagtgcaccttgctttagtgctgggtacagtataaaacagtgtggcccatttggacagtagtttagaataaaaatttaaaagtcttaataactcatgtctgacacatgctacctctgggactccatcctaagaaaataattctaagtagaaagaggcttttgtacaaacatttttcaaagcagaatatttttcatactgaataatgttgtgaacctaagtatcaaagaagggtgaatggtgaatggttgagggagtctttttttttttttttagatagagtctcactctatcacccaggctggagtgcagtggtgcaatgatctttgctcactgcagcctctgcctcccgggttcaagtgattctcctgtctcagcctcctgagtagctgggattacagtcatgtgccaccatgcctggctaattttgtatttttagtagagatggggtttctccatattggtcaggctggtctagaactcccaatctcaggtgatccttccaccttggcctcccaaagtgctgcgattactggcatgagccatcacgcccggccaaaatatatttttaaaagtataaaaactgtgtgtgtgtgtgtgtgtgtgtgtgtgtgtgtgtgtgtgtgtgtgtataagagatgaggtctcactttgttgcccaggctggtctcaaactcctgggctcaagtgatgctcccaccatgccctcccaaagtgttgggatttacaggcatgagccacggcacctggccttttaaaaaaatatatattttttgctttttcatttttttatgtttaatattggatgaaatgcaatatgttatgattgtagctctggaagtaaactttatatacttaagaacatttctagaaaaaatagaaacatcatactctcaaggattgtgtttcagttgtacaggtaaataaatgtacacatttatttacgtgtatttttaattcccataattccacacaagaagcaggatccctggtatcactaaaaattaaagtggatgtcattcgagaccagcctggccaatatggtgaaactccatctctactaaaaatacaaaaattagccaggcatgatggcgggtgcctgtagtcccagctacttgggaggctagggtagaagaatcgcttgaacctggaaggcagaggttgcagtgagctgggatcgtgccactgcactccagcctgggcatcacagtgagactcagtctcaaaaaaaaaaaaaaaaaaaaaaaattacagtgaatgtcaataactggcttccaaatatttaactccacctcatgtctattgtgcctatatccagaatttggttttcctttcccaatctgcaaattgtgactagaccatagtaacatcagggatcttaagtcagtcttaacccagacaagaggcaggtagaacaaattaacttcggaaaatttggaaatgaaaatgggttctctctactccaactcccctgtgtcttctctggcaagtccaggtagagagcgcattgaatagggagaaactgctcccttctcctgagaggtcgaaataatttttttaaagaataggttaagccggacgcggtggctcatgcctataatcccagcactttgggaggccaaggcaggcagatcacctgaggtcaggagttcaagaccagcctgaccaatatggtgaaacgccatctctactaaaaatacaaaaaattagctgggcgtggtggcgggtgcctgtaatcccagcaactcgggaggctgaggcaggagaaccgcttgaatgcaggaggcggaggttgcaatgagccgagatcatgccattgctctccagcttgggcaacaagagcgaaactccgcctcaaaaaaaaaaaaaaaaaaaaggaaaaaaagaaaaaaaaagtaggttaaaaggaatatcacatgaaaaactatgttactttgtatatatcatgtatataagaaatacatagaagaggccaggcatggtgtctcgtacctgtaatcccagcactttgggaggctgaggcgggcagatcacccaaggtcaggggttcgagaccagcttggccaacacagtgaaaccctgtctcttctaaaaatacaaaaaattagctgggcgtggtggctcacgcctataatccaagctactcgggaggctgaagcaggagaatcaattgaactccagaggaggaggttgcagtgagctgaaattgcaccactgcactccagcctgggctacaaagtaagactctgtaaaaaaaaaaaaaaaaagaaaagaagaaaaaaagaaagaaagaaatatatagaagcaatccacttgcccataatgggaaagaaatacaataccacttagaacaataccattttcaccatttctgagcttacctgtttctttcatcttgtggataaataggtattagctaaagagagaataaatgcttatctgtaaattcttttggtttgatttgtttttttcttttttttgagacagggactgactttgtcccccgggctggagtgcagtcgcgtgatcatggctcactgcagcatagaccccctgggcttaagtgatcctcttgccttagcctcccaagttgttgggagtataggtgcctgccaccacacctagcctaatttttgtttttgatttttagtgagaagaggtcttgctatgttgcccaggctgatcttgaactcctagggtcaagcaatcctcttgccttggcctcacaaaatgctgggattacaggcatgagccaccactcctggccctttatctgtaaaatttcaaagcatcaaataaggaaagagatcttaattaatatctttagtagctgaacaaactcaagtaggagaaataatagaagaaaaagtcattgctttcataattcgttgcagccatgaatgagagttgctatagttgtagcatattttccccggctcttttctcattcaatgattgtacctttcggaattatgtctttaatgattaattaattaaagtagatgtttggggtagcaaggcagtgactaagtcctttccactgaaacggaagaactggggattttattcatgtttgtgtttcctgatttacagttgctacaagcgccaatgttgaaaacacatatttccgtggctcttcttcaccttcattacttgtagtgctttcaaagagaacaatggcctttttctagttcagaaatgggtgttatgtagctcacagctgggagatttcaagtgttttgaatacgaacaagctgttttgtgataaagaaccagtgcagaggggaaaccaacaatgattacagtagttattcagtatgtctttgtgtttgagggaaaaaggagggacagtgttgttttgctcttatttttttccctcttccttttcccactttagacaaagcccgttgcatttgcggttcggacaaatgtcagctacagtgcggcccatgaagatgatgttccagtgcctggcatggccatctcattcgaagcaaaagattttctgcatgttaaggaagtaaggagaataatttcattttctaacagcatgatgtttcaccttgacataccatttcttatttcctattcatatgccgtttctgtgaagtagcattgcacatcgctgcagttgtataacacacataactaaatcaatggctctcaacctctgctaatataaatataccttttaaagtggaaagaagtcacaggcctcttgcaataacttcagcgctccctggggctctgtggcccagaaattgggaactgctagagtagatgatccttttttatgcttaacctatacttttttttaatgtttcaccttgactaggtgtagtttttcctgatgcctgaagtctaggcatctggggagggtttaataataatatctagaattcatgactcttctctctgctgacagtgtctcaattcaaactactgatgacctttttcctccttaaatgctaaatttctgcagtgggtgagagaatggtaagaattgacaccaataaggcaacaaagaggtatcaggaaaagtccttttcctacatgctaaatgtctccaccttctagtgagcaatgacacaacctgcaaattggaaactttcatccttaattaaggtttgtttggagtcaacatttatcaaatgcctgccttgtggagcactgtgtaaactgaccagaaatttcccctgtagaatattctcagtgtgtgatcctgaggtttttcttggacctgaaggaatttatacttggagctcttccatctagggtatatataatatgtcataggaagtatgtgtaaatcgaaactcttcactgcactaaaggctgtcagcaaaggagttgataactgccgattaaaagaacctagggctgggcccggtggctcatgcctgtaatcccaacactttgggaggccaaggtgggcggatcacaaggtcaggagatgaagaccatcctggccaacatggtgaaccccgtctccactaaaaatacaaaaattatctgggtgtagtggcacatgcctgtaatctcagctactcgagaggctgaggcagaagaatagcttgaaccagcgagtcggaggttgcagtgagccgagattgcgccactgcacccgagcctggcgacagagtgagattctgtctcaaaaaaaaaaaaaaaaaaaaaaaaagaagaacctagaagcctgggtactatggctcatgcctgtaatccaagcactaagaacctagaagcctgggtactatggctcatgcttccaagcattttggaaggccgaggaaggcagatctcttgagcccaggagaccagcctgggcaacagggtaaaaccccatctctaaaaaaaaaaaaaaaaaaaaaattaacctggtgtggtagcatacaccggtagtcctagctactcaggaggccagtggattgattgagcctggaaattcaagacaggagtgagccaggatcatgtcactgcactccagcctgggcgacagagcaagaccctgtcttgattaaaaatagaagagcctagagaatttagagcctaccattttggtaacctctgaaaagagatgtcaaatactggctaggtgggaacaatagaaaaagttatcagctgtgcctagaatctcactttacaccaggaagttagattattatgaggtctcttcttgatgattgatgccgaaagggggatctttccaccatgaaaggaaaagaaaaacagaatgtatattcttcttcgacgtgttcaaggacagatttattcaatcgaggaaaaagaaggcaaatcacaaagatttaagatacatattccacctgcaagacataaattgtcaacatcacacaagtagagaaatcatctgtgaacatcgcattgtatatttataaaactgtttgcacaaaggtaaattgtcctgtgacatgaaatatttaaggtacacttcaatatttatctctttctctcaataattccaattggtctgattatataaggggaagatttctgtaacagtacttcctaaagatctcttggtaggatgggctgttattctttgaacccagagagcttatccctactcatggtgacagcagctgctgcaagggaattcagcctggtcctacggcagcaccaggacagacaaggaacgcagagcctttgatagattgctgaggacgctaaatgcatttcttacatgtgaaacccatgagccgaagggtttcttgaatgataatatttaaggcatagttaatggtcattgccatatttctctcgactgaaaatagtgtggaagaacaaggatttgaccttctgtgcactgatttttaatgcttttgattttgtgtttagaaatttaacaatgactggtggatagggcgattggtaaaagaaggctgtgaaatcggattcattccaagcccagtcaaactagaaaacatgaggctgcagcatgaacagagagccaagcaagggaaattctactccaggtatgagacagatgtcaagtgtttgcataaaacttagattataccactatctgtgtactgttgtctgctgtattctgtatcctttattatgtattaacaaggaggctggtaatatggtttattgatagcatcacaaatcttgcattttcctgcatttaaaaaacttcagtccagcacctgattttcaccctatttgggaaagtgtcaaattattatcattaatgaaaagagctaaggtcatagagtattaaattcaggctccagtgcagaggaaaatctgaaaccttaatcatttactgaaaaatagtctggcacatcatagccctggtgactaatcccactgtctgtagctgcctggtatggctgggagatgtttgagagatgacattctcagacatcatcaggcagtggcagctcttgtcatccgttagtttcattttcacctgagaaactcaattttcagttctacccactgttaagcacttaaagagaagcgaagtatgaaacaagttaaaactgcctgtgcagatggcaattagatgagttatgtaagaagctggggctgaataatccctcctaggatttgtgaggttgtctgtccctctctgaaagaatcactagaaagacttctcgtagatgtactgaattttccatggaatcgtatgcagacgggtctaaggacgcagcatgcctctcccaatgtgaaaggatgggacatgggcaaggcctttcttaaatacgaatcgctggatttctcttttctccatcttacatcttatttgtttatctaagatgcaaatccctttgtcagtgataatactttactgtgagcaagtatttttttcaagcatcagcagatgagtgaaacagaatatgctttgtggtttggaacacccatcctcattaactggcttttcataattgtcaagttcatttagttcagacggattcctctgtgttttgagacctccaccccagaactgactttcattaattcctgggttattgagagcactcagatggtgagatgcattcagtcatataaaagtagaggcatgcataaaaaagaacaaagattggccgggcatggtggctcatgcctataatcccagcactgggaggccgaggcagacagatcacctgaggtcaggagttcaagacgagcctggccaacatggtgaaaccccatctctactaaaaatccaaaaattagctgggcatggtggcgggagcctgtaatcctagctactcgggaggctgaggcaggagaattacttgaatctgggaggtggaagttgcagtgagcccagattcgtgccactgcattccagcctgggcgacagagtgagactctatctcaaaaaaaaaaagaacaagatcatgtcttttgcagcaacatggatggagccggaggccattatcccaagcaaactaacacaggaatagaaaagcaaatacgggggccacgtgcggtggctcacacctgtaatcccagcactttgggaggctgaggcgggcatatcacaaggttaagagattgagaccatcctgggcaacattgtgaaacccccgtctctactaaaaaaaaaaaaaaattagctgggtatggtggtgtgtgcctatagtcccagctacttgagaagctgaggcagagaatcacttcgaacccgggaggcagaggttgaagtgagccaagatcgcaccattgcactccagcctggggacagagcaagactccttctcaaaaaaaaaaaaaaaaaaaaaaaaaaaaaaaaaaaccgcatgtttttacttataagtgagagctaaacattgagaacatacaccaggaagggaacataagacactggggactacttgagggtggaggatgggaggagggtgaggatcagaaaaaccacctcctggggcattatgttcattatctgggtgacaaaataatctgtacaccaaacccctgtgacatgcagtttacctgtgtaacaaacctggacatgtaccccgaaactaaaagtaaaaaaagaaaaaaaagttgcctgtaaagattaccctcttaggattaaaatactttactctgaattaagttatcattatcattagcagcagtaaattattcattagaccaacatacatataatgcatattttgatatgcaatattaaatattaaacttttgttgaaaatgcatttcttaatgagaaaaaaaagtaaaggcatgcagatgaacagtgcatgtgcattctgcctgcagggtgtttgaagacccgataggattctttcaatccttaatgttccattggccttattttgtgttttcctaccctctgtattgaaaatggtatcataatactagctaatgaaaccttatggccaagcacggtggctcatgcctgtaatcccagcactttgggaggccaaagcaggtggatcgcttgaggccaggagttcgagaccagcctggtcaatatggtgaaaccctgtctctaccaaaagtatgaaactagctgggcgtggtggtgcacgcctgtaaccccagctacttgggagcctgaggtatgagaatcacttcaacttggaaggcggaggttgcagtgagccgagatcatgttccaacttgggcgtcagtgaaactctgtctgaaaaaacaaacaaaaaaaagaaccaccttatatggaaacattttgttttaatagggtgtagacattgctcctgtcaactaggtagtatatcgtttgttgaggtttgaagttatcccagctgggggtgttttgtttttagttaggacaattcagcatttttcagaattttcttgtcaaatgacttgagaaaggggttccaagatgaaataaattaaggatagttctaggtaatagaaagttacttcaggatttttttatagccttttaatgtcatcatgtacactgtgaatctctggtggaatgggaatttttttaagtatagtatttactaaaattgctttctcataaaaactcccctggttcatgtcttaggaatagtgttttgtagaatacattttggaaaatttgggatggatttttgcagaggcaggcttgtgtgtctttctttgcctcttcatatagaaactgagaaatgagaacaacttcaaagggagtagaaatctttcccaaaattgtttgagaaatgtagtctcctgtgtctcccaaatgggcttgcctaggctaacattagtgctccactcatctttgtaaggacctgtgggagcagtgggtattagatcttacaggtcacagatgagaaaacaggttaagagaagttagggaacttgatcgaggtcgcagagctagtaagcgtcagaaccaagatggtagcctgacctccacgctgtacagacttccatgctgcactgcagattaaggagccaggtcttgcctggcacagcaagcccaggacagatggttattgccatctgttattatttactttattagatatgttgttttgctcttgcattttttcccttaggactctgagttatccgtatttgagggaatgtaacatctcagaacttactccagagaactagattaccttttcttacagccatatatcttttcctttgattttcttcattttattttggcccaagattttgcctaagtatgtgaaaatacttttacttgctttcataggtttttacatttctctccttttgtgtgtgtgtgtgcgtgtgtgtgagacagagcctcgctctgtcacccaggctggagtgcagtggcgcagtctcgactcactgcaacctccgcctccccggttcaagcgattctcctgcttcagcctcccaagtagctgggactacaggcatgcaccaccacgcccagctaatttttgtatttttagtagagacagggtttcactgtgttggccaggctggtctcaaactcccaaccttaggtgatccacccaccttggcctaccagagtgttgggattacaggcgtgagccaccgtgcccggcctctcctaacattttaaatgtagttttgttttgaggacataaccagaatccggcagtctttaaaaactctgatacagaaattagaaaaattgacagaactcaatggaaatggaattggggtaccgttcaagaacttggcattttaatagaattaaaagtcaaggacaaatctgcatcctggtcattgtcaccatttgcagcatttgtcacaattttacataaataatattttggctgttactaaaattcaaagggaatataaaacccatgaacttaaactgaaattagacttaatacttcagaaaaaaaaaaaaaacttctggggaaaaaaatgttttggtcttggtaataggtccttgtataactgccagaaactgcttctatagatatcacttgtcattaatttcacatactgtctgatgcccttattaaatgtatttgagtatctcttaagaaccttaaaaagatatacagccctcctgctaattgcctaataaagtttttgatgtttatgcattaaaatgctagaacagtagcaataacattcagcctgttactgatactttaataaaacttttatttccatattaatatttacgtaagtaaatattgccctttgatgcataaacactgtagcaaattctttcaactagaccctggctcggccataataataaacattaggcagtgagatcattttgcccaaatgtaaaatgttcttcttatcttcatctgagagaggggtcattcggtaacacgttatttagcatgctagtaggctggtgaaaaacacaaatgctgttgttctaatattaactccaatgtttctgagacactgcagtatatcatatcaaactttcaaatttggtagttcggaaatgtatgatcttcaaattattcctaaattaaccacgtttcattctccacgtgagtcacgcttgagaagtattctgggtactatctgatggctacatcatatcatattctgtttagtcatgtttcttcgtgtgtccgttagtggttggcaagttttcatatggctctgttgttctttgatagattgctcatgaaagcgtgagtgctttcaatcttagtgtactattaataaaataagcctaaaacagaggagctgaaaccaaacaagaaggaaatattaatcttgggtgttagccttaaggttctatgcatcgcctctgagggtctctaaaataaaaagcaaaataaatctgtgctatttcactgtctgtgatctgggcaagtaacttgggggctgcagaaattacactggttctcttccattctctcaggtccttttaaaattaaaccttgaatttgaaatcagagaccatcatgtggctatttcaagtactccaggaatctccactgggaaatattgttttcctccttaaatgaaagataaatttaaagttgaataaaaccataatgaattatgtttactgaataatataaatgtttgaggatgcgaaataagtgtcagatttaatagaaatttttgctttactccagtaaatcaggaggaaattcatcatccagtttgggtgacatagtacctagttccagaaaatcaacacctccatcatctggtaagtaggtgataaatgctgaataatacatactgcatttcatgctttccccagctctatccagttttgtgaatttacgtatacactgaatcactatgttaaccctacagatgttaaaaagaatcagaagtgagcatgcccttttggagttacaaacaatatggggaaatgtttttttctggctggaaaaagaagtatgtcaaagtgtttacattgctgtagatgatcaaaatgattaatgtatgtatttatttatttatttatttttttgagacagagtctcactctattgcccacgctggagtgcagtggcatgatcgcagctcactgcgcctctgcctccagggctcaagtgatccccccacctctgcttcccaagtagctgggactacaggtgcacaccaccatgcccggctaatttttgtattttttgtagagatggagtttcaccatgttgcccaggctggtctcgaactcctgagttcaagcgatccacctgccttaggctcccaaagtgctgggtttacagatgtaagccactgcacccagccatattaacctttaatccctagttcctgcgatggtgcttgtcatgggcagtaaatgggtgaatacttgccaacaaccatagcacaatgtgagatataaccttaacattaaacagaaggataaaaactttagaaaggtaaggaacagagggtaaagtgaagatagaggattggcctgttgtgggctctaccagaaaagttctgtggaagacacagacaagaagtatagaaaaaagatgaaaatgtgtgtgggaacagtaactactgttttctttccaaagcagtgggttcatcctaatggttgctggataaaataaagcacacctacttaaatttgaatttcagataaacaataatttactagtttaagtacatattgcatggggcatacttacactaaaaatgtatggaacatacttatgctaaaacattgttttaaattcaaatttaactgcatttatatttgctaaatctgggaactctcctattctgtgtagaacatggaattctatatagacaggagactaatgatttgaattgcaaaaaaaagcacatgattagtatcttagtttgctaagagaattgttattgggaatcagagtaagactgtaaaggttgactgccagggtgtttcagcaaaatgatactgtgtgtgatttctagaaagctggaaatgggaagagataaaaaacagagagttgtacaactatgcagaaatcaaagaactagtcacacagtgactgatgtgctttaaggacaggatttctctattactaataatcagcttcattcctgaatggtggtggcctttagagaccaatcaaggacttcttagcaaaaactataggattttttttttttaagagaaggggtttcactatgttgcccaggctgttcttgaaactcctgggttcaagggatcctcctcctcagcctcccaaactgttgggatgacaggcatgagccaacatgcccagccattggcaaactaagatactgatcatgggctttttttgcaattcaaaccattgttctgtttatatagaattccaagttctacacagaatataggactttcaagtgagcaaaatctgagcacaataaatgaattgctttaggaagcaaattaatttcaaaaactatctacttataacttgaagcaagcaattctaagatgctcaaaattaagtaaaatagtatgcatgaaatgaaaatgaaaggccctgtaggtattatgtgaaacttataccttcccttgataattacggagcccctgaatccacagaggaagggaggcctatcctgttccttctcaaatgtgtgaagttgcagggattcctatataaaccttacactcttatatatctcaaagatgatttcagtgatttctagggactgctactaggctcttaaagtggaaaaagactatgtcaccttgcgataaagcagcagttctgcctgcaaatgtcagcctcacttctttctatataccagaaaaattcttccattccctccagccatattgtagccctccagtggttttggcaacacagatgctccccaacttatgatagagttacacttcactaaacccatcataaatagaaaatatggtaactcaaaatgtacttaacacgtggacagacccagtaaaaagtccgacgtcaaaccatcgtaaagttcagaccttgacttatgataaggttatgtcctgaaaaatttgtaataaacttgcacaatcttaagttgaaccagtgtatgtcaaggaccgtctgtatagtgaaaggaggtgctgcattttgaagaacaagttagtatacatgtaaaataacattccattttgtaggcagatgtttgacattactaaaagtaaagttccatgaagagtgtaatatttaaaaaggtgatttaaatgttcaccaaggttttgtagagatacaccaactttcaagtgacttttctggtgactgagtcacttggagctataaccaactacaaaatgtataataagcatattaggactctgagacaatttttatatcaatagctcaactgatttaaaggaaaacttcagaaagctcgaaagagaagttctcccaatccacctccaggcacaactgctccaactatcaagtgtggatgggtctgtaatgatcattttcatcgtttccaaaggtcccatctattattctcctcactcattgccagaccaaagaatataagtatctgcctaaagtatatatgcttggatgctgtcaagaacttggaaaatttcccacttgacatctgggcatcggtgtcatagccagttgcagaatacatacatcgcacccacacacacgtgtgtacatatgtgtcaagcccaagctctgcttaacttgacccaaacctttaacaccaaaacttaaatttcaaaaaattgttctcggtgccatggtcacgcctgtaatcccagcactttgggaggctgaggcaggaggatcacttgagcccaggagttcaagaccagcctggacaatgtaagtgagaccccgtttctaaaaaattagctgggtatggtggtgtacacctatagtcccagctacttgggaggctgaggtaggaggttcactcgagtccaggaggttgaggctgcactgagccatgattatgtcactgcactccagcctgggccacagagggagaccctgtctcaaataaataaataaacaaacaaacagaaaaaatgttcccaaggctctctatcactaataataatatatgcatgctagtgaggaagaatgagacttttcaaatatatgaaagcagttctttccaagtaaatactaatgtttgctaaagcatggaaatataagtatgaaatttaaaaagagtaacatttctcattaaaaggagaaccatctgagtctaataaaatacatgtagctgaacagatttgaaaatgcttcttaactgccttggtaagtttctttaatatgttttgaaagtgaccacatgtttcagaattctacgtatttcaaaatgaactcagatgtttttagacctgagttaaccaaatgtcagaactagtacattatagaaagttctcaatttgggatatccagccctcatgtccagatacaggtaaatttcaaacctgactcaggctatgtgtgtggaaagccaaacacctgggcaacgttgcagccaaagatgtatatgtttccactctttctttgtttttttttgagatggagtctcactgtcacccaggctggagtgcagtggcacaatctcagctcactgaagcctccatctcccaggttcaagtgattctcccacctcagcgtcccaagtagctgggattacaggcaccggccaccacacctggctaatctttgtattgttagtagagacaggattttaccatgttggccaggttggcctcgaattcctgacctcaagtgatccacccaccatggcttcccaaactgctgggattacaggcatgagccaccatgcccagcctcactcttattttaaaaaacaaaaatacaactgatgatcacagcaggctagattcaatgggcaaatcacaaaattcaactcatgaacttgactgtccaagggtcctgtaaattctgacatccaactggttatcttcattttaggagagccctcaaagggtactatcccttgaatgtggtctttatgagcccaataaaagatgagaaagataaaacctgtgggaatttaccaccagcaaggaaactcttgattttggttaacatgtattgtaggaataatgaattcctgacgcagattttgtccttcatatccaggaaagcgctgacaacatgctgcttgagttgagattcaaggaaaaccatttctgaagagttttctgagactcttgcctggcttatgccattcaataagccccataaggaaactttcctatatgagcaaaggattagctataggatggtataaaagtcagcactggataaagccctaggcacattttatgttttctctacataccacatgttaaaccttttagcacatcagtatgcatagatggggcaaagaggaagacatacttactatattaggtctacctaattaggactgaattaattccattattaccttttttttgatagaaaatcatacctcctgcattatgcaagcaatagctgattatttgtaatagtgtacaaacaatggcaggtattcactccatcacaggtttcctacctcaccaaatgaaaaggaataattaaataagagagcctagttttcaaaaggctgcttcatttaatattcataacaacttcaaaactgaaaaataatgtaatgcctgtcagatgatcttccatcctttgaaaaggttagaagaagctgttgtgagcagttcagcttgtgtatcccagggaatggtagctgtattgtaacaccaagttgtctgttatttcaaactggtaatttgttccttccttcaatctaaatgtactgtggtttttgttagagagctaacatgtataatatgatgctttcctgcagtgagtaaattttttttcttctccttgactgattcttaaccgtagaataattttctagctagtccagctctatgatgtcatcctgactcctgacatcaaggacatgaccccattgaggatgtgaagggaactgaaagagggcacccagattgagaagggacttcgcctggatgggcagtgtggtatagggacggttacagactcatttaggtgggcactgtggtatacggagggttatagactcacttacgcaggaggagtaggtctgaatcctgactgccaagtttttgccaagaacaagtcccttaaattttgagttttttaatcttaaaaataagagccttgaagttgatctttatttccatctctgactctgcagttgataaaattctgtagctatttcaattgcatgtggaaggattttgtaaaatttgaagtgagattacgcatctttttttcttgtaacactttttaagtactatattttcaggtggaacaatgggaaaagtaaatcatgtcaagcaacaaagctaaacctttcattttacagatgaggaaaccagtggcatatcctcttgggtcctcgtgcccttccactctgcctcttttgttaaacccagtggctttgcataagtcaccagaagtcttccaatgtcattttattagactgatttcactcggatatcttgggacccagtgttttcccattagtcttcatcagcctaaaatcatcttaatcctgtccttcctggagccctccctgaatcattggccttgtgtatgactcctttgcattgactggattgagaattttccattctctttttctcaaatgtctgttgcaattttagggaaacttttcacactgtccttatttttacacaaaatctgcaaaaagaaaaatctttttttgcacattgtattgttggtgcaaatgtaattgcggtttcggaccatggattttaaatgataactaggcctaaatacatctttattaatcaaaataggaaacactacaatcaacacatttttgccaaggagaaataagtgtgtttattcctgtagcataaaactccgtgctttgggattcggcaaactcttgaaaagcactttctgcatcctgctggttgtggaagaattttctctgcaaaaagttgtcaagatgcttgaagaaatggtagttggttggcgagaggtcatgtgaatatgatggatgaggcaaaacttcgtagcccaattcattcaacttttgaagcgccggttgtgtgatgtgcagccaggcgttgtcacggagaagaactgggccctttttgttgaccgacgccggctgcaggtgttgcagttttcgctgcatctcatcgatctgctgagcatacttctcagatgtgatgttttcgctgggattcagaaagctatagtggatcacaccggcagcagcccaccaaacagtgaccataacctttttttttttttttttttttttggtgcaagtttggctttggagcttctcagtccaacagctgagctggttgtcagtggttgtcatataaaatccaattttcgtcccacgtcacaatccgactgagaaatggttcattgttgttgcacagaataagagaagatgcttccaaacaacaatttatttttgcttggctcatgaggcacctacttattgagttttttcacctttccgatttgcttcaaatgtagaaagaccatagaatggtcaatgttgaattcttcagcaacttctcgtgtagttgtaagagaatcagctttgattattgttcttgagtagtcgctgtcaacttccaatggtcagccactatgctcctcatcttcaagtccctcgtctcctttgcaaagcttcgtgaaccaccaccgcactgtacgttcattagcagttcctgggccaaatgcattgttgatattgcaagttgtctccactgctttacgacccattttgaactcgaataagaaagtcactcaaattcgctttttgtctgacatcatttccatagtctaaaataaacataaacagcaagtaataagtcattagcaaaaacgcataaagcgagaaatgcgcattaaaatgatatataacataaccacatttatttaagaatgtattccaatatcaaatggcaaattccaacagtgcaaaaaccgcaattacttttgcattcacctataataaaggttttcaaagtagttgtttgttatctcaaagctggtttaagatattgtaatgaagtcaaatgttctgtactgcacttttatacagttgatacagagaaaatcaacattatatttgaaactacagatttaaaatgtttctctgaaaatattcaagacgtctagcatgaaactgattcattcaagcaaacagattataagtgtatctttcagtttcattagatttgattaccttgcattcttaatgtgccttacctttaaatttaattttcttgcgtactgtgttgagcactcatgatagttttttttactatggttagttttatttgctttcattttattttctttataacctatttttcctctcctgtccacctgatttttgaattgtctgtatatagctatagacatagatgctactggcttagatgcagaagaaaatgatattccagcaaaccaccgctcccctaaacccagtgcaaacagtgtaacgtcaccccactccaaagagaaaagaatgcccttctttaagaaggtaacattaacttccaagctcccattgtccacctgctcaactgcactgcgtcacatttctagtcctgttgactgtctgcgtcctttgataagccaataacgtgcatgctctgttatttgtttcttttccatgctgctgtagctaagcagaagcagaaatcggtaagtttacattgacataagctgtgtttatcctgccactggcatcattagcattaattcccacagttgtattaaatacaatcatttctgtcccaagcaaagaacctatcaacagctaattgagttcatgcatttcaaaccaactaaattcagggagtgacctgttaaaacaccattacagtacttatcctttttgatggaataatatctaccaccaagggaatttgtttcaacattcagggatgtcaaacactgacagctccacataatgcacctaaattgtgcatgcttattctatctctttcttttatccagaaatttaacttatgatcaaacatattaaagcagttattaaattctgacttatgatatccagatacatagcttgtactaaaaaaaaaagtattcaagttttaatttagtcagtatttaaacttctaatccactaggtgcaaaatctgcagatgaacaagaccagtggaaaactgcaggcttgttttggcggtttactgtgagtttttcctattgtcatatataaatattctcccgatgttcttgccttctccatcagtcagattttaccatctcaccctttggacagtgcagccagtggtcatgcgtagagcctttgccattggccatccaagatgctacacagcgaggctccttgtcccctaaatggaaactatagggtattcctgagctctccttacttcagacaaagccttttcctcacccattttgtagctttaaagcattattttttaaggaccactaacctccccccaaatttccctttttttcccctcttttacccatcagtttccacagctaccatgctgtcttttagaatcatactaatgtcgccaagtctggcaaaaccatggatatattctcacacgcagatgtgatgtcaaatctgtctatcctctgcccccaaactctccacataatgaacacttttcctctgcaaacatgtattttggtttgtggaggaactcaagtcattaatgaggtgtcagatacagaactgtaaagttggctttttttgaatcaattatgattattttaataagggaaaacttcagcactctgggcaaaaattgcaacacttggatttttgtgttaacatagcctcagcttgatgttcacccacaacagtgggcccatttctggggtccgatcttcttgttacagctaaagcttgcagccaagtgactaacagtgtccatcattcagaagcttagaaaatcggcatcgctaagacatttgggccttgacggagcaggaatgtgagctaaaaccctgtttgtcaagataggtttgtgaagtttgcttacctttaaattctaaaactttaaaaacttttatcacaattttttcactaaataatttgagcaggcagggcgcaatggctcacacctgtaatcccagccctttaggaggctgaggcaggtgcatcacctgtggtcaggagttttgagaccagcctggccaacatggtgaaacctcatctctgctaaaaatacaaaaaattagcctggcatggtggcaggcacctgtaatcccagctacttgggaggctgtggcagaagaattgcttaaacccggaaggcggagattgcagtgagccgagaccatgccactgcactccggcctgggcaacagagctagataactctgtctcaaaaaaaagaaaaaaaaaatcaagctaaatggggttaacagggaagagtagataaaaatgatggcgtcattcttcatagggcacaaagcaccaatattccatcaaataaggtaatttctgtagctaccctattgattaagaagctgattgattaccagcaacgggtgaccctttgctagttggcagttacagatcgaaggaaccaaagacctatcaaacactgggccacttcagaattaaagtcttgagataaaatttcttggtagctgttactaaaatgcaggaaatttacattcataatttcaacggtggaaaaggtgttcttacaccgcatagttatcaggacttggcttctaaacgttttcagtatgatcccaggtggtataaatgaaatagtttaagaaatatgcttatgatgccttcggcactggtattcattcttcttatgttattgataatgtggttaacatcaatgtagaattcaaaaacaaaacaacagcctgagattcaatgagaagatcgttttctatgttttaggttgcttttagagtggtgcttgtgtggtacgtgtgctgtcactgtattatgtttgtcttgttttttttttttctgttcaaaactgtattctaccttgattgtgtcaattaaaattaattctgaatgctaggtgaaattttaggcagtgaaatttgacagcacagtcatggtaatatttttcttccctctgattatatcgtctgtgactacgggtaaaatctcagatggaagcttttgaatttgaaatgctttttaattctcccctgaggcaatgtgaattcaaatgaagccagaaaagtttgtaatgggcaattttaagcaacaataaaatgttcttgagtgacgggcagatgcaaaaatgacattcatatctgcacatcagtgtactgaattcttaaaatcatttacagaacatttttctgttggtgtgtgtgattctcaagttatattttttgacactccttagccagaaagattcatatagcaatgatttgcttatcgcagtgtctaaggccatatcactcttatgcatttttttaaaaagtcatttttgggtcaatttagcattttatgctatcaaaagagccaattttaatataaaccaatttgctgttacctaatttttggaaagatgttattttaccattttatttgaagcaattaacctgaaaagtgttgatagttttagaaattgctacaaaatttagctcctcccctcttattaaaaagaaataatttactgcagaaagatgtcattagttatctgacagaaaactacttttgagaatcatattagatatgcacattgataatgaaccttttgagaccacaatagcatggttgaatatattattatacattaatcaccttccctcgaagacacataaaccttacctttgaagtaccaaggtatagaaaccaaaaaattcaatagcattaatcactaagctgtgagcagggatcatgattactgtttactaaaataagcatgcatgttcatttaaactctcacaataatatagaattttgacagtagtgagagttacaatattttgagattaggtaaaaagtattggtagtgagagttataatattttgaaatgaggttttacacaggtaagacaaaaacctaagatgcaaaggtaatgcaatctttctttcctctgtaattaaccatgttaggtctaatcactacaactctttagaaaattcaaatgcagccgaaaagcaatattaacttctagtcaagcctaaagcacctatcttgcatgaggcatgtttctctttgttctgtcaactagtttttgttcaaaagcagcatctcttgctttaggaacgaataggtctgtagcatttcttgagatgagcaagaaaactgtagacaacagtaacttgaaacttcaggaaaatgaacccaccaatctttgactgggtttatgtagaaaagaggcaagtggggaaaataaaatgtctggaaagccagtgcctcatattatggagttcagaaagagtaccttatacacaaaatatttatgttctacctgcctgtgaaacgtctaaaagcctctcctctctctgcagacagagcacactcctccgtatgatgtggtaccttccatgcgaccagtggtcctagtgggcccttctctgaagggctacgaggtgggtagcagccttccacaggaagcttaacttgcatgctgaacttctttgtgatgctgcctcctactcccgaccctctctctgaattttacagcttaaggagccaactttagagcttagagagctcacagcagcaaagcctgttgttctgcaaactggtatacactgcttcgtcctttttctgttttgtttacctggctgttgctttgaagatttctgctagctgcagtgtactcagtccaggaaatagtgtcaaatggagaccgactgaaaccacttgcaatgttatttgtcactaaaacatcatgataagttcagtttaattgtcattgcatcagaactcagaagcagaaaaatgcggcaacctcatattgccactctttccagatgcaaagctcaggttttcaagcattcctaagagaagtaaaattgttttatcatcgttagtaattttttttggtcatatcttaatttattgcttgctcaattgcaggtcacagatatgatgcaaaaagcgctgtttgattttttaaaacacagatttgaagggcggtgagtatttcagcatactgggttttgtggattttgtcttaaagatggcaaaacgctggtgggacatgcgtgtgattccaagagaaaatggccctctgatgtctatatgatgacaggaaacaagtttcactcaatttaatctgattcaatcaatatttatcatatttgcttggtacatctttaacccctgatgtctagttcctgtacctacatccataagctgaccttgggcaggacaccactggccagtctcaccctcaattcatggtcaactggccctctattgctgcccaggcatcgcactaaatatccctcttccattcacttttccactcttctaaaagacttctgtgccatctccccctccttaatcctctgataaccccttctcatctcacgctcccccagtgaacttgcttccgtgtcattgagaaaatagaggcaaacagagaacatccaggcatttctacaaccccgcctgtggagttgcatgtttgcctgcatgctctgctttatctccaatgactatgttcccagcaagggccaacccaccatgtgggcactagatctcattccccatcccctctctgctagaagtatccatacagagccgtaatcatcctttgctctctcctcatgagtatttcctgttctaatggaaactccatcaccatgtaaaaatgttaattcctatcacattgacctcatattgctctaggtgtctcatttttttttcttttctttacaggaagattccttgaaagaattgagtgtactggctttccttccactttcttcagcctaccccagttatgttttcacccacaccactcagctaaactagtcatgtcaagatcacccatgaccttcacattgctaaatccagggataaattttcagccctaatcttacttgaccatgagcagtagttgacatggtggattattccatcctctttgaaatactttgcttggtttctggaaccacacttttctggttttccttctatcacactgactgctcctttgtctcctttgctgatacttcctcatcaactggaaatcttggacagcccagggctaagctctatgatgtcttttacctacatttctttagtgatttcattcagcatcagatttttaaattccattcctttgccagtctttcctctaaattctagacccatgtatacaattgcctattcattatcactactaagatgtctaatggacttttcaaatgtaacctcccccaaaacttactcctcccatggtcttccctatctcaattaatagcttcttcgtctttcagtcccgagacccttcagcccagatcattttccttgactgttctttctctcttatatttcacatgcaaatgctgttgtctttatcttcaaaatatattcagaatcgaagcccttctcacacatcctctgccaccattttggtctgagacatcttcatctcttccctggattggtgcaacagcctcccaccttgtctccttgcttctgtggttgttcccttaaagcctgtgctcaggttagctgctgcatgaccctgttaagatgtgagctagtgcccaccactcctttactcaaaaccatccagtgacttctttttttcctctgaatggaaaccaaagtcctacagtggcctacatgacctcctatggtctattcttccacacgtccttacctagattttctcttgctgctcttccctcgctcattctcaccctgccgtacttactcccttgctgttctttgagtgttccagacagattacacaatcacctcagggctttggcactttgcagttccttctgctaggaacacttttccctcagatattctccttggtatacgtgtgtacatgtatgcacacatacacatgcacacatttgttctgtgtctctcctttccctctgttttctagtgctcttttatgtatttccagtactatttttgtttattgtcattctcccataattagacgataaactccatgagggcagggtttgagaatgttttgtgaactgttgtattctcagtgcctggagcagtactcaacatgagcagtggccagatgaattttgaatgaacgtctgctgcatactctctgctagagaaatgcggagatggtgaagccagtctctgcctatgaacagctctcatggaaaccataaattgaaacctgtagcagtaacactgcatataagtaaaagggcaacttggttatatgcatgcacaaggtgcaggtagcataaagggaggcgtaattaacaccaacttcaggacatccacacctggaagaatttttaaatggtgcctaacgtttgaccaaatggattacagggaagagaagggtatgttcagcagatggtatatagtgtgtgaaggctttgaggtatgacacagcattatgtgtaaggcaactcacacccacatcttaaaggacatgggcaaggagtgactggtaacaaatccaagggtcatatctagtgtgtcacgccaatgggcttggacttaatcctttctttctcctcctcttcccccggtcactattcaacttgcctcagtaagtatttattgagtatattctatgtgccaggcattgtgaggagcaaaaatagacaagggccttggctttgtggggcttaaagtctattgaaaggcagtcttgaatcaaataattaatgggtgccatcattgaatgttaagccagctcctgaagcatcaaagacatgactagagtccaaaatggaaacctcagagtttaagagtaggttattacaggggacctggaagatacagggctagtgtatatttctgtatttttaaccagataaatgcagtgcttctcttctccacattcctttcctcctcccatcctaacaatgcaactacaatagatcaggagtcccaaatccccgggtcacagatcagtactggtccatggcctgctaggggccacacagcagacggtgagtggcaggggagtgtgcaaagcttcatctgtatttacagtcactcctcatcactcacacattattgcctgagctcagcctcttgtcagatcagcagcggcattagattctcataggagcacaaactctactgtgaactctgcatgcgagggatctaggttacatgctccttaggacagtctaatgcctggtgttctttcactgtctcccatcaaccccataaaggaccatctagttgcaggaaaacaagctcagggatcccactgattctacattatggtgagttgtataatcacttcattatatattccagtgtaataataatagaaagaaagtacacaataaatgtaatgtgcctgaatcatctcaaaaccatctccccactcctaccaaaccggtccacggaaaagttgtctttaatgaaactggtccctggtgccaaaaaggttggggactgctgcaatagatagtatttgttggtttcaggattcttttagatttcttactatagtactttctttctagaccacacctactactacaaccatttctaatttatattgacttttggcaggggaggcaagggtaggaaggaaagttttataggaggacaagtctttttagtaagtgatcaagcaggctgggcttggtggctcctgcctgtaatcccagcactttgggaggccgaggcgggtggataatgaggtcaagtgttcgagaccggcttcgccaacatggtgaaacctcgtctctactaaagataagaaaattagctgggcatgttggcgggtgcctgcagtcccagctactcgaaaagctgaggcaggagaattgcttgaacccgggaggcagacgttgcagtgagccgagatcgtgccactgccctccagcctgggaaacagagtgagactctgtctcaaaaaaaaaaaaaaaaaaaaaaaaaaaaaaaaaagtgatcaggcaaagaactgaaaggagagagaatgaggaaaacaaaaactattataagtttcaaggtatgaaaagactttataatcaaggtcttctaaccaaatattcctaattagatttttttaattttccatatctttaagaaatatttttcagtttgtgacaggaaatagaccctttagcttggaccaaggctactaggcactggccaagtataaaaggcatagctctactctgctccatttagcttgtttctttatccttggctctgtcatttatcacaatttggaattgtcaacatgagcctgaacactaaaaaaattctgctaacaaaggcactgtgttttccatgcctgagtcaacccactgccctttcctaaatgccaaagatggggaaatgggatggaatttcctggattactacttgtacttaaacctgagtaagttttgaatttggaagacacattccagccagagagggtggattttggacccatgttcgagtgtatcagccacccagattggttttatttaagaaacagataaacaaaatatcttaaagtatctgttatttctagccagaagtaactttcatatggtttaattaatagacctgccttggctcatcttgacttacagagctggggttctatattctagccctgttctccccagttaacagtcctcagaggaagaaacgagtccataaggcagaatttaaaagctgtgtacaaatttaacatttttacccatggcaagacatctagagtaactgaattattgactgtctttgcttttggcaaggcaagacagcaatagaggatggaaattcaacaaaagtatcaggtgtgtatatacatatgacattctaaaagggaaaaatgaattattccttaatcatctattaaataagctaagtttattttttaaaaacgtttaagcccaagaggagaaaatatgaaaggaaatgttagttatgcgaaaggttctaggtagtcaagaattcctttttcttttctgaaacccacttaaattcatttgcagcagccctagggggttgtcagaatcacattctggttaagtagtgtcagtgtgtcagatcaaagaagaaataaatcatcctcctcctcctcctgttgtgtgcaataaagtagcccattcaaaactggattcacagtaaccaactgtgtcatgtaaacaaagcaatcttcagattcaccttgtaggatggtgacaggtaaattaacaaggaagttgagaacaagaaggaaagctacctgggataaattcacggttttttttttttgtttttttgttttgttttgtttccttcagtgactttcaaaacgtcagcaatcagccctgaagtgtttggaatgcatactgaattgctacagggataaatataccattgccagaatcttctgtaggacagtcttactagaaatcagtaatcctgaggctgagcacagtggctgtcacctgtaatcccagcactttgggaggctgaggcaggcagatcacttgaggccaggagtttgagaccagcctggccaacatggtgatacctgtttctactaaaagtacaaaaattagctgggcacaatggtgggcacctgtaatcccagctactcaggaggctgaggcaggagaagcgcctgaacccaggaggcggagattgcagtaagccaagatcacaccattgcattctagcctgggtgacagagcaagactctatcttaaaaaaaaaaaaaaaaaaaaattgagcaaataaaaagttgtttatctcatggaaaccacgaggaaaatacacaagaaaaagtatagtaggctgggtgcagcagttcacacctgtaatcccagcactttaggaggctaagggaggaggactgcttgagctcagaagtttcagaccagcctgggcaacataatgaggccctgtttctactaaaaaaaaaaaaaaaaaattagctaggtgtggtggcatgcacctgtagtcccagctacttgggaggctgagccagggggatcacttgagcctgggaggttgaggctgcagtgagctatgattactacacccttgcactccagcctgggtgacagtgagatgctgtctaaaaaaaaaaaaaaaaaaaacacattatatgacatagttcattgactattatttacatagtttcaataaatattaaatatggagccagccaaaattaatttgtctatttgaatccctctgggacattctagcctgttgcagtgtagatctttctttctgtgctgggtgtcattctggaacattccgtgttatatgcttggggattcctttcacctttgttttgggttgaagctcctgtttcccagatcccttgatttctttcaagctttactgtcattttagtcaaaaaccttctcatttccctaggaagggtatatacatgtttttttcaatagcctgaatgtttacaaacctttctgtttaattgctagtttaaatgcttatggaattctgattgaaatagttttccctccaaattttgaaggctttttgcttcattaccttgtggcttccattgttgctttgagaagtacaaagcattctagtgctttgattctagaccctttgggacctgtctttttcctctgaaagcttatgggtttctctttgtccccagtgttatgaaattcataaaaatatgtcttggtgtgggtatttcaacccgtgtgccggaccctttcaattcagaaaatcagatccttaattctggaattaattctttattttctttcctctgtcttctttattatctttttctgaactcctgtaatttggaatttgaacctcttgggttatgtctacttttcttacttttcttctcctatcttccaactcttttttgttttaccctttggaaatgttacatttcttttaacctttcttttgctttttttctatttctattatcatgttacttccaaaagctcttattctaagtctttaaatagaaatttgttctagtctcatagataaaaccatcttttagcttttaactgtgaataattgtcataattgatttttctgtttgttttgctctctcatgaggttttctgaagatgcctgacaaactgtcctgtgctcaaattttaaaataaggcataaaataattaatcagaggttctgtgctcataggcggagcttgtcaactttgtgtttctgtgtatggcaatcttgctagataatttacacaggaaacctccaatatcattatctttgggtccttacaatttggcagtcagattccccagagaagaatcttccattctgacccctggggatataaatataagcctggctaccaaaactgtacaatgagaagaaaggctgaagactcaacattcagaatcctttcttttccatccagtattccctgctcctgttctgtctagggtcccctggtcagaggccctcttgtattgcctgcaagataacaaatgtagggtcttgtaccacacaggaaaagaactgtcacctggctatttgatattgtgagggggcagtggagggctgtaactgaaacagactttttaaccaaacttttccttttcgccctaacttcattctctaccttctttagaaatattgtgagccttcaattttgcttcacagctttttcctactgctgacttgaatattcagctttctgcagtctaagtcatttgctatttccagttcccaaattttgttgctctcatttctaccttatctaaaatgatactcccaattcaatattgtctctcataataccctgtatgttctttccacaacaatcatcatctttaattattttcctttattatttatctctgccactagaccattagctatctgagggaagactggttcttatttatttttcatgcctatcacagcaatgaactatggcacagagactaggaatatagggtcaggagtctgggttcaaatcccagctctcccacttagttacatacatacccttggataaaaaatctctctgtgagtctcatttttcatcagcaacagtgggataatagtaaacgtttctcctagagctttttggatcatttagtaattcaaataaagtgctcagtacttatctgacacttgtaagcaacaagtaagtgcaacgtaaggcaggtgcaggatagggccgggcgcggtggctcacacctataatcccagcactttggaaggccgagggaggcggatcacttgaggccaggaattcaagaccagcttccatagtgaaaccccctctgtactgaaaatacaaaaattagccgggtgtggtggcacacacctgtagtcccagctactccagaggctgaggcaggagaatcacttgaacctgaaaggtggagattgcagtgagccgagaacgcaccactgcattgcagcctgggcagcctgggcgagactctgtctcaaaacaaacaaaaaacaaagtaaggcaggtgcaagataaaaatgaataagtaaaaagaaaaaaaatgaataagtaagtatcctaacacatatggtttgaaaatatggttgctatatatatttcatacttagatgaatttggggcatacacttctatcccctttgattagaccaataaccttaaggtcttctgtgactttttcctccaacaggatatccatcacaagggtcaccgctgacatctcgcttgccaaacgctcggtattaaacaatcccagtaagcacgcaataatagaaagatccaacacaaggtcaagcttaggtaagtctgtgcaatgagcttaagctttttaaactctcctctcccgatgttgatgatgagaagacctaacaagatgataattccatgtgtcacagagtatagaaaaaacaggtgtgtgctgccagtcgctgttgctatggtcttactgatttcatggtgtggaaggatttgttatgatagtttcaagttaagaattccacaggctgtcagcattaatgttttggttgtggtttgttttcactaacatgagctttggtgtctgcagactctaagatctcctggctttgcatcagtgttaccatgagcaagtttattaaccttttgaagcctccatttcctcatcctaaaaaagaaataaaataactacctcatagaatcattgcaaggattaaacatgatatgtgctcaataaatgatatccattattatcctaaatattccttaattccagttatatatcaataatgaaatcattctcaggagagtataatttgtgggtgtggaaattagtaaaagatgaagtcaattcctggctatatttattgatagatatcaatatgtttgttttatttgtaaaaacagtgtagggagttattgtgtttacagagatggtatgtggatactgcttattaacgtatactgaattgatcacactgagacccttcagctgctatttaatctttttggtatgtgcttggagttttaggttaatcactgttacacatgttgcttactggatggttaggtttctgtttttataaagtaaactttctgagagttgtgtcagatctttgagcttaatttttctctgtttataggttagatatacaaatcctctgagaggctggtttctaacatagaagttcttcgtttactctgaagtatgattatataaataacagaaaaactattataaataataagctttatatgttagcaatgagcatgatacattatagaactcagttttgtttctcacctaacaacccttcgttggcaaaacttcagtaacaggtttagaaatatatttgaggaaaaaatgtaatcatgtgttttgcttatagcaattcctttttatgtccttatcatctgtcacagttaaaactctttccacacatcatttgatgctcacaagaattactttttattttgacttttttgagagagggtcgcactctgttacccaggctggagtacagtggtgtggatcatggctcactgcaccttgacctcatgggctcaatcaaacctcccacctcagcctcctgagtatctgggactacaggcacatgccactacattgggctaattttttgtagagagggagtctcactatgttgcccacgctggtctccaattcccaggcttgggcaatcctgccttggcctcctgaagtgccaggactataggtatgagccactgtgcctggccaagaattattataaaatgcttatttcataaattaaactgaattaacaaagtcaagtaattttttagactcatcagtggaatcaattacataacagatttccttagattgccaagattttttttacaactactgattatacattgtttttaaatgaattttccagtctatgtatttcattgagcatacactagataccaaatatcatgtggaagcccatgaataaaaaaagaaactgatgaagccccttccctcaaggagctgggtgtagccataaggcgaatcagtgaagagccctttgagatagagggtgatgagcaaagtggtcgagccatgaactggctgccaaagagctgttgctgcaggaggcacagggaaaggcttttccagggagctgatcctgagctgagacttgaagatgacaggatttagccaagaaaaaagggaaaggagtggagagggtgacagtgattcgagacagtgaaagccacaacaggcttctgaaaaacataggtgcttcatttaagctaaaatatattgttttaaaaagaaggacatgggagatgacatgacagagagaggcaggcataagacatgaaaaggttggagcttatttctattagtctgttctcaggaaaaaatgtgatcatgtgtttcgcttatagcaatttcttttttatgtccttatctatcacacttaaaactctttccacacatcatttgacgctcacaagaattactgctaataaagacatacccaagactgggtaaagtaaagaggtttaatggaatcacagttccacatggctagtgaggcctcacaatcatggtagacagtgaaggaggagcaaagtcacatcttacatggcagcaggcaagagagagcatgtgcaggggaactcccctttatgaaaccattagatctcatgagactcattcactatcaggagaactacatgggaaagaccaagtcccatgattcaattaccccccaccaggtccctcctgtgacacatgggaattatgggagctacaattcaagatgagatttcggtgggcacagccaaaccatgtcattattcttaaggtggtaggagaccatgtacagactggaggcattcattcatttagcaaatacttgaataccaaccatgtgccagccattattttggtgcccagggacacaaaagtgaaggacacaaagtcctctttctcatagtgtttgttttacaggaagacatggacaaaatcttgtatatatagacagacagagatggctggtcagtggttgagaattctaaaagcagcagcagaccaaggaataaagagtgagccaaggaggaggctgtaatattattataataaaatgcaagaagtacaaaaatgcaaaaaaaaaaaaaaaatgcagttgggcaaaccaactgcatctaacaccaaacccattttataataaagtgtagagtatatcatgtaatgtattgaatactaaaagtgaaaaacagaatggttgtatggggactcaaagttcggttcccactgtacatatattgctttcacactcttataaagttgaaaaatctttaagtcaaaccatcgtaagtcatggactgtctgcacttagtgtaggccaagtactgcagtaactataacggaagctttgcatgtggattaatttagtcctcatttccgtaatacagattagaatacttaggttctaagaggttcaatatgttacccactggccataaagctctatgaagcgatgacgcttcacttctgccccccaagccactttgatatgtggcagtgggaacagagaggcagaatttactgagcctggggagaaaggtagttagagaaggcttatacagattctttttgcaagataaggcaggcactggtcaaaattaagagttttgtgtgtagtaattatgaaaatggcattggaattacacatatggcattaaataactcatactagagctacctccaggtcttattaattcctaactgaccacttaggtgtccctcaacactagccgcaatgaaagtaaccatctctactctgttattacagtattttttgtttgattacagaaacctccttctaaataagttaacttctgttttttgttttttaacttttaagttcctatcacccaggtattaagactagtactcaccagttattttttcctgattctcttcttcctcccaccctgataggccccagtgtgtgtgtcattaaccctctatgtaccttgttttctttatccactccatcactgatgggcctttaggttgattccacatctttgctattgtgaatagtgctgcagtgaacatatacatgcgtgtatctttataatagaatgatttatatttctttgggtatatagccagtagtgggattgctgggtcaaatggtattcctatctttatgtctttgaggaattaccatactgtcttccacaatggtttaactaatttacactcccatcaacagtgtataagcgttcctttttctccataacctcaacagcatctgttattttttgactttttaataatagccattctaactggtgggagatggtatctcattgtggtttgatttgcatttctctaatgatcagtgttgtagcttctcttctttatctaagaggaaacattgttcctgttgttgtttatagatattagagatataaagcatagaaaggtgttcttcatttttcagtttaattcagtgggtataagaaactgtgggatgtggggagatgaggaaggcttgccccgtcttcaagatgctgagctgcattctttcattagctaggacaactggaaagaatcaaattgactttcagtttcagaaacgaacattggggaagtttctgacatttctttattagagtaaattctgagcatgatatactctgtcaaaggaaaattcctagcatggatacatccatttttaaaagcatcatttttactttgaagtcaaaagtattatcagaatttgtcgtcgattcttaaggttgtatctactaatacagtgttgcaccaggattctgaaagtccactttaaaatattttaaaactctttccctttaattaacggagtgtaaagtatgtatgtaaggctaccacaaatatctttatatatgtgtatatattaaaacatgttaatatattgacataatataaataatatccatatatgtaatatattttaaggctatccaggttttatacaatcagcacatattagggctgggcgcagtggctcacgcctgtaatgccagcactttgggaggctaaggcgggagatcacttgaggtcaggagtttgagaccagccttgccaacatggtgaaacgccatctctactaaaagtacaaaacattagctgggcctggtggcacatgccggtaattccagctatgtgggaggctgaggcgagagaatcacttgaactgaggaggtggaggagattgtggtgagccgagactgcaccactgcactccagcctgggagacagagagagactctgtctcaaaaaaaaaaaaaaaaaaaaaaaaaccaaaaaaacaaacaaacaaaaaaaacaaaaaaacccacatattaaacttgtactactcaaacctttaaaagcaaggagttacacgggatgctgtgactgtctgaacacttaacagatgaaacaaagatgaaaatctttgtgatcagatttcttaatgcttacagtaaatattaatttaggttgtaacttgactgggattcagtggcccaatgttattttaaagctagtatctcatgtagtttgggccctgattttttaaagatatctaggtaaaaaaaaaaggactcaagtcataacatattgtgaggcagatggattagtgaccagagagttaccttttcttcaataaggtactagttaaaattatctccaggaagcttctggcaagaatccaacggcctaagaggaattaaaaggtaattgtaaatccacatttgctagcataaaagtctcatggaattcaacctccacgactgcagtgggaagtgaaagctatgtactatgctttatagacctatgctgcctagtaatagtagcttctgcctatttattaaattttaaaaatttacacgcctgttcaagtgctcagtagcccattagctgctgccacgctggaccacatacagagaatatttccctcattgcagaaaattcggtcagacagtccggtttttgagtctttggagatcacagaacagatgaactgaatgccattttctcggagttcaactagatattctaatgttttgtgataagtttctataaattttatactttagatttctgtagtgctgcctctgaaaactgcccttttaaaacatgactactttggttggaaaatatgaggtgtgtttttggataagtttctttctggtgccattcacgtctttgctgttttattttgtatttcatcttgttaataaacatctagacggcatacaggtgacatgtaaacatagatcagcccgtgcactgaaaggaaaacctgtcatggttgctaatgcaaagtggtctgcaatgaacacacggaagatatgtcaaggttcttattttacagcagttttatgaaatgatttcatagactgcaagcacaaagaatgtcagcagagagctaaaaatttccacaatccaagtattatactaaaagtaaattctgtagccggttgacagaaaaattccttaaatcctaatgatgtgtggagaaacagccctttccaaaaggataaattactgttgtaaatttttatcaattctattgcctgtaagcattaacataatggctgacctactcacctttctgttgaagaaacagtataccattttactttatcttaaaaatactgcactttaactgaattgtttcgccctttacagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggtaagtaggactgctactgtttgctctataatcaaactttcctaaaatgtattttatgttctgctttctataattaggctattgtaatagcctttatgatgtatagagaatttgaggagacatgatagtcaagaatttttaaattgatatagtttcatggcttagaacagctgttctcaaagtgtggtccatggatccctggagagtgttgagacacttttagagggtccatttagtcaaaactacttccatgataatactaagacattatttgccattttcactgttttgatatttgcatggctgatgcaaaagcaatggtgggtaaaactgctggcgtctaaacataaatcaagactgtggtatcaaagtaccagcagttactgtattcaccgccaccatgctttcgcagtttgaggggaaaaaaagccaatttcacttaatgtccttataaagtagtaaagtttattacttttattaaatcttgacttttaatattcagtgtactaaaacaaagtacacacaaagctcctgctgtataccaaaaagtaaggacaagcactggtttgattgagttgtgaactaaactagccatgtttttcatagaataccatttttatctcaaacaacaactgacaggctatgcttattccgacttggtgtagcagatattttcttggacaaaataagcctgtcacttaaaggagaacagcatgtgttgccaatgataaaactcaagctttcagacaacaatcagaattttagaaaacttgtatgcatctctgagaacttgcaagcttcccaataaagttttctctgagatcaatggtaatattaatgaatatgatgttttaataatgtataatgaaatatgtcaacatttggaagatctgaagtcagtgaaccattattgtttgtatgatcaatgaataacattaattttcaagacagaccaatggaatgtcatggagtaagaaaattgcactgcaggttcagattccacataacaaatagtctttaaggaaccaccatttgttgagttttagtgtagtatcaaagaagactatactaaattgtttctccttttctcaattacaaatctgtaggaggttggattttcttcacgtatttcaaccaaaacatgacattgcagcaggttgactgtagaagcaaacaggagactgcaattgtcttctatgaagccagccagccagccattagagagatgtgtaaaaatgtagctatttttattaaaaaaaattcggccgggcgcagtggctcatacctgtaatcccagcactctactaggctgaggtgggaggatcatgaggtcaggagatcgagaccatcctggctaacacagtgaaaccccgtctctactaaaaatacaaaaaaattagccgggcgtggtggcgggtgcctgtagtcctagctacttgggaggctgaggcaggagaatggtgtgaacctgggaggtggagcttgcagtgagccgagatcgcaccactgcactccagcctgggcaacagagcgagactacatctcaaaaatatatatatatatattttaacatgtatcagatttattgtgaatttttaaataaatgttttaatagttttccattttagcttctttaaagaggttgtgagataaaatgtttgagagctgctagcatagaaaaaatgtgagtgcttaaagcttgcaactgtgatttatgttaacatgttaattttgcagataatcttatagctccatctattataagccccttgtgctgtatataaaaaggccccagagaaaggagtcaataatgtaccttgtactttacctggatgtagttattactctgttaaaaactcattatcttttacaggttttacaaaggttaataaaatctcgagggaaatctcaagctaaacacctcaacgtccagatggtagcagctgataaactggctcagtgtcctccagtaagttatctctatatacagcataatccagttacagagatcagaccttttttttttttttttttttttttttttttgggggacaaggtcttgctctgttgcccatgttgggagtgcagtggtatggtcttagctcactgcagccctgaactcccgggctcaagtgatcctattgcttcagccttccaagcagctgagactataggtgcatgccaccatgatcggctaacttttttttttccccctgtagagacggggtcttgctatgttgcccaggctggtctagaactcctggcctgaagtgatcctcctgccttggtcttccaaagtgctaggattacaagcatgagctgccatgcctggccagaactggcattatattttgaaaaaaacagtcaaacacctgtcagggaagagaatcctcatcacttacagtggtattcattccaaagtaaactgtcctccctccttccatgatcatgtgttttgagcacaagtaatccaaacgatgatcatagcttaccaaaagcttccgtacatcctgcagtaacttcactttgttaatatccaacacaagatcctggttccgaaaatttggcttgtatgatgagtctatttggagttggtatattattcatttctgatcatagggatcaagttgtctgctcttaataactgtctgagacatttattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcctggccaacatggcaaaaccccatctgtactaaaaatacaaaaattagcagggcttggtggtaggcacctgtaaccccagctacttgagaagctgaggcaggaaaatcacttgaacctgggaggccaaggttgcactgaaccaagatcaggccactgcactccagcctgggtaacagagtaagactctgtctcaaaaaaagaaaaagaaaaaagatatcacaatctttatgtcaagaacaggcttcttcctattctattctattctgttcaaatatatatacatctcttttctaccatagtatctatgcctttttcattgctgattgatagacaacttttctgggttgccatgtccttaacaactgttacctttctggccattatttattagttaagcattcagtgccctcaacaatgatttgaggtagtcagacacttcctaactaaataaaaagggagatagtagcagcacttatagaagcaggagcaagtacaaaggggtgcagctcatgagccccttcctcctcttatggaggtgggaagggggtgaaaactgggctggcatcaatgtggtctggaatgtctgcctctgcaggagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacaggtaaggggagtttttatatatatctatatatacaatcttcatagaaaaaaggttgcctatggtgacacctctaggatccaagcccagtagcctgcttggggcttgttctagtatattaactcaaagcaagtccagcatgagctgtgtatgtacctgtaagaaaagcaccatcaacagaatatattgggaacatacacagactaccgaaactttctaaacagtagcatagactgtggaagtggatcacctagattcaaatcctggctgcacctcttaccacttgtggggtggataacctggggcaaatttcttaactgttcttacctcaggaataataatggcaacctgtccaagaggctgctggaattaataatctcaagagatgatcttatagggctgttgtattaatgagttattatatacaaagggtctacagaacagtgcctgtcccatactgtatcactgtatcaggtaagcatttgctatttttaatattctcacatacagtcaagcagaggtagttaagtttacaccgctgtatagaaaaatctcagggacctgcatctgtatttgagccacaggagaataaataaaagaacattttccctgctgctgcttttttttttttaaaggaaaaagttaccatgggcactgttctaggcacttacaaaagtccaatttaatatagtatagtataaagccttataaatgccactggatgttaccaaagggatgaagctaggttagacttcatttcagcttttcggatgcttaaaaaggactctgcttgaatgcacttgctctgggacatgttctttacacactgaccttggttaacgcctggtgtgctcctttcgctgccagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaaccttgcctattgttcctgttgtttgtttacctcccagttacctaccattcctccccaccaccgactccagcaggttcactgtctgtcagaacccagaagtgcttcttataaccaaagtttctgttcttcagaagaaatcagggcaaaatggggtgacttgaagtgaataaaatgttaagaatattatcctacataagacatgtacacagaaggggaaccttgaagacattatctccatgcctcaattacactgctgtaagaagcttacaatgtcatcatgtttaaggctaagaccttttccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccccgtctctactaaaaagataaaaaattagccaggtgtggtggtgcacacctgcaatcccagctacttgggaggctgaggcaggagaattgcttgaacccaggaggtggagcctgcagtaagccaagatcacaccactgtactccagcctgggtgacagagtgagactccatctccaaaaaagaaaaaaaaacaaaaaacaaaaaaaactatccagcaaaattataaaatctactttgttttgcttccttgattattccaagttcttaccaaatattcttagccttttataagtaaaactgttttacatttaactccttatttcccttacccccaagaaaacgcaatattaaaaatgattaagctggggtggtagagtatacctgtagacccagctacttgggaggctgagataggaggatcccttgagcccaggaggtggaggctgcagtgaaccgtgactgtaccaatgcactccagcctggtgacaacctggtgtttaaaaaaagaaaataaaaattagttacatatataatgttttatcagcttatatatgaaaaaatttccctcagttcgttaattagccctacactgtttacataaatttatttactgagtataaaatcagtagtcataataaacttgacaattcttacattggtaggaaaccatattctaattaaaattg

SEQ ID NO: 13507 - DNA, 14721 bp, Human
accgtctttgagctcagtgaggtggagtcactcaggctggaggccatctgcgatatcaccttccccccggggctgtcacagctggtgcacttgcaggagctcagcttgctccactcgcccgccaggctacccttctccttgcaggtcttcctgcgggaccacctgaaggtgatgcgcgtcaaatgcgaggagctccgcgaggtgccgctttgggtgtttgggctgcggggcttggaggagctgcacctggaggggcttttcccccaggagctagctcgggcagccaccctggagagcctccgggagctgaagcagctcaaggtgttgtccctccggagcaacgccgggaaggtgccagccagtgtgaccgacgttgctggccacctgcagaggctcagcctgcacaacgatggggcccgtctggttgccctgaacagcctcaagaagctggcggcattgcgggagctggagctggtggcctgcgggctggagcgcatcccccatgcagtgttcagcctgggtgcgctgcaggaacttgacctcaaggacaaccacctgcgctccatcgaggaaatcctcagcttccagcactgccggaagctggtcacgctcaggctgtggcacaaccagatcgcctacgtccctgagcacgtgcggaagctcaggagcctggagcagctctacctcagctacaacaagctggagaccctgccctcccagctcggcctgtgctcaggcctccgtctgctggatgtgtcccacaatgggctacactccctgccacccgaggtgggcctcctgcagaacctacagcacctggccctctcctacaatgccctggaggccctgcccgaagagctcttcttctgccgcaagctgcggacgttgcttctgggcgacaaccagctgagccagctctcgccccacgtgggtgccctcagagccctcagccgcctggagctcaaaggcaaccgcttagaggcgctgccagaagaacttggcaactgtggggggctcaagaaggcggggctcctggtggaagacacgctttaccagggtctgccggcagaagtgcgggacaagatggaggaggaatgaagctggggtggggccgttttaggtagagccttaaaaatgcttctgccctggaatctcaaccattgtcttccaagataggaagccaagtgggtccaggccaggagatggggggggcgggggcagctgtgtcatctttctggggcccaggaggatctgggctggtttgtctggggagacagacaggatgttgtggagctggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatggttctcatttggctaagcatcaaaatcacctagggagtcggtgcaaaacaaaatatcccagtcccctcccctgaaacactgactcaggaggtttggttgggggccaggagtctgttcctaaatattccaggtagttctggtgcaggtaagtggccctgagacagtatgttgggaaatgctgacgtaaaggtatcagggccgggcgctgtggctcatgactataatcccagctgtttgagaggccaatgcaggaggatggttgagctcaggagttcgagatcagcctgggtaacatagcgagaccccacctctgccaaaaaaaaaaaaaatagggtatccaaatatctagattctgatcccttttgaggtcctagaccctttgagaaactgatgaagccaggcacctccttcctcaggaaaatgctggtgtacaaatacacacaaagctcttcaggcagctgatagatttcccccagagagctattcaaggacttcctaaggtgggtggactgcagggttaggacacctgctatagaggtgacatttttccaaggacaagcagggactttggtcttgactgttctctgggtgcttaataaataatactaattatgcaagttctagttttgatctcttatgtgcactcctgtcattgtctaacaccgtccattagggccagacatagtggctcatgcttgtaatcccagcgctttgggaggctcaggtgggaggatcgcttgagctcaagagcttgagaccaaactgggcaacatagtgagatctcatctctacaaaaacatacaaaaaaaagttggccaggtgtgctgatgtgtgcctgaggtcccagctactaggcaagcagaggcaggaggattgcttgagcccaggacccaggaggttgaggctgcagtgagctgtgatcacaccactccactccagcctgagcaacagaacaagaccctgtttttctttcttttttttttttttgagacggagtctggctctgtcacccaggctggagtgcagtggcgcaatcttggctcactgcaacctccgcctcctgggttcaagcaattctctgcctcagcctcccaagtagctggaattacaggcgcctgccaccatgcccggctaattttcgtatttctagtagacacggggtttcaccatcttggccaggctggtcctctcctgacttcgtgatccatccgcctcggcctcccaaagtgctgggattacaggcgtgaaccaccatgcccgtaaccttttatttcatgtgaccaagtaacacccgtgtgccagaatcaaggatgagtctcatgttctcagagcagaggcacagaaggctgcctggaagacggaaaggtaaagacctcagctataactctacacttgtgtgtgctccacccacaaatcgtcaccagaggagttccgacaagccggtaactctcatcccaaagtgttccctcgttggaccagaagctggaagggcacttggcagagtctgcctggccctggccacctcccgggtgtccgcaaaatcagaacttccttctcgcatctaagagcagagggaagccgctcttggggggatccctgggttccagatgggacatttccccagcacccgtcggaccacttaaaggagtggtttaggctgccgggggcccaagcactggcacctaaccccagcgcccctcctcagataggaattctccacgtccaggcgctgggctcacgttccgggtgcgagagagataaggggggtgtcttgaggttctatgtgggtctggccaacaactctggccttgaccttggccccgtcgccgagggcaggggtcacaccgctgggttcccatggccgtcccctcccccctggcttcagccaactctgagcctgctggggctggcaagaagggaaagggctctcgacggagcctaattacggtgaggaggcggcaccccgctgccagcaggaggctaggaggtaattaagcacaagaggaatcctaataaagcaccatcagtgaggaaggcattccgaagggacgcccaagccgaccgtgaaaagcgaggaggctgaggctgcaccgccgtggagaccagggatcgactgccgctttgggaacgaggttccaggaatgcgcatgcgcaaaagccacgcgggcgaacacggcttcgcctcgctaagcatgcgcgccgttttccccgcccaccgtcctcagaagaatggtgtttcctcgcagcgcctctctcaggagcgatcgggaattggcgcatgcgcactacggtggtggtggcgacgaaggcgggggttgcacgttgcctgcctcgagctctaggtggcgtcatccttcgggctgagccgaagcacgcacgcgcggaggttcgcacgcggagaagggcgggtgcgcgccgcgggcatgcgcggtgcggggcgagacggcggctcgacggggtcatccgggcgcaggcgcagtgcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccagtaagcacggcggcgtgggggagggggcgggcgggcggggcggggcgcgcgccgcgggaggccccgcccccaccacaaggccccgcccccgcttccggggcgctcgctctcctctccgccccccccgctgcgggctcgcggggcgagggtcacggtgacccggggggcgtggagccggcgagctccggggggttcgcaccctcagggcttgggagcccagttcccggacccaggcgaggcccccagctgatgacccgcccccatcgccgtgatcctctgggtcgggcttccccgactccacgcgacagtgaccacatccaggtcgccccgaaaacacagacacgtccctgttgacctgatgctaccactctcgtcatctcagggactgtctggcgcccccctcccccggcctgggggcttgtcagccccgtgcagcgacgatctacgcacacgcgcacgcctggctcggggacacctgaggttacttgaccacatagagcccctccccatctcttctgacccgaggattctccctctcgctctccctgtgaccgtgtctgaggtggggggacgggagggggtcccttctccccctcttggcgacagtgaccatggcattgggctcagcagaccccctcccacatacaccaggccccgcaaatccctgtgaccagtttcactgccaccatcttggtgagcgtgtggtgtctgacctccagaaatgcacatcgacccccagccagcccggtgactttgtcacctgtgttcaagtgatggctccccttcccttcacacccacacccacctgacctggggacacctggggccagtgtgactctaggcctgctcccgccgcgccccagcatacatccacctgctttctgatcagtcccaccacctcggtacctacctccctgacaccttgtcatcctagatcagtacctctcgcttcacacacacctggcctgggaacactgaccatatctagtctcccggctttttccccaagatcctggtctctaaatcctctgggctggaggaaattagattttcaaaccctgtgaacaccacccctgacccatgatcctttttgtgtctttcttgacccagtaaaattctctcttgtctcctctgatgtgaccttcgtagtttatttagttctctctatggagtcattatggcaggcgagaaaggtacccccgtatctgggcaccccacccattccctggtcacccagcctgaccttcacagcctgacaccctcctgtccctccctctcctgacctgagtcagcgtgggttcctccttggggagtctcttgggggtccagagaaatcatggaggtggggattctggtgcaggacactgcctgagacaagaagcccagccaagacacgggtccctgctagcccctgggggccgccctccctggcccctgagtggatgagacagggttgagtccaggatcccgggtgccttcaggggtggccgttcccatgcagagctaggaggccggtggcaggcaggcccccgaggagtcccctccaggcgtctctgtctgtgtcaactccatcccatcctccccgccctccccatctctgtcggttcctagccatctctgcagttcggtgcctccccctcctcctcgtttatgatttgatttcttttcttttggacgaatcagtcgtttctgttgtgatttatcgtggtgttgtttttttcttccttttccccatccagttattgtgatcactctaagccctgctcctgccccgtcccaacgagcaggtaccagcctttttatcatcgctgcttggacatctgcaccattgacctaaccgctgccccggccgcagaatggcgtcccccagcccccatgctctgtgtgtgtccccatgtcccttcccctcactctcactttctctctcactccactcaagcagcggtcagcccagcccagcctcctctgcgtcctccctcctcctccccctcccttactcccagctccactttggactccctggaggaggaggtgggctcccccactgaatgggagtctgtggcctccgggggtggggggggtgcacgcctgtgtgtgtgtaactgagagaacgagaaagttgggcctggtgggtgggtggcctgtgcctatggatctctctcaacaactaggtgaacacatagcaccccccgggttccataccagccctgggcgccagggacacagcagtgaatagaacagatggagcccctctcctctgtagcggggggctgcaataggggggcccactggacaaggagcacattcccaccagagagaacattctagctgggtgagcggccctgcagggggccagcctgggggaacctctggagacggtgggaattgaacaaagcctctggggaggccaggcacggtggctcacacctgtgatcccaacactcggggaggttgaggctacagggagccatgatcacaccactgcaccccagcctgggtgacagcgagatcctgtctcaaaaatttaaaaactgggccaggcgcagtggctcatgcctgtaatttcagtactttgggaggccaaggagggtggatcacttgaggtcaggagttcgagaccagcctggccaacatggtgaaaccctgtctgcattaaaaatactagagattaggccaggcacagtgactcacacctgtaattccagcactttgggagaccgaggcgggtggctcacctgaggtcgggagttcgagaccaccctgaccaacatagagaaaccccgtctccactaaaaatacaaaattagccgggcatggtggcacatacctgtaatcccagctactcgggaggctgtaatcctagctactcgggaggctgaggcaggagaaccgcttgaacccgggaggcggagattgcagtgagctgagatcgcaccattgcacttcagcctgggcaacaagagcaaaactccatctcaaaaaaaaaaaaaacataaaagattaggtggaggttgcagtgagctgagatcgcgccactgcattccagcctgggcaacagagcaagactccgtctcaaaaaaaaaaaaaatttaaaaagcgtcttgaaggagttggggggggagagaagacagggccgccagggctctgagcgcagcgccagcctgtgtggggcatgcaggctgtgccccacgcctgtgttgggagagagagtagatggggtgcctggccctgtgagtggttgtgagtatgtgtgtccgagggcaagggggactctgtcccggctgcatgggtgttaggtccacggcatgccccgggtgtgtgttgtgcgtgcgtgcacttgcacggcatgtgcgtgcatgttgacatggcagccggtgcacctgtggctcctgtcggcagacacgtgccctccagcctctcgctctctctcatccgttctctttctcatcctcaccctcttgctctcactccaccctcctgagctgccatgtggccatcaccacctctgtggcctctgttctcagggcctttgtgtacctccttcccccagtgcctacctgaaccctcccttccatccccccatgctccagtctgtggtccggcagcctcctccccaggctccggggccaccctcggaaggcctggtgggctctgtcagggaaggggcccacaggactcctcgagggctgtggtcgtcaaccgctgagtgcagggtgtgagcgggactcggatactctctgagggcgggaactaggcagtgtctcaagagatgccaggtgcacaggggttgggggctgggttggggggagcacaggccctcgggagccagaaggggactggggctgtggctcaggccatggacagagcagaggcgcagggacctgaagaagcagagggagaagcctggccaacatagcgagaccccatctctactcaaaagacaaaaattagctgggtgtggtggcgtgtacctataatcccagctactcaggaggctgaggcaggagaatcacttgaacctgggagggggatgttgcagtgagttgagatcacgccactgcactccagcctgggtgacagagcgagaacctatctcaaaaaaaaaaaaaaacagtgggaggtgacgtggtgctgcagaggcggcagtggccaggacagcgggaggggcacgggaggtgaggcctctaggccagtcatgaacgctgggcctggctgtgtcccaaggtccccagagcccttcccctgctcctgcctggtcctccaggaggggagctagggggcacagctcctgcaggggctggcaggaccagataggggcaatgctgggcctcctgcattgggactgaggcgtcttcctgcccctcctactggctgagatcagggtcctgggcacacgggagggacggggtttagctgccagcatggagcgggtttgtctgttcatattagtccctgggcaccagtcaccaggagcctgcagaactgtggggagaaaaggtggacgaggcaggaggaaaagaggggagaggggcttgttggctgagggctttggagagcggcaggccccagctcctgtgggaggggcaccttggtaggtgtgtgtagccgttgtcagggcctctaggatgtgacgtgtcaggattggctcctctggaggccacgttagcatcccggcctctgttcctgcaccctgttgccagcccagccagggagaccctagctcctccgggaagctgccctcctgtcccaggcccctctctggcctgtctctgcagcgcctcctctgggcacctgggccctagtcttggttcctgtctgtctgtctgtctcctgccctcccacccctaatgccgcctgcccaccccagggtgcctgctgcctgcccgccgcctgcccacccgctgtagcatgcccgagctgcccgcatgcaggctgctggatgagccaacccccgcctggcccagcattggccccacctggtcccgccagcccctgcaggagctgtgcccccgagctctcctcccagaggatgcaggccccctgaggtcctgtcctgcccccatgggccccagctctgcaggccaggccaggaggccctcatgtcagcccactggcccgaggggggccctccctgaccccggaacagaagatagggcaaggcagcctgaagcctgggtctcgtgcccgctgcctccccagcgtggccctgctcgctcttgtctgggagccaacttcagtgctaccagcagagccacagcctgggccagccctggcaggcactccgccctggcctatccatcctgtgggtgctgtggccctgggcctgcttcctgggcagaagtgggaggaagtgcacacacctgtcagggaggccccctggccgagggacacctcaggtccccatctcgtttctccgtcagcgtagacttggggctccctctcccctgctagcctcctccatctctttccaggtcaggggatgagacaagggaccctgagaacagtctggggtgggagggagaccccagctcctccagcccagcagggcagggggctgtgccagcctagctcgggaaacccaggaggggaaggtgagggtcccgacccctccctggagtgccagatgtggagctgacaccagctgggcgctgacccccctccctgccactggttctcacccccctagccctgcagctcccgctggccaacgatgggggcagccgctcgccatcctcagagagctccccgcagcaccccacgccccccgcccggccccgccacatgctggggctcccgtcaaccctgttcacaccccgcagcatggagaggtgagccaggggcccagcagggttgggtgggaagcagcattgaggggccaccgtgccagccctgggaggagggtggttaaaccggtgggaaccccggtatgggggactggggtggccaacctaaggtcaggacccacctccaccggcacctgctccatgtccccagcattgagattgaccagaagctgcaggagatcatgaagcagacgggctacctgaccatcgggggccaggtaccaccttcactgtggcggggagagggaggaggcccagccaggctggacccatcctgggagcgccagtggggggcagggggcggtggcagaggccccagggaccctccaaccctccctctcctcccagcgctaccaggcagaaatcaacgacctggagaacttgggcgagatgggcagcggcacctgcggccaggtgtggaagatgcgcttccggaagaccggccacgtcattgccgttaaggtgagccttggcggctaccccggctgcgccccacaccccaggccggtgctgaggctccctcctgtccctgcctgtgcagcaaatgcggcgctccgggaacaaggaggagaacaagcgcatcctcatggacctggatgtggtgctgaagagccacgactgcccctacatcgtgcagtgctttgggacgttcatcaccaacgtgagtacctggccgcgccctgcagcgtctcctcctccctcacccctgccccttcctagggagcagagcctctggggggtgggccggaagacacagctcccccgggtgcccctctccctgcagacggacgtcttcatcgccatggagctcatgggcacctgcgctgagaagctcaagaagcggatgcagggccccatccccgagcgcattctgggcaagatgacagtggcggtgagtgaccaggcggggcttgcactgggcaggatgacagaggcggtgagtgaccaggcggggcgtgcactgggcaagatgacagtggcggtgagtggccaggtggggcgtgcaccgggcaggtggccttgggtctgtgccccctgccacatgcacccccctctgcgtgcctgcagattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcagtgagtgggggccccccagcgggggagggggtgggggctgggaggccggccccagccttggagatacgtcttctcctcccccccctgcagcccgagcgcattgaccccccagaccccaccaagccggactatgacatccgggccgacgtatggagcctgggcatctcgttggtgagttggggccctcccctgttctccagccaggagtgagggcttctgggggactcggagggaggagaacataaacctgtccagccctgcccgtctccctcccaggtggagctggcaacaggacagtttccctacaagaactgcaagacggactttgaggtcctcaccaaagtcctacaggaagagcccccgcttctgcccggacacatgggcttctcgggggacttccagtccttcgtcaaagactggtgagaacctccctccacttgggaggtcagggacagcccgctgctctgggcagctggggaggcaatggcaggaggggaatggaggccgcaccctgggatgggcggatgcgactgtgggcgggctcctggctggcggctgccacaggagctggagctggtgcccggggagccatgagctgggtttggacctagcctgaggggacagccagccctgtggcatttggcggggtggctgttggagattgtgagcacgcttctgcaacaagcacagctacaagttcaggagggccatgttcgattctctcaggggagccccacccacctttctgggggacctcagccagctctggccccccaagccaggcccttgccacctggccctaggccaggaggctccgggactcacagttgctccccgctgtcagccggggtcctgaggacatccacagctccttcccccacacacatcttggggacccctggccccttggggagggcctgagcacaggggtggggccggcatcccctcctccctcgttctcacatctgtcttcccttctcttgctctagccttactaaagatcacaggaagagaccaaagtataataagctacttgtgagtacctgagccctcccagtccccgtcctgtccctgcggaggcgcgaggccaggagggaagaccgtctcctcctaagccccaccccctcgggcccacaggaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttccaccgagtctgtggtgtgtcatgggcctggcagggcgaggtgggaagggggtggttgcgg

SEQ ID NO: 13508 - DNA, 46244 bp, Human
ctgaggcagaaggactgcttgaggtcaggagttaaacctgtgggatgattgcacctgtgaacagccactgcactccagcctgggcaacacagtgagacccaatctctaaaaagctttcctaggccgggtggtggctcatgcctgtaatcccagcactttgggaggccgaggtgggtggatcacttgaggccaggagtttgagaccagcctggccaacatggcaaaaccccatctctactaaaaccacaagaattagctgggtgtgatgttgcacgcctgtgatcccagctacttgggaggctgaggcacgagaatcacttgaatagggaggcagaggttgcagtgagctgagatcacaccactgcattccagcctgcacagcagagtgagaccctgtctccaaaaaaaaaaaaaaaaaaaaaaaaaacttctaagaaaatatgattaaaaaaagaaacaggctgggcaccgtggctcccgcctgtaatcccaacactttgggaggccaaagcaggaggatcacttaagtctagaagtttgagaccagcctaggcaatacagcaagacctcatcgctacaaaaaaataaaacattagccaggcatagtggcacatcctgtagtctaagctactcaggaatctgaagccggaggattgattgcctgagctggggaagttgaggctgcagttagctgtgatcataccaccgcactccaaattgggtgacagagtgagatcctgtctcaaaaaaaaaaaaaaaaaaagaaaaacaaaattgtaggccaggcgcagtggctcaagcctgtaatcccagcactttgggaggctgaggcgggcagatcacgaggtcaagagatacagatcatcatggccaacacggtgaaaccccgtctctactaaaaatacaaaaattagctggttgtggtggcgcagcgcctgtaggcccaactacttaggaggctgaggcaggagaatcgcttgaacctgggaagcggaggttgcagtgagcggagatcacgccactgcactccagcctggcgacagagcgagtctccgtctcaaataaataaataaataaataaaaataaaaagactattattttcagatcataaaaaaaaaaaagaaaaaattaggcagagtgcaggcatgcctgtaatcccagctctttgggaggcggaggcaggagaatcgcttgagtccaggagttcgagaccagcctgggcaacagaaccagagcccatctttacataaaaaaaaattaaacatgtagcttgcatgtatttctactagggcattctaggccagcgctggtttagaatgttagcccaataagaccaggtattttttttctgctcactgcccatacagtgattgacacacagtaggcgctcaatgacattttaatgaatgaatgagatgctgagccttcgggaactggcttgctcaaagagccagcaccgatgaagcgctgaccacgttccatgccccgcctcctcagcgcaccagagaaggaaactgaggcccggcaaggtgacgtcagctcctgcccaacggcacgtagtgcggaaacgtcggggccgggattcgaacccaggttctgtacccgtaaccccggcgcgctgacctttcctaccttaccgggcggcggcaggacagacaggtgcgggacacacggcgagcgctcaaccagaggcgccgctcctcagccaccgccttccgtcagcctccgagggccggaacccagttcgccccctccgcggccatcgctggctgcccgcgtctccgccggccgcggagcacttcgcaggcggcgccgaccggaagtcccgcctctcccgcgcgccccggagcgccgcgacagctacgccggccaatgagcagcgcgccgtggcggacgtcggccaatgggctcgcgcgcggggggggcgtgtccgggccgcgggccggagcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccaggtgaggcggtggggggccttcggcggcgcccgacggggtaggccgcggcaggcctgagctcgcctggcctggccgcggggcgcccgcgggcctgcaccggccgaggcccaggccgcgccggaccgggggaggggacgcgcgctggggccgcggcgggcgggtcggggcgggccggtgtgggcgccggctacaggccccggggccggattcctctggcgcctcgagggacgggcgagggggatacggcgtgggcatgcgccggggggccgggctgcacggccgggggccccggtcgccttggaagcccgggctccgggggcgggagagtggggccagctacgggggagcgccgggaacgctttgagcgcgcagaggtcacggcccacgggcttgctcccccgggaaatcccacagattcttttgtggtcgttgtcagagcaccgcggccggtgcgaggtcctttgagaagtgtgcaaacccttcagtagatacacgggagtcctgggggaaaaaaaaaatctaaactgcatctttttttgagcgccatctctaacaaagctgtttgtggggcgtgggacgttaggatttgtaaaatatgtgtgtgtgcctgttggaaacacaagctgcacacagttgaacaatgggggatggatgcccttccttccttttccggtgctctgggctgcggggcttgttaaaatgggttttggtccctactgtgtgcagggcaggtggagaagaacttctgcacaacttctgcatgggcttcccgtggtgggactgagcccccttgctagaaagtgttcatctaagatccggatggccagaaatgggaagatgaggagaatgatctgtctagagcagggtttctcgacgttggccctactgatgtttggggtcagatagtttttggttgtggtggtagtgggggcttccctgtgcaatgtaggaagttgagccgtattcctggcctctacccactagatgccagcagtatccccatgctccaagtcgtgaggatcaaaagtatctccaaacattgccagatggctcgggttgcgggggaggggtctcttccactctcacacgcacaggtgagaaccattactgaactaaatgctcttcctccaaaagttctaatgccctgggagatgctcccaagacctcgaacaagcttgactctgttgagccttagttttcttatctataaaatgggaaggacaaaagtgtggtgcaaattgaagagggtggaaatcccgttgcgttgtgcgtggtctgtgcctggtaggcactgaataaatgatgttgtacatagccaccagtatttattgaggatttactatgtgcttgacactttgtggacgtttgtctgcagtccttgaggcaggtgatgttataatttccattaatttccattttagagatgaagaaactgaggcttagatgggtcacttgatgtgaccagtctcatgcactaaagtggctgcgccagggtttgaactcgggccctctgattcaaaacccttactcttaaccactcgattgtactgctcctataatcacaaggctccagggcactccagttgtcatcgaatattttctgtgtgcaaagttctgtgctgggatctattatcaaattctgcaacttcgaggcccacaaagaggttgagatacacgaacgtctcaaatgtggaaggaaataatactgtttatgttgatgcattggttttgagcagacagagtttcagtctggatgtgttgagtctgagatcatggtgctatttcttttttttttttttttttgagacggagtctcactctgccgcccaggctggagtgcagtggtgcgatctcggctcactgcaagctccgcctcccgggttcacgccattcttctgcctcagcctcccgagtagctgggactacaggcgccggctaccacgcccgactaattttttgtacttttagtagagacggggtttcaccgtgttagccaggatggtctcgatctcctgaccttgtgatccgcccgcctcggcctcccaaagtgctgggattacaggcgtgagccaccgcgcccggaccatggtgctatttcttttttttttttttctttttcttttttttttttttttttgagacagtttcacccttgttgcccaggctggagtgcagttgtgccatctcagctcactgcaacctcagcctcccaagtagctgggattacaggcagccgccaccacgtccagctaattttttgcatttttagtagaggtgggatttcgccttgttgagcaggctggtctcgaactcctgacctcaggtgatccacccgccttggcctcctaaagtcctgggattacaggtgtgagccaccgcgcccagcccatggtgctatttcaagtaaaagaaatgagagaattatgaaaaaactttatgaaaatttcttgcctctctcactctccgcttcccatctcttccctctttccacactccagcaggagttctgttctgtaaatgcacatctaattgtatcccttctgatttaaaatctttgtgcagaaaaaagacacgttttcttgacctctctggtggcttaaaagataaagctagaagcccttagtttggagtgccagttccttcacaccctaaccctccccgcccctgcacgtagaccccaaactctaaccctccctgcctgttgcagcctccacctggagacagatctcttccacctggagatcctttgcttatgctccatggctcagcccagagctcactggccgtttgaagcctcgtctgactgccactcttcctccacccgcaccggaatcaactgttccctccttagtgttcccatcccattcagtttattgaatcgaattcaaggctgaatggcgagagaagcgcagcgcccggctggcgcccctaggtggcagtagcgaggcggtgcggccgacccgagctgtgggtcaggggaagaccaacggaagccagcctgtgggagggaagtgaggctcgctccctcctctgaacgactctccctgctccgctgctgtgtcctgggcccccgctaggctctggagagtgtgcatgatgtgtgtaggtcatctcagcccactctgatgagtgctgtgagaattatgccctggctgatgtggaagcccagaaaagggacctgggtgggcacaggagagcccagaatgcttcctggaggagaggaggcagtagcggtggggaggagctaaccaggcaaagacaatagggtggggctttttaggatacagccaagcccggaggtgggaacatcgcagtgttcagagaacatcgtgtgttcaaagaaccacgtgggttctttagggacaagaaggctgagatgggtagtggtggcaggagtgctcaggtgtccactgggcagagggcttggctgttaccctgcaggtaggccaggggtggctactgagcagttttagttcactgctcaccctggtggagaggctggggggagacaaggagaaaccagtcacaggctgttgcagtactgaggtggccccgtaatggctgaaccgcttgagggtcaggactgggactgcttctatattttgtatgcctgatgctttgctctgtgcctggcacgtggttgatattttgtctgtgccagggaaaggaaagattggcagactactcagaagcgactggatccaggtacctgtcaaacagacatctgtggctgggtgtagtggctcacacctgtaaccccaacagcttgggaggccaaggtggaagattgctcaaggccaggagttcaagaccagcctgggcaacatagcgagatcccatctctaaaaaaaaaaaaaattttttttaagagtgagacgtttatgtcaggggaaggaatcacaggagagggaacaatcctgaacagctcgatggccagactcatgtcaccatgaacagaaacaggcagactcaaggaaggggagtgactaggaggaagaagatgaagctgggtttagagacactgagtttgcaatcccacttaggagtcggtctagcaggaggtgacaggaatctgaatagggatggtggcagagaggtggcaggacggtgagagatctcacatgtcaaactggcaggacatggtgcttgattaggtccaagggctagagagaggtggcttgggggacaggtggggctatgccaccaaatgaagtaattcagggggcggaggcggtttgaagagagggcaaggacaggaggagaggagatgaaggtgtttgtagctgcagacagggaggttggggagacatacattcgccttgattttgttcatgaagtgggactagagacaggtactcactgtaccaggcactgtggagcaaggggtgacatccccagtggaggaagctgaagctctgggaaggggagcgacttctgcacagtagttcagctgatgagcaggagacttagtgcccagctcgggcctgccaggctccagagctcagggttttttcctgccatgccctgttgctttgcacttctgtgtgagatccctgcagtggcctttggccttgaccagccagaaagaagccagagcccttagcagggctgtggggtgcctggactgggccacaggccagccacacctgacctgctcctgccccgggcttctcagcctggctgaaagggaattgtcacttagctggagctgctccagccaggcatcctgcccttctgtgggccatgggcaggggcttggaagaagctggtgccatgtccacctgagaccttgccttgcatggcatttataactgggtcaggtggtgctttgggttttttctggcagcagagcatttcctgaatgacctaagccttttttacctggaagactcagaatgttgcatctggaaaggaccttaaacattattgggtccaagccctgtcagatgatgtgtgaagtgtcaagattgagcctgaagatagatttgactgttctagttttgctctggctcaagtggtttagaatacctgctccgtcatggtgcaatgaaagtgattctcatgcttgcctggtggaaagcagcctcactgcttcactctttttctgtcacacataaagacacacacatctctctcccctggatatgcgctagatgatcgacggatgtgaacaacatcactgatgtcacatagacaaccaggattgtttaaaatagtgcattggagtcaaaaaccttcagagatcatccaaacaagacttctcccagaggccaggcaccgacggtgactctcacctctaagcccagtgcttgggaggctgaggtaggaggatcacttgacgtcaggagttaaagaccagcctgaacaacatggcgagacacccccccgcccccgcctctacaaaacataaaaaagcggccaagcgtggtggctcatgcttgtaatcccagcactttgggaggccaaggcgggtggatcacctgaggtcaggagtgccagagcagcctggccaacgtagtgaaaccctgtctctactaaaaatacaaaaattagccgggcgtggtggcaggtgcctgtaatctcagctactcgggaggctgaagccggagaatcacttgaacctaggaggcggaggttgcagtgagccaagatcgcaccactgcactccagcctgggtgacaaagcaagacccccctctctgcaaaacataaaaaagcttagacagaactacatagaggacttagtaggactacgtagtgacacgcacctgcagtcctaggtacttgggaggcttaggtgggaggatcacctgagcctaggaggccggggctgcagtgagccgtgatcatgcctctgcactccagcctggtctgagagccagcagcctcctgtactgctgtgtgacacaccctggctttgcctggggactcttagatggcaatggtataacctgggccctcaaggttctcaccactgacattggtcattgagtgtaaggcaaataatgataggagtggttgggacagtaacaaaggtttacagcaatggcatggaggcactgagaactagagtaagtaacctgttgtcctgggggaaggtggccttttattttttatttttttgagacagtctcactctgttgcccaggctggagtgcagtggcgtgattttgactcactgcaacctctgcctcccgcgttcaagtgagtctgctgtctcagcctcctgagtagctggtactacaggcatgcaccatcacgcccagctaatttttgtattttcagtatagacagggtttcactatgttggccatgctggtctcaaactcctgacctcaggtgatccgcctacctcggcctcccacattgctgggattacaggcataagccaccacgccaggccaggaaggtagctttttaaagatgagccagcctggtgtagtggctctcacctataatcccagcactttgggaggcccaggtgggaggatgacttgaagccagcatgggcaacaaaatgagacccctgtctctaaaaaaatttaaaaatcagccaggtatggtggcacacaccagtagtcccagctacttgggaaactgaggcagtttgaggctgcagtgagccgtgattatgccactgcactctagtttggcagcagagcaagaccctttctcaaaagaaaaataagtaaaaataaaagtgagctgggaggccaggcatggtggctcacacctgcaattccagcactttgggaggccaaagtaggaggatcacttgagcttgggagttcaagaccagcctgggcaacaaagagagacccccatctctttaaaaaaaaatactaattttaaaaaatgagctgggaagtgaaggagaggacactagtgccctgcagagggaacagccaaagcagaggcctgtagcatattggcaagaagctggagtgagcgggaagggagggtggcgactgaggctggagaaccacctgggtccgattgtgaagggccttgccagtttgacagttgcattgtcatgacaacttgaggcctggccctgccacttattaatggcatgcctgaccgtgagcatcatcgtgtgaccgccgagcctcaatgggtggtgaccactgacagggaataccagaggggtgagcatcttgattgcaggacagtgcaggccttgcacctcgagagacagaagtggctacgacttgggagtcagtgataattgagtggtgacaaggcccagttgtggttggagcttgtgggatagaagctgatttggcccaggattgatgatgcagatttggagaaggtcaagggaagggcctccagagagtggggtgggggcccagaaacgtcatgaaactgctttgcagggcaggttgttggtttctcccgtgttactagttgaccaagaacttgacctgcaggggctgctcagccttgactcagagtgtcaggaggaacagggccgcaaagcagaagttctctttttaaaccttttaaaatttatttttattgtggttttgttgttgtttttgaggcaggatctcactctgtcgcccacgctggactgcagtggcacaatcatagctaactgcagtattgacctcccaggctctagtgatcctcccagctgagccccccgattagctgggattgcatacaggtgtgcatcaccattcctgggtaatttttaattttttttttttttgtaatgatggcatctctctgtgctgcccaggctggtcttgaactccaggcttaagcagtcctcccaccttggcctctgaaagcgctgggattaaaggcatgagtcgccacactcagacaatttatttttaaatttgcatgtaggaaaattcattttttcgagtagagttctctgagttttgacaaacggataaagttgtttgattaccaccataataaagattggaaagttcgctctcccacaaacagaaatactccctcctcctgtccctgtgtaatcgacttttcccctcactccctaaccccagcgaccacagatccatccctatggttttgccttttccaggaaggcacagaaatgatgtggcaagatgtgtttgagattcacacaagtagcatgaattggtgataccttttattgccaggtggtattctgttgtatggtgtatcccagtttatccatgaatggcttgaagaatatttgggttgttgtagttttggatgattatgaataatgccgctctgcacatttatatacagatttttgtgtgaatatagattttcctttctattgccttaatactaggagtaggattgctggatcccatgctaagtgtatatttcaccataagaaactgccaatctgttttccaaagtggctgtcacatttcacatttttgcattcccaccagcagtgcatgaatattctggcttctccacatccctgccagcacttgacattgtctgttttgttgctgttggttgttttttgttttattttgctttagccattctaataagtgggtagcggtgtctcgatgtggttttaatttgactaatgatgttgagcatcttttcatgtgcctgtctgccatccatatatattctttggtatagtatctgttcaaatcttttgccatttttgaaaccaggttgtttgctcattatgttgtttttggtttttggagatggagtctggccctatcgcccagtttggagtacagtggcgccatctcggctcattgcaacctctgcctcccaggttcaagcgattctcctgcctcagcctccccagtaactgagattacagatgcccaccaccacgccttgctaattttttttttgttgtatttttgtagagatggggtttcaccatgttggccggactggtctcaaactcctgacctcaggtgatccacccacctcggcctcccaaagtgctggaattccaggcatgagccagcacactagcctgcttctgttttgagagcttaaaaaaaagtgttctgggccaggcgtggtggctcacgcctgtaatcccagcactttgggaggccgaggtgggcagatgggcagatcacgaggtcaggagatggagaccatcctggctaacacggtgaaaccccgtctctactaaaaatacaaaaaattagctgggcatggtggcgggcgcctgtagtcccagctacttgggaggctgaggcaggagaatggcatgaacccgggaggtggagcttgcagtgagcggagatcatgccactgcactccagcctgggtgacagagcaagactccatttcaaaaaaaaaaaaaaaagggttctgggttgggtgaggtggcttacgcctataattctaatactttgagaggccaagatgggaggatcacttgacaccaggaattcaagaccagcgtgggcaacatagtgagaccctatctcgacaaaaaataaaaaattagccagaaggctgaggcaggaggattgcttgaacccaagagtttgtggctgcagtgagctatgattatggcattgcacttcagcctgggcagtggagtgagactttgactcaaaaaaaaaaaaaagtgttctgactacaagtcccttttgcaaatgtttactccagttggtggattttaattctcctagcagtatctttcacagagcaaaagtttcaaattttaatgatatccagtttatccattttttttttttttaacgaagtgggcttttggtgttgtgtctgagaaatctttccccagcccaatgccacaaagatttttctccaagaaattttatgtttttacattttaaaacagaggtcggcagattttttttgtgtgaagagccagatggtaaatattctcagcttttttggccatacggttgctactacttaactgtgttattgtagtacaaaactatctatagacagacaatacataaacaaatgagacaagctgtgttccaataaaactttatttataacaacaggcaatgggccagatttgtaccacaggccatgatgtgtgtttcaggaggtccacttttcccagacctagaggataccacactgtggacagtaagcctgggacagccattgtccatctcaccgtccatgaaagcagaatgagggaaaaagcaaagtagatgcctaactcttagagaaagggcgaggagaaggaaaggtaaaggaaaaaagagaaagaaagaagggaaatgcttgaattacattttgagcaagcttcaatgtgcattttaattcttcagtgttaacccttgtggtctgtttggatcagcttccagcaaatgtttttgtctgtttgtttgtttttgagccagtgatctattctaaaatctcgtggccacagatggtgtaacagacacgtggagtttctcatgattaaagtctataggtcccgagctgctactgaaagttgaaatttagccatttcccattaacgaatatttagaattctatccagttttatactcttatgaaccatgaggtagtgccttccttgcactttttgttttgttttgttttgagacagagtcttactctgttgcccaggctggagtgcagtggcgccatcatggctcatgcagccttgatctcctgggctcaagcgatcctccctgcctttgtctcccgagtagctgaaactataggcatgggtcaccatgcccactaaattattttattttttgttgagagtcagggtctcacgttgttgtccagactggtcttgaactcctgcacttgcgtgattatttctgtagaaagatcctgcagttgtgagtcagaaggttctaccatctcatactcagatcagtagcaggtgatcttgcgctggattttattccatgtgactggcagaaaatagcatctggttttcttttgcattttcctcattgttcacgaagatgaagttcagtgtctttttctggacttacgagccatttgaatttaaggcctttataaattgctgctcacatcctttgcctacttccctcttggttacgtctcttcttttatcccttaccaatttgtagatgttccgaatcaagttttcccaacctcggcagtactgacatttggggttagataattcttggttgtggggccgtcctgtgccctgaaggatgctttacagctctctgacttctacccaccaggtgtcagtagcaccccctcccccgacccctggccctgaccaagtcacagtaaccaaaaatgtctccagacattgccctgtgtccccttgggggcagaatggcccagtgtgaaaaccacaggtctaaataatagaatatgcagtgaatcttttctctaggctactcctcttcgtctaggtctgtgatgccttttgctgtacagaggtttttaatttcatggagtctcacttttcagtctttttttctatggcttttgatgctaacctactttttaaagagcagggagcataggacatcctcaaataaaagaaatgttaggaaattgtactgattttccacattgtctgagagtagtaggagggtagggaagacctggatgtttctaccaggaagaaagaaaccagacctaattcttccctcggcgttgattcagggagtaggtaggaaatctccacatgagaggtgtgttcagatttttatgtaactgctggcaaggctatttttaaagaaggccaaaggcgcatgaccgtgggcactgggtgttcaaacataacagaattgagcaacagggatctggggaaagggatgggctctcaccgagacctccaggcgggtggccatccacagggatgactacctgtgtgtttagaggcagggatgaggggcctctgagaagtgagcccagtgtgcggcgcactttcagcagggcgggctcggcatacttggccgcattgatctggactcttctccaaagtcatcactggctctgatgtttatcactgaaaggaaagacttcagcaactgagaaagacatttcaaagcctgcaaactgtgaagaccaagttcctctgactggtagagaaaccctcacctctttccagctcactcactgtgtctttgggaataaacaggtgcagaggaccattgcctacctgccccctcagcagcagggtgtccaggggtggggttcaggtacaccccacaggctctggacatggggagaaagcaatcggaaatctggaattctctcgagagacaacccaaaggcttttttacaggatcttaaattgtggtgctggaattgtttgtaggtctctccgaagccctcttagtgaacttggagttgttctgttttgtgtccatagactattttttagagcagttttaggtttacagaaaaattgtggagaacactcgttctgtagcattacaatgaagtattgactgaataaaattttttttaaatagaaagaagccggacacagtggctcatgcccgtaatcctagcactttgggagggtgagatggaaggattacttgaggccaggagttcaaaattaacctgggcaagataccatctctacaaaaagttttaaaaatcagccgggcgtggtggcacatgcctgcgttcccagctactcaggaggctgaggtgtgaggatcgcttgaggatctcccaggagccttggctgctgtgagctgtgatggcgccgccacacccattattagcatctcacattcacatggtacctctgttattcttggtgaatcaatattgacacattattagtaactaaagcacgtaattcagattagagttcactctgtatattgttcattctgtgggttttgacaaacatgtattgtcacatccaccactatatatcatgcaaaatagtttcactgccctaaaaccctgacaatcccgtgttccactatttgttgtcccccccacgccgacctgcatcgctggcaaccattgatctttttctctgtagtgtgcctcttccagaaggtcatagagttggaatcatacagtgtatcacttaacagtatacatttaaagttcctttaaatgtctttcctagcttaatagctcatttctttttatcatcaaaaaatatgcccctgtgcagctgaaccacatgaatggagtctgttcattcattcacccattggaggagatcctggttgcttccaggttttggcaattatgagtgaagccgctgtaaacatccatgtgcagatttttgtgtggctgtaagttaacatgcagcatagaaaagaatctctaagtgcagggccaggtgctgtggctcatgcctctaatcccagcactttgggaggccgaggcaggtggatcacctgagttcaggagtttgagaccagcctggccaacacgacgaaaccccgtctctactaaaaatacaaaaattagctgggcatggtggcagacgcctgtaatcccagctactcaggaggctgaggtaggagaatcacttgaacctgggacgcagaggttgcagtaagccgagattgtgccactgcactccagcctgggtgacagagtgagactctgtctcaaaaacaaaacaaaaaaaaaaaaaaagaaagaaagaaaatctctaagtgcaaatgcagttactagttttgccttcatatactgcaatatgaacattttgaatttacttgctctttttctcttggcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggtaaagaaatggaggcgttttagtaaaccgggtattggtggccatcctttgggcactgtctcctttgcctgtgactctgtggcattcctcagtgcaggataactacagccttgaaacgatggctgtgaagtttcatttttatttcaaactctgtccattgctcttgtataagatcggacataagttcccaaaagaggaaaaattcattgtaagacagagagcatgtacaaaataagacagtgggaggagaggaaggaaccagagacagggcattctgagagctggaaggggctggagaaccacagcctgacctggcttggcctgggcagattgattgggtcccacgtgtggaagggaccctggcgagtgtactgtccagggcaggtgcaggtaggcctgcccctgtctgtccaggcccccactcttggtcaggcccaggtcagcagaacaccgaggaccttgtggacagcccttcgttatgtttgggctgctctgtctactgtcaacaccatcaacttgaacttctgcaccatgctgagcttgaactctcagaggggcaggagcctggcagctaaaagccctgctgttccactccctcacagtgggacttctaagcctttgtgtccccatccggaatgtggagattgtggcttctacatcctggtggtccctacctcgtaggtgtttgcagaggtcctggcacttgtgaaggccttccttacagagtggcctccattctgagagcatggcttcaaggactcgggagagaattacggacagaccatgtgcggagctctcctcctcctcctctcccaatggcccctcttcctcctcttccctctacccacccctacccccctgccttcctttctgtctccgccctgctttaggaagccaaggagcggccagtcctctcggggctctgtctgccaccctggatttggggactgtgattccctatactgaaaactcacttcaggctgggcacagtggctcacacctataatcccagcactttgggaggtcgaggtgggaggatcacttgctcagaagttcaagaccagcctgggcaacatggtgaaaccccatctttacgaaaaatacaaaaacttagctgggcgtggtggcccgcatctgtggtcctggctatttgggggcgctgaggcaggagaattgcttgagtctcgggggttgaggttgcagtgagctgagattgcaccttaccaagtaccacttggtactaaagtgtcttctacactttagcctgggcaacatagtgagaccttgtctcaaaaaaaaaaaaaactaatttaaaagttgaatgctgggcacggtggctcatgcctataatcccagcactttgggaggtcaaggcaggcagatcacctgaggtcaggagttcgagaccagcctggccaacatggtgaaaccctgtctatactaaaattcaaaaattagccaggcgtggtggcgcacgcctataatcccagctactcaagaggccgaggcaggagaatcacttgaacctgggaggcggaggttgcaatgagctgagattgtgccactgcactccagtgtgggcaacagagtgagactctgtctcaaaaataaaaagttaacaaaagtttctattatgaaacatttcaggcatacatgaacatagagtgatgtgttgaacctgatgtacccatcattgcactttatcttcaacatttccccagtaaccttaagacacctgacccccacatgactcccaaagagcctgtctggccgctctacagggaattagctcttcagatgcaggcactgaataagaaagccttctctccttccaactccaagagtctgatttaataaacgccttctcaatggggattttacacagtatacaaacttgagcagtgttagaatgttctagaagccagcatctctctcctgctccaggagaccatcctaaataagagaagggttttaaaattctcctgtgccactaacaattctcacctttttcctctttctggtggaagggaattttccttgatattcctgagcaccagagatattgcaagcattcccatggaatttgcagttattctcctgcaacctgacttctttgtctgttcccttgtggttttcacaggaatgtgagctatgctaaaggaacacctagatttggctcagtctggagagaactggttttgagaatcagtgaaggctgcaaaagtgtaatttggaaattatttcagttcggaggtgagccctgtcttatctttggacagtagttagtaactggcgcaccaggagttgtggagtggctgggcctgggctttcatcttggcccagcctcttgttagcagcccttcaagtgactggagctttacggagaacatgctgcaacctggctttgctcagcctgccgccagtgtgggcaaacctcttcgctggcagggcccggggcacggcgctaggtctcaccacccctctccccagccaacggctttctcccagcctcccaagacagcctctcacccggccaggcaggcaccccggcgaatctgatccctggcctagctcagctcacaacacgggtgtctccgagccccacagcagccatttccccgtgtttaccctcctcggtcctctgaccacccccttcaccctcagctgatgaccacctcccgcttcgcagtggaactaatagcgtctccagctctccagccccgatcctcccttcccttcccttcccggcttcccaagagcctcaggctctccaagtgcccacttttcctgggcttcgagtgtcttgaaaggaattccttccagacttccagcttcctctagctcggagttcctccacatctgtggctcctgatgtcagggctggacgccgcactggacactgcagggtgttgagcagcatccctggcctccacccacgtggtcccagtagtgacatcccagtggtgaaacccaaaaatgtcctgacattgccgcatgtcccctgggaggcagagtctcccctagcgagagccactgctgtgtgtgttggcctcccacccacatactgtcctgttccctgtctccacctccttccagaagcatcctctcccattggctttcaggagcacctcctcctcccacctgtctaactgcccctgaggccatgccccatctgtctttagcgcctttccccagcctttgactcagccggttatgccagagggttatgctcagagggttatgtcattctcctcttcttccaaagctgacactcacggtgggcagagtcacctcatggctcccagctgccctctgtctgccacctcctttttgaccagaaggctgtcctgagctccagaagccctcggccccttaaattcagtatattcctaactgacctgactctccctaaagccagccactcgtttccagttgtccccaccttagccgatggcaccaccatccacttggtagctctgctcagaaatctaggcgtgtccttggctctcatcctcctgggtgttgcttcagtccatccctttcccctctctcctcagccaccattctagcccaggacaccactgctggtggcctgcactgtcgttttggcctcttaactggcctcctatgctccctgaagaccactgtcctcactgcagcagaggggcctgtttgacagcccgcatgtgaccctgtcactcccctcctcaaaccgttcaggtcctggtcgtgtttgcttaaggaggcctcccttggcccaagtgtcagatgctccgctgtgggttcctatggcacctgggccgacctgcactgtggggtttccacctggcactgagctggagctttctggtccagcacatgagtatctctcctggagggaggagctttgttaatctccgtagccctagacatagccagtcggtgtttgcagagtgaaggaaggaatgaatgaatgagtggtgctggggatgggggagagtgcagatcatcattcagcaaatactggttgagtgccagccatgggctgggcactggtggcgggaggaaggaggggcgtgatgatggctgggaggaagggactgccccatgtgctgctctcaagactcggaatgtttctggctggcctggccctggtccctatgttggggatatggcgttggttggttgttggctgttccacccacaaacaccagctaaggaggccactgcagcgcccggcggtcctgcccgctgccttcctgggcagccctgccccagtgtctggtctctccacagtggccccatatgtccctcgggggatcagaaggagtcagccctctaccctcatggatgacctgtcatgccggagccaccaggctgcagccccattcacggcttctgtcttgctgtatatctctggtcgggttaaagcccacaccgctgcccaaggctttaaccacatcccggaggagggggtgtcccaagagggtagggacacccctgggcgcctgccccctctccccacttgctgcaccctcccccccccccggcaccccccggtcaggctctactcttgggcgcttgtgattctctgaacactgttccctctgcaggaatgtccttccggactttcccagcctgatggcttttttcttaatatgagtcatgtttgctcctcacagaaaaaaaaacttaagcatgagccaagcagaaacaaacaaacaaaaaatcacccacaatcataccgctgttagcttttgggcacatgtccctccaaatgattttctttacgtattcatggccataagcagccacgtacttctacagaatgggctcttctctcaggctgtggataaacttcccttcctgtatctggacatttttccacttcgctgaacatctcgcgatcccatcatcatcggtcgcatagtattctgcttcccatttgttgatatttgaaagccctgctgacataaatgtcctggcacaaatctttgctcactggttatttccatagaaagtcttcctgccggtgaagcggcagatgggagagcgcaccttttaaaggctcttggtccctgtcgctaactcgctctctaggggacgcttagttcacccttccttctgtccagccctgctatccgctagccttggcaggatttctcacctttgccaccctgtgagggacgagcgacatccgatcagggtgattcctatttcgagtgaagttcatcactgtttctatttagtggttgtttgtactacttttgtaaaatacccttcttgtccttcgcctgtttcttttcttttgcagacctttgctgtttcttatttattgctgaattaattcagtctccacctccagtctctgtctctcagtgaggtcttcccttgagcctttaaagagagaactcacgggacctgccctcacggtgcagaggagggcttcacccacagggcactcgccccctcagccctgcaccccgtgtcaggtcagggcgcttccagctgcaagaagcatggagggatggaagcattgtgtctggcagcataagacaaggaagcagctctccagtcttaaccctcatccaaagagagggagaaatgtgtttggaagttcgagagcactggccagtgtttgcccagtgtgggcggtgtatgggtgcccagtaaggcaaccatggtgctccccgcagaggcagctttgtcttctccaggcagcagctttcagggtacagtccctgggccagcagcagcatcaggatacttggggaaatgtgactctcagaccctgccttgtggccagaaagggtgaggaggctcttcctccagttgagggaagtgagagccgggcatgcactggcctctgggacagccctgcatttcactcccgggttctgcatcctgcattcctccctgccagtctccttcctgcttccccgtatctcccacccacaccctctccatcccatctcccatcccaggggccccgtttgccccccgagcactgacaccaggcaggcccaccacggcctgtgcaggagccaggcccctctgagcttggctccctgtcctcctgctccctcgcaaaccctcaggcctcctgtctcagggctgatctcccatctccaggcaggggctttggcaagctctgccactggtgggcaggaggagcatctgtaaggagtttggggatgtggattcccacacctgcctgacatcctgggtcccgggatggggtaggggtatctagggagccaagttgttgccttgaactccagatgcccctggtgcaggtggcttgtggaccctgcctggagaaacagtaacttgggggcccgtttgcacttctcctctggaggcctcctctcctctgcataaccatgggaagccccatgcccctcatgcactggaatcactagggagctttaaaaaccactgaggaggctgggcgcggtggcgcacgcctataatcccagcactttgggaggccaaggtgggaggatcgcttgagctcaggagtttgagaccaacctgggcaacatggcgaaaccccatctctacaaaaaattaaaaaattagctgggcatggtggcgtgcccctctagtcccagctacttggggggctgaggtgggagcatcgcctgagcctaggaggcagaggttgcagtgagccgagtcttggcaacagactgagaccctgacttaaaaccactgaggccaactggcaacccccccacctcctccttttctgacttcattggttgggggtgtcgcctgggcagtcagtggtggcttagaaagctgtccagatttgtttctattggaggcaaaggtggaggtgggtggtcaggtgctggacaaagcccttccagtgatggcctcacccagcgggtggaaaccagggcaccttcatccctcacctgcctgccttcctgctgcctccaggcacctaccacagagaggagagcagattctggggatgaagccaggccttgactcacaaggctcagcctgtagggagatcaggggcctgcccccactacctgtcctctgggtggggcattcctctactgccctggcctgtgcacatagcctgcatctcccatctggattagatcaccagcccgctggctccacactggctctgccctgctgccagtggccacttcctaggcccttgccacacgggccacctctactttctgggaatacactggcattgtctctgcctcggagacttggcacctgctcttctgtctggaatgctcacgtcagccacgcagaggtttaaaatatctcctctgcgacgggccctcctgacccctgtcttaatgcttgtcagtttctcaccaccatgttgtctgacttgcccccagggatgtgacggctttcatgatggcagcgaccgtcctctgtcatgcatcactaactcccagccaagcacagggcctgacacatagtaggtgctcagttaatgcgtcagctccttgaggacagagaagagcttgaccatggaaggtgacgggcagcccaggggtgtgcgactccctcggtgatgttggcaggtgtgggcatgtgtggtgaggaagagcatgtggcagagacaagggccaaaggtgggtcctcagggcccatgggtctccatggaatggacagggagtgaggagcctgaggagggacagccagggagacggaaacctggtgtggtttccacatcctggaggaggggtgtcccaagagggtaggccctaccctgagctgccgaaagctcaggggacacatcctgaaacggtccccagggcagtgaccatcctaggggaccagtcaggatcacccagcacctgggagatgaggaagcagggacttggtccaagcagggaccatgtttctgtgttgagaggaaccggctgtggctgaggacacaggaacgggcattggtgctcgagtccctatcagtgtgtgactttctcaagcagcacttaggctgcctgaggcgccgcagccaaggaggcaggtggtccaggcttgtttatggagcagaaagatggggcccggatgcagaaggcgctgagcacttcgagagcaggtgttcaggagtgaaaaaaacccagccaggctggcgtcgtggtcaagaatccatatcacaggaatccctgaccccagaggctgtcccctctggtcctgcccttgccatcccgagtccctcccgtggtgtccagtgagtgggtattcgcttgtacgtgtgctgagtgtgtcacaaagggggtgcagggacacctgccagtttcacactgccatctggagcacttgcagaggccctggcagtcctgacctggctgcactgctccgttgcttgttctccaagctgcgatcccaattcgctccacacgggcctggtcctacggtcttggtgctctgggttctcactttgtccagggccccagagctgagtctcttagccctgaggagttttattagaaatacgagtctagaggatctgattttggttttgttctttaggaaagagagcgccccatgcagaactaactgcacgtcatttctatagctgctacgtcagggccatgccttaagtgtgggctgggcgtcctgacttccttccgcggagggcagtgtggaaaggggtgggagtcactttacagccaagaaacctggcaaactgactgcctcggcccagtgatcacggtcagcaccagcagccataagtcacgttgacggcctgtgcccttgacatcgtgtgacgagaagggcgctccagctgtgacagactccagcaaacccaatcgagagtctacgggatgtccgaccagtcctcaaaaccgtcacagtcacgagaaacaagaaactgtcatagtcgagaggagcctgaggggatgtgactgctaaatgtcacgtgggatcctggatgaggtcctggggcaggaaagaacatgagggaaagactaaggaagcggctggggcgtggactagaggtaatgggaacattcatcgtcaccagcatttcatactcacttgcggtggtacccataggggaaactgggagggggccatatgggaacttggtattatccttgtaatttttctgtaaacctaaaactgttctgaaaaataaaattcattttaaaaagaaagtggcaaacctgggttaggctctctgctggatttgtaatcttgctgtcggtgagatggatctggatgtccctggcccagctgccaggaggatctctgcctcagtggggctccaggccacctcctgttcggtgacctgctcgttgtcgcactctgccggctgggggaatggagcagtgctgggtgaggctcaggcccacagcagatgttcagcagccttgcaagtgcatggataagctgcgggagacggggattgcgctcttccctgtgcctcctcacttcccctttagtgagagcatttggccaaatgtcctgtgaagctccttctgaaccctgaccccagaggctgtcccctctggtcctgcccttgccctcccgagtccctcccatggtatccagtgagtgggtgttcacttgtacctgtgctgagtgtttcacaaagggggtacagggacatctgcctgtgaacctggttctcccccactgtctggcagggctggggattctcagcccctggcctctccctggactcttctgccccacagcggggtcgggctggtctcaggcttggaaaggtaaatggaactggtggtgggtggtgccagcaggccctcctgctctggacaaggaagtggcagagaaacagcagtgacacaaactggggtcccaccagcctccactgccgtggccttcctcatcctcaccacccaggccccacagagcggccggcacccacgggactggtctttcagaaagatgctgtccgtagcacagtattttttaaaaatactcctttgtaaataacttttggggttattttaattacaaaagtaaaacctcttggccaggctcagtggctcacatctgtaatcccaacactttgggaggtcgaggtggggccgaggtgggaggattgcttgagcccagaagttttagaccagcctgggtgacatagtgagaccccatctctaaaaataattttaacaattagcttgggcctgctggagcgggcctgtagtcccagatactctggaggctgaggtgggaggctgtcttgagcccaagaatttgaggtggcggtgagctgtgatcacagcgctggactccaccctgggtgacagagcaagatcctatctctttaaaaaaaaaaaaaaaaaggaacctgtgttcattgcagaaaatgtacgtgtttgccaaagaaaataaagtttgctagcacctgtaatcccatttcccaaaggccaggcagatatagtgcttcccgacctccctgtccctcactcgcagacggttggcttaccaatgtcttcatgttctcttgcacaggacacagcttgggctatggctttgtgaactacgtgaccgcgaaggatgcagagagagcgatcaacacgctgaacggcttgaggctccagtcaaaaaccattaaggtaaagggatctgatcaccaccgcatccattcctgccctgggcacaggtctgtgctgagccccgcccagcctcacagtcactctccaagggactatgagcacagccgctcctcgggggctcccatcagataccctggtcaggtgtatctgacccaggccttacatgagtgtctcaggacccactccccgcccagggtgcccccaggttgcgtcagctcccaggcctcccctgtcgtctctcctgcctggctctctgtgttcccatccctggacagctccatccacccccagcctgcccagtgctccctctgcgctccttggggccagttgtaacccttccctcacccagcacctcactcagcacctactgtgtgccccacagtgaccaaaacagacaaattcagtgcccccgtgggtcgggggtgcagacagtaaacaagacagaggatagccatgtgtgaccggcagttgccgtgtgtggaggcttcacagcggcaggtgacttgaggaagccaactgtgcagcagcccaggggcagcacctccagcagggccatagtggcttcctgggatgagttgcaggtcctccaggtcacacagatggatttcctctgtcctcatcatctgacccgcgctctcgtgcactggggctgtcaaccccgagccccacttacccccgtccccacgtgtctgccttctggctcctgggttcgtgggcagctcctgccacctgtatcaagcctcgtgtctttccgacctttgctccctggtctcctgtcagtcctgggtactgctgagccttccctgagcctcccgtgccccaggcaggcccctgcaactgggcttcctgcagcagccactgcacccacccgccctcagtgcccgccttcacaagatacccacagacgtaagggcttcccggccagaatcccctctcttgctccaaggccatttggaatgaggtggtcctgtgtgagcctttagatctgctagattcccctgccccagagaaaggtgctccctgagtcacatcaggcaccctgaagggtccctcttggacctgccaattattagggcctcctggggagctgtaacatatagattccatggtcacaggggggcctcctgagtcactgcagggtgggcctgggagcctggatttttgcctgcccaccaagaggggttctgtgacctgacagtgacagcaccttcagccaacagctggcctctgtccctgccttcagactgccccatgatcttggttactcagtggccaaaccctggctcagcagcagctctcccagacctgccccatgccgcatggacgtggtgtgcagtgggctccctgagggcaggcgcgccactcctgcctcctcgtgtccagtgcaggtcctcagaggcaccttccccggtgggggctggtgagggcagccaagcgccatgggattccacctgagcaggggcagcccttcctcgcctccagccccaggtggcttatccttggccctggactccccatctaggaattctctcccctatttagaaaatgtgtgaaggttcttgtttctgaggcagccaggctgaggtgtggagcagaacgcttgattattcctgcacagctgttccgtttactcagatgcaggagccgggtgcccagtgtgtaaacaggactgtcttgcctctctaggattgatgttggtgggaaaggctggagtggctgcctgagtttggagccagagcctcacgggaccccaggggcccaggcctgggcaggtgtccctccctgtcatcccggccatgcatgcagaagcctgcctcaccttcggcggccctgccctctgccggcagagtctgcttctcagtggcttcacaccactgtcctagttctgcagaaacaggccagcctcatggggacgtgacagccctaagtaatttctccccaggtctccccgaggctccctgggcctggctcctctagcagttcccccggcgcagccctggggtcctctgtgctccaagtgtgttcattccgcaaacctttactgagcccctggccagtgtggtgctgggccagatacgttgatactgagggacttcggatcccctgccatccccagtttaaaggtgactgatctgtgcagtgtgataagggcctggatggagttgtgcgttcaactgatcctggattttattgcatcttggtctgatgccacctggtgtcctgcagttctattctgacaccagtcacccagagttagcacagccccagcacatttaaggccacggtccccaacaagaccgccctcacctcagatgccagtcaccctttgggggaccccaggcccctgcacttttgaccagctggctacaaattcagggttcccgccaccccttcagggtgcatgactcactagaatgactcctggaactcacacttctgatgacagtttgtttataaaggttgcaactcagggcctgccaaatgaagagccacacagggagggtcccaagcacagagctcacatgtctgcacctggtgggatcaggtgcctagtcctccctgcatgtgacctgtgcacctgccaggaggctccgtggagctttggtgtctgccgtgtttactgggctcattacgaatgcatgaccgattgactctttggccatgtgatcgaactccatccccagcacccctttcccctcccccaccctggaggtcaggccggtatcgcccagctcacagccccagccgtctagtcacatgcttggtctttctggtgtcggagcccatcctgagccatcacttagcacaaactcaagtgggatccaaggccttatggtaacaaagacagaaattccaggagttttacaagcttcctcctaggaatctgggacagagaccagacaaatcctttatgacaatacgggctagggccaagccctctgccaggtgctgggggtcactggcccatggtccatcctcggggagcccagttgtgcccaccattctctgtaaggtggtcccagggtgggcttaggagcctataatagtggccagtgccagaggaggctccctcaagaaagccagagttgagatctggaggaggagagggagttagccagaccagggtggagatgagggtattctgagcagcaggacctgcaggggcacaaggcaagggccgcatcctagaggagacccagtggccaggcacatcatgggaactgcaggctggccccaagcctctgccccgctcctcccttgcaggcagggcctcctggagccttgtgctcatcctgggctctgaggccccagccctgcacagagagcgcagacgtgccttgccttcaccccgtccgctctgtcctctttggtcctgatgtcattcccttggtggcagagtggagaaggaggagtcctgtctcctcatccctatctatctttttcccatagtagcagcccaggcagccacagtgggagtggtcctgcatggaggcgacaggctgagcatgtcccagatgcagctcagtgtccctgctgggatgctgcacagtctctgtgtgcagctcttcatcactgctgggtccctgtgtgccacacacagccagtgcttatcaaaggctgacggggccagaccttccatcctgtatctcacgtgccctctccacagccccataaaaaatggtccccagattcgggttgaagaagctgatgtttcgagtagtgaaacagctctgccaaggtcacggagggatggaggggcaaagccagggtgtgaaaccgggtgctgtatgtggctacaggcacttaacattgtcacctggaggcttccccagcacattgtgagatccaagcctcaggaaccagaacagcagaactcctgtcacccacagaagccggcgccggggactgcagtgcagataggcaggcgttcttcacagcagtggctactgcgcactccactcacgcagcagcggtccccagatgcctgccgttcacctgaggctgctctgagtgctttggatatggcaggagacacacaagtctggccctcacagagtctgtttgcaaagttaaaagttaaataagtaaaatagatgccaggcagggtggtgcatgcctgtaatccagggcatttgggaggctggggcaggaggatcacttgagcccaggagttcaagtctaacctgagcaacatagcaagaccctgtctctacaaaaaaaactaaaaaaaaaaaaaaaaaatgtagcgtgtcaggtcatgatcaacgcagtcaagaactaaatagggacaggaggaactgggcgttgatgccagtggagggatctgtggcaagctgagtggtcaggagtttgctcagctgccatgacaaagccccacaggccaggttgcttcaacagaagaagggtatcaactcacagttctggaggctggaagcccgagaccaaggtgtcagcagggttggtttctcttgaaggcactgggaagggatctgtcacaggcctctctcacagcttctggtggaggctggtggtctctggcactgcttggtttagagaagcatcaccccagtgtctgcctccatcttcacacagacttctccctgtgagagtgcctgtatccacatttcccgcctttctaaattgaatttatgttttcaaaaaaaatactttttttttttttgagatggagtcttgctctgtcactcaggctggagtgcagtggcgcgatctcggctcactgcaagctccgcctcctgggttcacgccattctcctgcctcagcctcccgagtagctgggactacaggcgcctgccaccatgcctggctaattttttgtatttttagtagagatggggtttcaccatgttagccaggatggtctcgatctcctgacctcgtgatccacccgcctcggcctcccaaagtgctgggattataggcatgagccactgcgcccagccaaaaaaaaatactttttttttttttttaaagacaggacctcactcagtcacccaggctggactgcagtggtgtgatcacggctcactgcagcctcaaactcctgagctcaggtgatcctcctacctcagcctcccgagtagctgggaatagaggtatgccccaccacgaccagctaattttttttgtagagatggggtcttgccatgttgcccaggctgaactcttgggttcaagcgatcctcccactcagcctccaaaacagtgggattactggcctgcgccaccacacctggcctaaatttccctcttttataaggacatcagtcacatttgattagagatcaccctataccagtgtgacctcgtcttaactgattacatccgcaatgactgtatccaaatcaggtcacgttttgaggtcccaaggggttaggacttcggcatatgaatttggattgtggggtggggggaacacgattgaacccctcactggatgaattcttgagaatgggcagccagaaaaagacctgattgaggccaaagagcaagcgatgttgggagcttaggaaagagggttctggccgaggggccggggagccccaggtcagtgcacgcctgctgtgcgccagctgttctgattctagcctgactgaacatgacagtgtccagagagaagaggaaagcagagttcccatggtccttggagacacctgtccttgggaggcatcagagctttccccagcatttggctctagggcacttctcctctggggcttcatccagggacggcagtaggtccagtcagtgccagcctcagctccgctccactggcgccagggtcatggtttggcaggcccccaaatactgccccagtccagacaggtctgcagggagccagggcaagcccggacactaggggaggctgggggccaaggcagcctctttttctctggggacagcactggcagcccctgacccacatcatggggtgagcaagtgtccccagagctcctgtccacaggctgatggaggtgccccgggcctgggagcagcacggcttccccagagacctcatgggctccgtagtgacatgctccctcgattcccaccgctaccaggcagagctggcctccagccccacactcctctcctcgtggggctgtcctgttcccctgctgggccgcccactgccctatgagcaggggcaatgtctgttgttccttctctggaacatgataggagcttctcagaggatgctgtgtgtgtgttctcagcacgcagattctgcccagtgactcctgagtggcggcttctccctgcgttctggtctcagttaccttggctcatcagttctgtgcccctcactcaaagggaatgaacttcctttcgcacaggttcaagtccccacccttctcgggaacacatctcctgctccctcctccatatcccagcctcctgacgaggctgtgagtcctgccaggctgccccttcacaggcagaggggttccactgtggtccttttcttccttctgggcccatggggtctgcacggccgtcagcgccaacctgagaaagcaccgaagaccttgtcttgcattggcctccgggctcccctcaccaccctctccacacgaatgatgaatgtaccattttgtcaaagcacccagaaggttctcttcagttttctttgattttgcaaaatataaatccaaaaggcattgagtcgtttaatattgaacacttgagtggatttgagtacaaactcggggtcctcccagaactcacagcccctgtcagggcttctgtggcgagcttgctctttggcaggggagtctcctgtgttcccagtagctcccagcttgcttgcccgctgcagcacgggctgctttcaggcaccaggacctctctggcaccggctcactgtccagcacatcagagaggtagccacacacaagctgcgggccctcagttgctgggctttgtgacataggagtcacgcctgcctccttgaggatggtgagcacccagtgaggaagcactgccaggcatcctggctcacggcccatccctcagtgagcttgccaccatgcggctgcaggcggtgagcgtcagtgatgataatcgttccctgcatgatttctaacacacagtgttggcttttcctaacccagcattcaacaccctcctcaatgctttggccacgtgcctgtactaatctcggaaagtggttgtgttcccaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtaccagaggggccccagacgcgtggggagggtgttctctaggtgggggctgggttttctagggaaggcagatcaccgtttgattttaaatgtcattagttattccgcaaacgaggacagcaccaaaatgagaagacgttggctttggtttgaggaggctgaggaggtaagatggcattaaaagaagctggggatatctgggcgtggtggctcacgcctgtaatcccagcactttgggaggccaaggtgggtggatcacgaggtcaggagatggagaccagcctgaccaacatggtgaaaccctgtctctactaaaaatacaaaaaattagctgggcatggtggcgggcgcctgtagtcccagctactcgggaggctgagacaggagaatggcatgaacccgggaagcggaggttgcagtgagccgaggtcttgccactgcactccagcgtgggtgacagagcgagactccgtcttaaaaaaaaaaaaaaaaaaagctggggattaggccagcatttcatgtacagtgaaaacgccaagagattctagcaccttccctcaggcacccaaatgtgctggccttgcccatgaatggggtgaaaaggacactgcaggccgggtgtggtggctcacgcctgtaatcccagcactttgggaggccgaggtggacggatcacctgaggtcaggagtttgagaccagcctggccaacatggtgaagccccatctctactaaaaatacaaaaattagccaggtgtggtggcaggcgcctgtaatcccagctactcgggaggctgaggcaggagaatcgcctggaccccaggaggcggagattgcagcaagccgagattgcgccactgaactccagcctgggcagcagagcgggatttcatctcaaaaaaaaaaaaaaaaaaaaaaaaaaaaaaaggatactgcagccaggtgcggtggcgcgggcatgtcatcacagctgctcaggagactgaggtgggaggattgcttgagcccaggagttcacagctgtggtgagccgtgatcgcgccactacacttcagcctgggcaacagagcaagaccctgtttcttaaaaaaaaagaaaaagaaaaaaaaaggctgctgcacatttgtccactgtggctttcgttgcaggcatttggggtgcagtagtctgatggcccaaatccccagaattcggatgcccctctctggggagcacatctaaagtgcacagagcacatggcagcgaattcctctaatgggcaggcaatcctggccactttgctggccctcccagtccgtcttggcactggatgtgggctctgggctttgtgtgatgccgtcaggcagagatgagcaggggacatgtgcacgcccacggctgtgctccggccctactgcctggcccgcctgccgcactaggctaggaactagtgccccaccacatcctttgccaagccctgcacgtggccccgcctgggggacagggagctcgggccaccctgaggggatttaggatcgctcagctctgtttggggcaggagcaggagtctgctaactaaccagcagggaagaatccactccctgagcctagtgaggcccatgcgttgtatgggtggttttcatattcttcccacacagactgtgtgtgccgcaccttggctgtgatgttgaaataacaccgagtagttgggccacagaaagtcatgctctgaggtgacctctttttgagagaacagcagcactcccccagcagcccagagcctcgcctttcatgtgcacacaggtggggccttcctggcctgcaggctagaggggcatgcacattgtcctgcgtcccctgagctgcgtgctttggggtgggcggccttatcagtctctcttcctcctcctttccggctgtaggaaccccacctggcatgcactggccctgccgctgccggccttcgttcccgctggggcccgaggaggggaagggcccctttgcacttcatgggggccctgggagcttcctgtagcctagcacagactcgcgccctggcaccgggcagtgccgaaggacagggctcactcgcacggccgccgccattctgcctttgctctggggagagggtcgggggatgccagttactcggtgtaaactcccctggtctgcaccagaagagtctcctgtggtccctgaagtcctctcacttaagtgccagctgagcgaatgatcctgtcagtgggccagtgtgtgggtttattgccccccattctgcactggggcatctgagctggctgtgcagggcccagggccgggggaaccaacctcactggcccacagtccactcccctcctcctctagaccccacatgcactgctctgcctcggcctgtctgtgtccagtatggccctgatgagggaagcctgtgctccacttggagcccccaatgcctgagaacatgcctccagccacccaactctcttggggccttccctagtctctcaggcacacacgggccacaggcagggggaactcacctctgcacacagctgctgggggcattgcttcctttccctctgcaagatagtgtctcccagggtgttgggggcaccttagtattgcgcccccagggtcggctgtgaacctcaaggtggcctaaggaacctttgtcatctttgcagagcagtgagggaggcagagagaagggagccaggagggtctcccggctctgcttcccaccccaggatgcagaattggtgggaaggtgaggctcccatcccagggctgtagctccctctgctggagacagagtgtgtgtggcaggccagcctgtgtggagtttgccttcctgtgacgggctttttagtgttaaatagatgaggatggccgggcgcggtggctcacgcctgtaatcctaatactttgggaggccaaggtgggaggattgcttgagcccaggagttcagaacagcctggccaacatagcgagacccccaactctttttttaaaaaaagagaaaaaaaatcccaccctgagctgacagagcttaattttttgtattccttcgcttctatatccaccttaattgtgaactttatagtgtattcatctggagattatgccgtttcttggactctgctgttaaattctaaaaaacacaagggggccgggggccgtggctcacgcctgtaatcccagcattttgggaggccaaggtgggtggatcacctgaggtcagcagttcgagacctgcctggccaacatggcaaaccccatctgtactaaaaataggccgggcacggtggcttatgcctgtaatcccagcactttgggaggccaaggtgggcggatcacgaggtcgagaggtcgagaccatcctggccaacatggtgaaaccccgtctccactaaaaatacaaaaacttagccaggcatggtggcaggcacctgtaatcccagctactggggaggctgaggcaggagtatcgtttgaacctgggaggcggaggttgcagtgagccgagattgcaccattgcactccagcctgggcaaaaagagcgaaactccatctctaaataaataaataaagtaaaataaaataaaaattagccaggcatggtggcaggcgcctggagtcccacctactcgggaggctgaagcaggagaatcacttgaaccggggaggtggaggttgcagtgagctgagatcgtgccattgtactccagcctgggcgacagagcgagactccatcttaaaaaaaaaattaaaaataaaaaacactaggggaagaaaaaaacaaaaaatgcagagccatcttcagaaagtatacatccattaaataattgagtgaattgatatccccctctgctaaacagcatccctcctgccccccttactagagctttcttcctttcactcaggcagtttgcatttgaaagccactctacaaccccagacgaggaagccacacttgcacacgtgccttctctccgctgggccgcagggtctttagaaacagaatgaagccatctgcttggagccagcttccctacgagccggccagcgtcagctctcagtcgtatttgcctaaagttcgattttcatttaggtttccaagactgactaagctgtcattcgtgtcgtgagagactcaaagaaaacagcatctgtcagggttgtgttttcaggtgttccttctgagcagcagctcagaaatgagcttgagccccagaatattcctggcacgtgtgcgtagcgctaggtctgaccttactaaagctgctgtctctgtgctcacggggggcctgcagtgtcgcgattgtgggggcagctggcgggaccctctgggaagtggtggagtaaggtgccgtgtgaggcgtggagacaggacatggggacagttgggtgcccgctggacaggtcacccaaggccccgggctgcctggctttggtcgttgtttgttaccatgcaccagaggcctttgcctggagaagaaacctgacttaagacaccctttgactggaagtctttctttttccttaagaggtgagatcttactgtgttgtccaggctggtcttgaactcctggcctcaggcgattctcttgcctcagcctctggagtagttgagaccacaggcatgagccttggcctggcttgactaaaagtcttgagaaccagggtgtttgggttgggctgtctgtgacggcctctcccactgggacacacccgtgactcccgcctagtgatgtcactctcagactggcctctcagctgtcacctctcccacccctgggccttcccctgactccatcatgtccttgcccccagagaaggagctagtgcgctgctcagtgtgccctcatccccatccccctcatccagtttccagcccgcttcccaggttcctcaagggacgggctactcatgtttccctcccgggcctagtgtatggacaggcaggggtgcaggacagccatgctctccttccacccgccttgctcagcatctcacacccatgcccagctgaccaatgtcccccatagcaggacgggcctcaggtctcacactgctccgtccagggattgggtttagccgggaacccgggactggcccttgggtggctcagttgaggtggcaagagaagatgccctctgggcttggctgctggggccctggcccttcccatacagggaccccaggcctgcctggcgagcctgtggataggttcagctctgctgtatgagcctgggcagtgttctggcctcatttgattctgatggcaatttggggcccacgggaggggtgtaggaccttagagtggagtatcccaagacaggagtgaggtgacagcagcagcatggagctggcagggggtggccacaggaccctactccctcctggcatgaaggagaaggcatgcaggctgagctgggcacctttgcagcaggctcggccacgaggcctgctgtcacagcgggcccagagacagcagccaggagagtggcccctgagcccagggaggatctctcagacgcagtccccactccaaccctgttacccaccaaccacacaccacacccacgcacccactctgtggcggacacctggcagctaaatagtgacggtggatgtgctgtttcctaatgttgctttcttccaaataagaggcctgggtgtctattggggatgtctgtcaccaaaatatctttgggcgccaacactgtggagtcatggcttcagccgggaagaaagtctgaagctttaatcttctgttagtcattggttttctttactccatccatttgttttcacttttaggtttaatttttgtttatttccttaaccagacttctagcctggcccacagtagactgacctgacttttgcttttcagttttgaaagtcctagcgtttttccccctaactccgtttttgttgatttgttgaaaaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggtgggtcgggagggtgcgcgctcctgaaagccatacttagccccgctggcaggcgacggcacagccacagaatagaaaccacggggatgatagactgatcccgtcagagagcgcgtttcagaatcattctgcagctccacaccacaacctccatcagaaaggtgtctgtaggaaagccgtttacttccgatggggcgttgtctttcatgggaatcaaaacagtgactccaggctggacacagtgacttatccctgtaatcctagcaccttgggtggctgagagaggaagatcgattgagcccaggagttcaagaccaacctgggcaatattgcgagaccccatctctacaaaaaatacaaagctggccaggcatggcggtgcgctcctgtagttgcagcaactcaggaagctgaggtgggaggattgcttgagcccaggaggttgaggctgcagtgagttgtgatcataccactgcactccagcctgggccacagggccagaacctgtctttttttgtttttattaaaaaaaaaaaaaagacagcaccagtccccaccagttgctgtgagcgtgagcacttagagcttcagcacgcagttcctagtaacagcagaacggagccgcgagctttaaagatggtttcatgcccagtgtgggggagcacacacctgtaatctcagctctcaggaggccgagttaggaggattacttgaagccccgagtttgagcagcctgggcaacaaagtgagacccctgttcctacaaaaagtaatgaaaaaaactgggcatggtgatgctggcctttagtcccagctactcaggaggccatggtgggaggatcgcttgaacccaggaggtggaggctgcagtgaactatgattgcaccactgcactgcagcctgggtgatagagtgagaccctttctctaaaaaataaatgaataatgaacgtctcatatctgtgggagaaaagatgctgccttaggtatactcgggtgagagtagatcttccagcattcttagacatttgatcagcagccctaaggcaaacctttttcaaacacctgcctcgtggagtcatttgtattggtgaatgttgtatgtatgcattctgtttataagccctgtcctagaggggaggagttttcccggattccttagtctttccatcctgaaaatggttctggctgccaggatgaagtgggatagaggcgatgagagtcagggccttggactccaggatgtggtgtgctgtcgcctcagaaacagcagaggtctcagtgtcagggctgttttgtttttgtcaaaacctcaaggagtggcatcgagggcttatctcaggtatgacaaggatagatttcccttttttttttaatttttaatgtttttattttttgttgagatggggtctcactgtgttgcccaggctggtcttaaactcctagcctcaagtgatcctcctacctcagcctcccaacgtactgggattataggcgtgagcccggccccatcgttgttttaacagtgaagctgggtgggcgctgcccagtgccacacatgctgctgtgagaggtgttattctcatggctgagttacccagcattctcagcctggctcaaattccaaagctggcctgccttccttgaggtttctggcttgaagacaaggctggggaagcttctctggacggaatggagctgaattttaaaatccagctctagaaatcccatcatacagtcggtcctgctcttgatggggcgggctatatgggcggtggggttgggtgaactgctccttagcctggaaggaaaacagggaaggttggaggagacatgggactctggtcccagtaatgaggacaagaaaagaaaggggaaaccggagaagtggacatttctggtcgagcaggaaaagtgagtggcagggcaaccactaagacaaagtgatggaaggaagtggggagggcgggagagtctggagggaaagattcgctcaggaggctgagagaagaggaggaagaaagacccagactgcagtgagtttgcagtcagtccctatcacgtccagaaaagcccagagataagggatggaaaagaattgggttggaggaagagaggagaagatttatgactgtcaagaccagagaaatcagcaggagaaaaactaccaacaagagtaattcctaagaaggccgggcgcattgactcacgcctgtaatcccaacgctttgggaggccaaagcaggaggatcacttgagcccaggaatttgagaccagcctggacaacatagaccctttcttcttagtctttccatcctgaaaatggttttacaaaaaatgtaaaaattagccagcatggtggcacacacctgtggtccagctgctcaggaggcaggaggatcacttgagcctaagagtttgagaccatactggacaacatagtgagaccctctctcaaaaataaagaaaatcaccgttgggctagtgagctgccccatggcagctggtgtcctctcgtgtctgtcgagagggtgaatctgtttaacagcgcttgaaggcactcgtttaccccggctggggcctgcagggctgcgcttggctgatagggccatagcctgaagcccagttttattttggagcaggtaatgcttctctgcatgcatcacgcagcttcacagatgccggcttcacaaatgtatgctactcagatattcccaaactgaccctcagacctttacttttttaatgtgagaaagttccagagggaaacatagctttaggaactgttttgtcatataccttaatccttattacagcatctgtacattttcagaaggctttattttattttagtttagtttagtttttgttttctgaggtttttgtttttttcctagagatggggtctctctgtgttgcccaggctggtctcaaactcctggcctcaagtgatcctcccaccttggcctctcaaagtcctgggattccgtgcttgagccaccatgcctggcccagaaaggcttattttttatgtaaataaaagtatcactgtggaaagagccccacgtgtgtggtcaagtttggtgagcctgccgttgctggtgtcccagggcccttccctgtcccttgagttctcagtcctcagtggtttggcccctgaccctcaggggatgttgagctctagccacagagggttggttgcctggtgcttgggaaggaattcttgtgccctacaagtggccctggcaaaggcgtgctctaaccagagaccactgggctgtcaacgcttgggggcgggtcatgataaggggaaggtgcaaaatttggaaaaaggagttcagcccctgcacgtaccccacagtacgaggagagtttcctccagggagaactgaggctgtcagaggcctgcagagcatttctaccttcaacggaggaccaggagaagcgcccatcatctaaaatgtggggaaccgcaggaacccctaaacagaaaccccgacatacacagtgggaggagtggagggcaccaaccagcccctcagagtcagctccctacagaacagggtcccgcccctccactactgtatttaattcctcccagggttttgacccatgcaggtgtctcaaccgtgagcacctcgtggctgcgcagagcgggatggggcccagcggccatggtcagcatgcgtccaggccttgccccatccccaggccgcctgcgctgaccgtggcctgacgcttgctctctgtctgccaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggccgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcatttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatttatttattgaagtgtgaaattgagcaataggcaggcaccaccgtccccagagcaggtcagcgtctcgagaggcccctggacaattgaggatgcccatcccctcccctttccctgatcttttactgaggggctgtgtgcgcgatccttgcaaattgatgatgttgccatccgtacccaggctgtgtctcataaaagtcggcctggtgccagagaggacctcctttctcccacagaatcccagatcctcaggaaaagccaaaaccgaggcccattgcccggattcgacacaaaagagggtccctgctctgttgcccgagagcagtctgcatcctgggaccagaatgctttcctggaaaaagaagcctttcaggtttccctgggccagcatcttctgatggaaggtgggagccaacacccttctgatggaaggtgggagccaacacccttctgatggaaggtgggagccaacacccttctgatggaaggtgggagccaa

SEQ ID NO: 13509 - DNA, 29171 bp, Human; identical to SEQ ID NO: 12283
  misc_feature (1)...(29171): n = A,T,C or G

SEQ ID NO: 13510 - DNA, 16378 bp, Human
actctgtctcaaaaaataataataataataaaaataaacttcttgaaagaagaaattgtcttatttcacacagtacataatcagtacgagttgatatcggtgctgaatttggcctctactgatttctgccctttcctctctatgcttctgttatctgaactcctacgtttcacagtctatttacttttgtctctagtttagatactaacccaactggtcaggaataatgtctgtacataccagtaatgaactttacaatgtgactcaaccagctacatgagtaagtttcccccttgggggagtttgtgcagtctaacacgcaacaataactggaaagaatgaatgaaatttctaagcagaaagaaatgaatggcatttctaagcagaaactacacagagacgcaatggcccagattcttccatttctccagcaaacatgaattgagtacccactgtgtgccaaattctgagctaaaagtgctcataaattttaactgaacttgtcacagctacccaggtaaacagataaaggaaaacatttagagatgtctaaacttacttggaaggttgttaatacttacagtgtaacaatgaggttaaaatttagcaaggcttgagacaaatagaaggtttgcctcccactgctaccctacaaaactaggactttgaccaaattgactggtttgctatcttgtgggcaccttgctcttctgtctctactccctaacttttcctttctctttacctggaatgtcacccacccccacctcactcccacacatatccacctctactctacatatcaaaccatacacatcctgcaagacttacgtcttcccgcctcaggactctcacaatatttcatctcactacatgtagtataattgtgtgggaatgcatcttagtttccctactaacgcaaaaaatcctagaatacaataatctcccttacatatctttgtatgcctcagaatgcatattgaaccatttaatacattttttatttacagcaggaatgcatgaattgattaattaaatgttgagagctgtagatggcttttctcaaggtgcttcaagtgcagaagcccaagtgattgacccacacacttacctttgtgttccttccagaaaatcctcagggaggtgagagacccatgttcagctgtgtatggcaccaaagtctatacatagtttctgggagtcactgtgggctgtggggaagcacgtggactctggagtcacacacaccaaggtctctagcctagctctgccacttactggttgtgtgaccccagggaacttaatttacaaatttaagctttagtttcctcatctgcaaaatggagcctcctcgcctttcttcttttgctaccgaactgggttatgagaattagatgcgtgcatgcaaagcacctggtagagtggcacacacctggcagaaggaagtaaattctagtccccgttttcacttaccctcatatacaacggggcacttttttatttgccaactatttctttgaagataataaaagagtcagaaaatgatagtttttaaaagcaccctgcagtccacatgggaaccaaccactacctctggccatgagtttaccctttgggtttccatttgtcatggccaagggcagtgagggctatgccagggaccctcagtgtgtttggccctacccaatcaccatctcaggtctaccccttgtgcattccaccttgcggggctcagtccaccactcagaaggatgcattctgcacactccttgcctgaaagaactcctgaaaggcactgaccaggctctggaaggctatattcttttcattctttataaaagttatgtgattaccaagctcaataatcaaatgtccttcatcgctaaaagattatagtggctctggttcggatgctttgggaacaagcgaggcaatacgcaatggcttggtttactcatgttacagaaactgtagcagttatttggtaatgctttcaacagtgccttcagcttgtgggaaatcccgaagatggccaaagacaactcaactgttcgttgcttccagggcctgctgatttttggaaatgtgattattggtgtaagtaatgattattttccaggaaattctgcacttcctgtaatcataattctagatgaatcaaaagtaagagtttaaaggaaaataatgctgtgattactggcttcctatatttttgcttcattttaagaaatgtgttagtaaatatgctagctagaatttaactgtatgtcaaaagatcatggttgaaaaagtagatattttcctcccaactttaaaatataagtatctaaaaggagtcatgtcaaccatagtcagtgtctaaacactctgactacgaacacacttcactatttcttttctatgtcaccttggtttgatttccatgggactctgctgttaaggttttttgggacagatgcttgcatcttgttcttctcatacagaggccagtaccagggtgtaagaataatacagaggccatactgtgtgggtctggtggcatagaagaacatttgttttggagtccagagctcttggcccagctctccctctgactccccatatgactctggccatcacctttcaaggctgagattcctcatctataaaatgtgggtgttggcaaagataagcagcaaggttcctctcagctgtcattgataaatatgaccaggaccagctcaaatattacaacccagaaatgtgggtcatgacatgggggcagggggagatcattctcataccagaaagcattgtttgagtgattcatgccccaaggacattgtggatggtctgaaattgtgtgggtctgttactaaatagacagaataacatgtgaagggatgtatgcaaccagttagtaggatggaagtagttgtttgatttcctggcaatggggagtttagattagttgcataaagcctgtgcaggaaagggagccagtcactcttaccttccccaccctccaccccctttcccaaagctgcactcctgatggagcccacctttcatttgcccccagtgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcggtaagacctcaaaattctctggagttgtctccctgagccaattgtaatggattctttcttcttcactgagcaatgctttggctttcagtgggggagcaggaagtaccagataaggggtgaggaggggaagactttccctgcagtgaaatggtccacatggaggcaaagatgccctccactattgcaagcccagaaggctccagtacagagaagccaaaggggagacacctgggggtgacctaatgagtattttccatattgtgcctctacagctggtgtctgcatacacccagtaggtacagctaggagctatataggccaaaggagagacacagtgagaattcattcattagatttttttctcttggcaataagttgtttaaaacattttgatattaattaggcattaatatattaggatataaaatataaaatatgcatacatttttaaaagaaagtataagctttcaaagatttttgagctcaaggttgatgattctgtatcatagcctatactccccacattatcatccaatctgcttttcagggaccccagaaaaccttgataagcaccactgtagagtgagccttcagctcacacctgcctgtgggggctttaactctgtacatcaaggagaggcttctgccccaaaccatagacagcaagaccatgccctgcctttgcagatgaaagcaaatttgcaggcagcagagctgagaaacctgtttcagacgtggacccctactgtctgccctaatacttagggcagcagtttcacactattatggaacacgcctcgaatcccccacccctgaaataacccttttattcaaatgctgcaggacctcagttccccctttatagaatgagtccagcaatgtaaggtgcttgttagtttactcttccttttaactaaccactgtcctggttccaatggattacagaacatttacattctctggttccttagtgtgcgtaagttccagggcaaaagtacccacttttggtgggtggggaaaggaatacaggaaaaagggagaggagacacaggtgttcctaaagacaaattcacttgcatcccagcctcactttgggccagccatgtgcatgcctgacaaccaggagaactgagctggggaggcaaaggggctaaaggaggaaacacctcactgcatacctcctttctggagcgtctttaccaggagccagcaaagctcttggcaaggagcaaggcagcagctaacacaggaaaaaaatgttctggggcctctgaaggtgctcctgctgttgactgtagccagagctttattctgggctgagtagtgagggcaacagagggtcctgctcggagagcctcccatacccaaagaggaggacagttttccctgcctaccctgctgacactgaccacagtgccccttctcccaagagtgtgtgcaagcctggggaaggcaaagctggaactcttgcaaacagtccccatcccagattcagaggtcatttgctgttcggatattttccagccagaaatagcatcactgtcatgtggaggtatcatgtgcacacgcacccatgtgcccatgctcacgcacacacaccaccactaccacacacagcaaatgccatttcactcaactgaaccaatgtactttgagtgtgggtgcgtgtgaaagaacacccacaaatgctgtgcacttggagcctgcctctcctctgatgagactggatgcttgttaggaaggaccctagatgttcaacattatccagttcatctttttctgaactccgtgattctaaattttcagcaaattgtaaagaaaatttctccaaaattccaaaattaaaggggatttatgaggccctatactgtatgtgatacactaagactctcttgccactcactgagcatgcacatgcatgtaaatgcacacatgtaaatgagcatgtaaatgctcacatgtgtgtgtgcacacatacacaccagttcattctcttgtacttgtttttcccagttaaaatagaaactcaggaaactggactgaggaaggtctgtattcaatggctatttgttctctggagaaaaggagagaattgagctgactagcaccaagcctcaatccaagccactggtcaatgagggtttgttgaataactacatgagtgattacatgattatatgataaatttgctgaaaaaacataattatttgggcaagtcgctctttgacgggtaaatgtaattcttttatctcatttatttcccttccagtatttcattctgatgtttatagtatatgcctttgaagtggcatcttgtatcacagcagcaacacaacgagactttgtgagtacaacctcaaaaagcaaaataatatgaattatcattattataacaaccaacatgtattaaccccttactatgtgcccaggcaatccaatatgcacagtaataatacatctatcattttacttaatcctcataaatctatgaaataggcattatcactctggtcatttgagaaaggaaaaaaaatgagacagaaaggtaaaatgacttgtctaaagtgacatagttggcaactgaaagagcaagaattctgaacccagatggcctgactcccagggcccaagtttgtaatcccctgtgggtttcaccactctgccatggccatgggccttccaatgggaggatctctgttctacctcagctaagacgtgctctcaattctacatctttctttctctcccattctctgttttcctagcctaagccaccctacagtatgtgttcccctggcctcatagtgatttcttttaagatgagagtctcttctctgcatggggacttatgccaacctcagccagctgtacttggtgcctctgagtacagttttgctccaggagagaatgttcagtgtccccaggaaaagacagagaaaaatattttcctctccttgaaaattagcgtgctatctctccctcttgtgttgcctcttcctactatagttcacacccaacctcttcctgaagcagatgctagagaggtaccaaaacaacagccctccaaacaatgatgaccagtggaaaaacaatggagtcaccaaaacctgggacaggctcatgctccaggtaagactgtggtttggggggtgtcatttttacttactggtgggagtgggtgtcatacacatgactcagtgggacctatattttatttcaagccatgatgattagcttacatttgttggaatgattttgtcaagaaacttaggttaatcatacactctccctctttagaactcaggtatcatttacattaaaagaaaaatattttctctaccccacagtgaactcgagtggtaattactgcctgtttcgccttttgggtacctcttcacaactcctgtgagctagtcttgccaaggaccaggccctatatcttgatttgatcacccaattttctccaactggcaatcatagtttatgtccatgtttatctccagtgccatcaaaagtccaagtcttccagaatatccatcatcacccccacattgccctctgtatgcaaattgttatcctctacataactaccaatctgacctagctttcttactggcccctgctcctactccacaccccaccaccaactttttacagtctgtcatcagcaaactcccttatagccaccactccttctatgaactctttactatctttttcttgcttcattggaaatttggctatctcctgggagtgctacctgcccttcattttcctcccatatccatgtaccataggacctggaaattggctaggtgtccttcttgctccccttggctgccatactatttgcttccttgatctacatcaccccttatccctccttgccattacttaccagcctccctaccctcagtcgttctcctgccttcattagggatttcaatatctcacttaactatctacctcttcagtcatactcctgatatcccacctagaaacttcagcagccacatggatgactcagcaacatttagtctcacaattccttgtcctaccccattccaaagattttgtctttctccccacctccaccctcttccatgaccatagtcagcatgccatcaccagtaactgtgccactaagaacattccattctctgaccattaatttctatcatttctttcatttattctaatatctcaattctaataattttattccattaggacctccaattaattgaccactttttaacttttatcacccctttcatgttttctctttcctctttgcctaacccatattcaggtccagccccatagccagtccttccctacccttctctgtgggtcactctttcctaaccaagcccaccgagtagaatatagctttttgctcactcttcgtttatactctaagagctaaacattgctgagaaaagtcacacaaccatgatcatttcaatttaaacttgtgaccacagagctcaaatgggcacacaatatttcctagtatattttcccagaaaattcacttgtcactatttcacatgttcttccttcatgcctgccacacctcttctcaccctccctctcagttgatgacccgacctcatatgtttttaagaatatagaagaaattagacaagaaccacctcatctttctaccaccaaatctacattgatatacacctgtgcactttgccttctctcttgttatgtcacacaggctgtcctttgtccagctcttttgattctgttctgcattccatctcctttgccccaacagtcttccctgctctgatctgcctcatcagtttctccctttcaacagcctacatggacaccttaaattgtctatcttataaaaagactcccttgtccaacattcacccactattctgtcctactactgttttgttttattccacagcaaatctcagaagagatgcctacacttgtggtccccattttcatccctctcatctgctttcatccaactacaattggcctctggcctcaccactcaaaaaaaacaaccctggccataattaccaattacctccatcctgccaaatccaatagccaagtctctgtcctcatcttctttgacatcttatcagcatttgtctcactgactactcccgcttagtctcctctgctgggttgtcactctttacccaaatctgaagcttggagtgctacaaagctcaattttggacccttaaatcttctctgtgcccactaaatcctagtttgaaataagcctggcttagacttaaccatttttcccagaatgcagaataattatttttcttggttagatatttcccataacatagtgacaaaattgtatatcctttaaagatggttgatttatcatcaagtttacttgaatacattcattctaaaagttccaagatacccatggttttaacttcctcccttttgaaggattttaggagaattgataacaaagaaggaaagctatatgaattgtgttttgtcctctattctcaattctatccagagtgtaagggatgtattaattggtctccctcccctatgtggagacatagctctgtgtcaccaggttatttttttcactttattttctcccattataaaaataatacctaattactctaaaaaatgtttaaatgtatagaaaagcaaaacaagaacaattactcataacttcaccactaaaatttttaattttatgattctcaatttgctttgatataatctttaattttatgattctcaatttgctctgatatatcagaataattattcctctctcacattgttatatcaatatattagtacagtatcaatcataattaacatttattaagagtttaccataagccaggcactgtattgagcacattaagtatattaactcatttaatccttaaaaaaactctatgagataggtactatattccaattttacagttaaggaaactgaggcttagacagtttaagtaacatgtcaatggctacagggttcactaatgactagtaaagtaggaagtgtaaaaattcttttacaaactgtaaaatgtaagttgtaagttatcaataccttcagctgtcatttggggatttcttagtaaatgtaagatatggtacactttccgtatcttctttctctataaaatttcagttgctacattgatggctctagtagggaccacgaaagagaattttgtatctctcatctgctgacaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcaggtgagtcctctctcctcccaagacttcccaggaggttctgctgctctttatgagaaaaatattggtcaactgtaggaaatagtctttcagtaaggaattctacattcttttccctaaacctcatgttaactatttccttctctgttaataaactgcaaatgctaaaccaggactgataggggcaaatttacattttaataaaattaacaaaacatgagaattgcaatagcagaacccaactttgtttaaatgaagacaatttgcacaatgtatggaattggtatgtcaagaaatatttacattaaacaaagttttgctctagttttgcaaaatgtaaattggaagggatgatgtgcaaaaagaatgttttgccaattccaaagcaatgactattgctgaggataaatgtagtaattacacatccacattccttattcaatggtaaagtaggacagtcttaataaacattaggttggtgatttggatggaaggtagtttacatacagatagtttttgaaaaagtttccaggctgatgaggataatgtgattacgatcatgaaaactaacatttattgtgtacttactaaatgccaaacactgtttccagtgccacacatacactatctcctttaatgctcagtagtaggtgccagtaggatccctgttttacaaacgaagaacttagacgtagagatactaataaataccttgctgaggtcacacaactagtaaatgtccgtcttttcaaaaaactctctggcttttgaaacatgagttttctgccttcaagcacagactctaagccagtgaagacttgttaatattccccaaaagccctgatgagaacctccaggtacttgtagtcagcatctgctgaccctgtacactgaaacgctgtgctctgctcagggagttacctctttaaggaaagctagttgtgtaccagctcattaaataattgagaaatgtcaggctgttttgtttgggagcagtacaaactgcatgttcagattgagggacatggcactgttgctgacagggtgcctggactagaactggatgcattattccagaaaagggcatgggagtgttctagattattttgcagcagtgtccaaagcaaccctcattgagctttactgcaacattgtctggcattgttttaatcaattatattcagactgttattaaaaattaaatttgctgcttataatcaaggtgtacaatataattattctcaggactataaaaggcttttgatatttcaacactggaactgctcatgcaaacaaatcttgattggattgtaattgtgtacaaactgtattacctctttgaaagggataaaaataggacatttgtcttcagataaccagtttatttcatagttataccttttttcctagcacatataatattttagttatgaggacaaacctgaagcttttctcaagtttagatagatgagaaattgaggaaaagatacaaatgaactattttcctctaccttgggacctccacacccattttgacaatgcttctaacacgttcccttacagttccctggcctcatctgttctaacaactccacctccactacctaccaactacaaattcatcatcactcagccctactcctccaccaaattcctgaattctgaaattcctctctctgttcctgacttcctgtgctccttgtttctcaacctcactcattctgctcctttgacataatctcttatctattagtcctttctgattctccctagcccagcctcccagattcccacacaccaccattctccctgactcataggtcttgctaagtcccctcttgccatccttttccaccaagaaaaaggtgctaccccaacacctggtatactttatttctattattgcattcactacctggaactatatttgttcccaagtctattttttctgagtctccttgaggactatgtattatttgattctacagatttgatatttttagtacttagcataatgcctggcacaaagcaagcactgacgtttgatagatgggtgaataaagaagtgaatagtgaatggtttttctttttctttttttttttttttttttgagatggagcctgtctcactctgtcgccaggctggagtgcagtggcgctatctcggctcactgcaacctccacctcccaggttcaagtgattctcctgcctcagcctcccaagtagctgggactacaggtgcacgcaaccacacccagctaatttttgtatttttagtagagatggggtttcaccatgttggccaggatggtctcgatctcttgaccttgtgatccacccacctcagcctcccaaagtgctgggattaaaggagtgagccaccgtgcccagcctggtttttgttttgttttgtttgagagacagggtctcactctgtcacccaagctggagtgccatgctgcaatcacagcttattgcagcctcaagctcctgggctcgagtgatcctcctttccacctcagcctcccaactaactacaggcatgtaccaccaggcctggctaattttattttttgtagagatgaggtctcactgtgttgcccaggcttcactttttgacaaccatattgtaggttttcaggatctacaatgcacaaatgtgctgctatagctgtgaagactaacaaaattagggaagtcactataagcttgttaatagtagaaattaactagaatttcacacagcatgtcagatgcaaatatatatatattctatgttatggtttatgtgactcagaaatgctatgtgcaaattgtgatcactatacctcaaaaatgttataataaaatgaaggaagatcaagtaaagtaccactaaattgactagcatcacgaaaaggcactaaatgatggtgaaaaaaatggggcttctgtctgtgagcttcatgaaggcaaggcccatttctgtttgccacagctaaatgcccagccagtacttggcacctggcataagtgggcccttatatatatattattagatgaacgaccacctcccaggattgttgggaggaccaaggagtagcagatatgggagtgttttgtgaaccatcaagtgtgttgcaaattatactattgtaaacattaatgttccattcattctgtaaatgtttattacgtgtctactatgtgccaagcacttgttctaggttctagaaattcaacagtgaacaacataaaatccctgccctcatggagcttgcattctagcatgggagacagaaaataaacatgttaccaaacaaatacatgataaaattccaggcccaaaaaggccaggagcagaaataaggcagggtgagtatatagagtaggatggagaaagggtctttttctctgtcactgtcaggaaaggcttgttgagatgatatttgcagaggtttgaattaagtgagaaaatgagacaccggaagattggggaggaaagttctacaagaaaggagttgtgagtgcaaaggcccttaagtgggagcaggcccagctttttgaaggagcataaaggagatcagtatgacaaagtcagaatgagtgaaggatgagtagatgacaaggatggagctagattttttgtggctggagtcccccacccccaccctcacacacaaattatagggaaggatccttcttaggaaaaacaataaaaatatgcatacaaaattaggcacagggccttgaaagggtcttgcaagtaaggggccctgaagcttaagctcattcgctttatagagaaacctcctctggtagtggaagatggggtgagaggcagagccgcatggtccatggaaccagccctggttattgcatttcctaggcattccctttggttcccagagctttggtagaggctgctcagatggcagctctagccttacatgcgtgtatcactccagaactttgcacagtgactaggatagagtgcgccatgtataaatacttactggattgtggcatgcatgaatggatgatttggtgaataaaaaaattattcctttgcatgctcactgtgacccttcaaggtctcactagaatccagtaaagatatgttgaaatataacatcaaatgagaattcagggagcataatgcaggagttcctttaatgattattaaaaatggcaacaggggacctctggttttcatggacagaagcatttttattcaaaaacaaacaaatcaaaaagtaactgcctccaaataaatcaccaacgaagcctttggggagggaaaaattctaattgaattaagatttttgaatttattgtccacatattcagtatagaaagagggttatgctaaaatagcagtactttttagtgagattaagtgataaagacacaaataaatgtgttgtggaatcattgttcaacagtattgtttatgttcccttagtaaagcactattagtagctggctgtcctcagagatgtggaaatagcctggatatgtgaaatcagaattttgagtagcattgattccaataggaacctgctttcccatcaatctcttctctgctttctggttcttctcacactaatgtggaattgcccactccttcagggctgctatgaactgatctctggtccaatgaaccgacacgcctggggggttgcctggtttggatttgccattctctgctggactgtgagtatttcccagcacatattttatctgagaggatgatcatacggagagaccttgagagtgccactggttacctcaaccacactagaaagtctagaaacaaaacctcaggcctgaaggctagtcaggaaacttctggcaccggaagaaggacagtgggttctcttgagaggcaaggagttaacttcccctaccagggaaaggctgtgccctgccaaccagctccttcttccggctgatgggcagctgcctttagagggctggagagcctctttcccttgccagagttcttagtgaactgctcctcctggtctccagatctcattaattcatttcatccacatatcaaagactgtcacctatctagatggcccctgcctgatactaatatgcccagatccttctaaagagctgcctctggcagattcatcctttcctactgcccactttatctgatgcatatgcagcaagaggttggagcggtggttctcagccctggctacacattaaaacgccatggggaaactttttttaaaaattgcttggatcccaacctctgagacttcgatttagttgacctgggggttgagccaaggcacttttatttcccccagatgatctgctgtcagggttgacaaccattgccttagagaagcagtcacaaacttttgatttcagaacccctttacactctcaaaaattattgaggactccagaaagcttttctctatgtggcctatatctattggcatttaccccattggaaattaacatagaaaaatttaaaatatttattttaaaataataagcccattaaaagttatcacaacacatttttgtggaaaaacaactattttataatagtgacttttttgcaaatctcttcaatgactagctaaatagaagacagttagattctcatatttgcaccttcattcaatctgttgtaatatgttgcctaggttgaatgatctggagaaaatgcatccttcatatagacatgtaattaaaaaaatagtgctttaataatattcacccagtagctgggaccacaggtgcacaccattgtgcctggctaatttttttatttcttgtagagacaggatcttactttgttgcctaggttggtcttgaactcctggcctcaagcaatcctcccaccctggcctcccaaaacactgggattatggccatgagcactgcacccagcccacaagtagtagcttcttaaagatcagttgcaatttggaatctgaaattctgttaatgagcttttcatactctgttatgttaaaatatattacattggtttgtcttgcactttgcatatatctttcagccatttataattctataacatcatagattgcttatttggaaaaaatattagttcattgtgttatgcagatcttccaaatgttaactgatttatgtatgcaatatccagaaaatcacatgtggcattgatattgccacatggaaaataccttaagcaatggaatgctatcaagttcacggtgacaactacaagttttccaaggttctgatttttgcttgaaagttcaaatttatcattggcaatgaatattgtcagttgttttccttgaagtgacagactcactttgtaaattttcaagaaaatatctgccacatgtccaagtccaaacaaccatagcgtgtctgttcatcattttttaaagtaaaagtggtgtttccttttaatcatgcaagtgcttttaagacaaccatattacactatgcaacagactgttttatgaatgaatacttcctttctgtcatgcagaatatttaaaaagatgtgtactcaaaggccaaaatgtaataaaattagtagttcttactgcttcattgaggacaatctcaagtgaaactggctttttaaattttttttttttactgcaagtgcgtagcagtgaagacacaatgatcactaacaaagtttagtgactctgccttgattcttgctaatactccaggag

SEQ ID NO: 13511 - DNA, 22497 bp, Human
ttagctcataaaaggcactcaataaatatttgttgagtgaaaacatctccttctcaccatatttgacaattttgaatttctcataaattttcatcaagttatagcagtatagtaaaagtccttatgaattgagtccttgattagttctgggaggttactgagcaccccgcctgtacttcaggggcgataggagtaatgggagtaagtgctaacccagcagcagggaggaagaatcaaggagtcatttggaatccagagagtcacatttctttttctttctttctttctttctttctttctttctttctttctttctttctttctttctttctttctttctttctttccttccttccttccttccttccttccttctttccttctttcttctccttccttttttttttttttttgacagaatcttgctctgtcacccaggctagaatgcagtggcacaattttggctcaccacagcctctgactcccaggttcaagagattcttgtgcctcagcctccccagtagctgagactacaggtgcccgccaccacgcccagctaatttttatacttttagtagagacagggtttccaccatgttggccaggctggtctcgaactccagcctcactcaggtgatccacccgcctcagcctcccaaagtgctgcgattataggcgtaagccactgtgcccaactaacatttcttagcctaatgtttgcatactccagctttatctcttggcagcccaaagtagattcctaggttcaaccagaagttccttgaaaattgtcagacttcatagaagtgtggagttgggagtcatggatctagtactgtacttccacttactggcaaaccccttgggacagagtattaagtttgacagacttgggttcaaatcctggctctgccacttagaccatctgtgggagcttgttacctctctgagcctcagtttcttccagatctagaaggagaataatatttatttttgaaggattgttgtcacaactaacttataagtgtataaaatgcctaatctaggtttggcacttcatgggtgtttaataggtgggaattataatttggaagcaccggagtgggtgggatgatgatctgggcaatgtattattatttgtttactattaccagatccagatatatgcaggggaaagccagcttagaattcaaaaagccactttacatagctacttttgttaaatggatgtcaaataaatacataatgatatttgcagtgtgacttaataaaggccttcagggggttttccagctttcactgttaggattttttctgataatagtcccatactttcctactctgatgtgtcctcactcagaagcactgtctggctctccccaaagggagctcgggacagtttcctgcctgaggtgttcaggtgaattctgtgctcacttttcctttctctctccttgtctgtctctctgaccctgaggtcttatcttgtcctctgggaggtatgttaagtgctctgccaggctgcctgtgcctggcctgttttttctcactgccagtacctcttggattccaattccaaacatggtatccatctggggtcaccctttcttccggtgccaagagagaacacattccaaatggaacacaaatgtgcctcccatgctggctctcctcattctgcttgggaaaaacagagagcaggatgtggccgcatcatcccacgctgctggacttttcagtcctgtagtgctactttcccttgggactatttaggtttttctgctaagaaccaaatttgaagactcccaagatacatggaaccaaggaagcttgccagagctctgcagggagagccagagccttgctgagacagcgggggtggtggggaggagagagggggggagagggggagagagagagagagagagaaagaggtttttaaattctccatgaagtgtactatgttccatcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctatctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgtgaggagcaggtcttaactctggccactgaacagacctatgctgtggagggtgagacacccatcaaccgcctgtccctgctgctctctggccggtaagctactctatccattgcccagaatttctttccccagcccacacttctcatttcctagtgtgtccctttccatttcatgtccctttccatttcgtgtccccttccattgagggaaggatgtgacaagtcaaacaaaccaaaatagatttttctaagagtggggttgcttcctctttcttggcattttccaagaagaaaccagttcatgaggcatcttggttggcaagaatgattgtatgtgcacttgctgctggaaggtgtgcagtgcgtgtgtcttgagcctgggccttaaataacccctctaccatcaccacacacatatcagtgtgtcatgcctaagctgcagcaatatctctgtaagctttgaaaaactaacatttcaataaggttaatctgttccttactcaaattcaacatttgctaagcaccaactgtattcagggaacaatgccagaaatgggaggtcgggatagcggggtggttctcataacccctgttccctgccaaggcatcaagcaaacagccccacttgtgtttggggtagctgtatgtagccaggtagggagagtgaataccccttgcccacctttccatttccagttgttctattgaggttcttgaagactaagaagtcaagtacagtactgtaaatctgagggcccaacaatgggagaagagaagtgatacacctatctcatcaaggcttttgtggaagcaccgcctcttttggagaaggctgacagtcagatatgggcagaaatggtcttagtcaggatcagtgtatgcccagtcaacctggatgtgaatgttgggcattgatttcttctgagaaaacatcacggggctctgtgctacacacttagtaggcaattgtggattttttgatactgccctagtggctcttgagccccacaacccccactccaccagctttcttgagaccaggagaatgtgatagaaaaggtaagatggcaattagaaggctccaattccaagaaaaaaaaaaaaaagcaaatccagataatactgccaaccacacaatggagaaaaaagtttgacaatgatgctaatggtactacaactaccactaatagtaataatacgtgtttgtgtattcatttatagaacctgaagtatcatgtatatatgttttgattttgtttgaactcagaggtcctggatagagtgagctaggaggggagacattttgtgagggtacatttcatttcatttattggtgaactgaaagtgtaaaccaatgcgattatttgtaaacagatatagatgtaaatacaaatacatataactattgtgaaaatgtttgcacctatagttccatgcttaaagacaatttagggaacttgctcattcatgagacccatgatgttatagctcgtctgttcaaaggaggaaattgagagcagcagaagtgctccctccagtgtagggtgcccatttgctggaagcatgtatggttactgtatagttcagttaggatagatttactgtgaacttgtataagatcacttcccagtgaaggggagaggggggcttgcccttggtgtagcttttcctggtatacttagcatcaaaaggctgagtcagaaattagacaattttgatttttttttttcctgcctttcaaggtttggagtaagagttttgttatctttcagtgtcaccctgtctcagctttgctgagctggacatagaggaaaaggcttctagtctatgactgggctctagttttaaaggagaatcactgaaccttgggctggttacagtaagggaccaaacatctcaaagcagcagacaagaactttgtgccaggaagtggggactcttgtgcagacttccacatctcacatgcacactgttctctagagtccttcactcaaacctcagaagtctttttgttttgttttaataaaggaaaccaatctctttcaaaactcagagagggaaagtgactttctcaaagtctatcaccctgttaagcagcgcttaacttagacgtttctctcatataaaattcaaaacacaaacttccatatatacaaccccctgagcaggcaactaactatctaagctattcatttaggagaagatcatccatcttccagtagatcaagaaggaagaagaaacagatgataaagggcacagcattccgatttaaatggcttcagcgaggcacgaagatcattagacattatctacactctacggttgtcactctttggtggcttgcctgggtggccgaaatcctcgcctaaggagctgacatatgctgcagcagcgccattctcttctgctgtcttcctttgctatggaagcttttcagtgaggttttgatccccttttatggtgacacaagtgagtttgttccttggtttcctttgttcatttattcatccttactttcttgcttccttctttccttcttttcccccttccatacatatttattcagagtcttgaataaagctcctgtcttccagctttaggttgtcagataataggtgcaattgtttttttaattggtgctggtctttggtaatttgtatacacgcatgtatacctaggcattcattaagagcaaggctcaggagtgctgatatcccattggccaggacttatcacttgcctatgcctagcagccagggaagtagagaaatgttgatttttttctctgcagtcatgtgtccagttaaaatctagcaccattaaggaagagaagaaagcagatactggagaacagactgccacactggatttcccaggtctttgttcattctcatctttatctgcttctcaataccctttgcatccctcaaaattcagctcaaatgtcatctccttcgagaggtctgctgcccaaagagaaccaatctttctctctcctctgttactgttccacaatagcacctatcacattgacttgcagccagttatttatgtgcctgtgacttccactaaattgtgaaatcctcaaagacaaagaccagattgtgcccatctctgcattcccagatctccagaaacatgagagatgctccagaaatatttgtttagccaataaacctccagaaataatggaaggatatctcccccaaatgaacaaggtgtaccttagagatctttttcatcttccccctttgcctaatagaggcacccctattgcctgatataactcactttagaagagaggttaaagatgaaactctgagttttctgggcaggggtcgggttgggggaaggataaagcccatactggattctaatcttcttccagatgtggcctcacatctgaaatacactccctgtcctcaggcatcatcaatgacatgccatcagttctaacaagttctcatggaatgcagtctttttaccctgcaggggcagagcactaggctaggtacagccacaagggtacaaaggcaccaagcagcaatagtaaggctcctaaccccttaagttgtgaaaccaagcctgtggtcatgggcaagtcaagagcagttaatgacttaagacttaagacttaagaatattcataaaattaaagcaaataattcggatttctggctgcagccacagtaacccactctagccaacagaagggggaaaaaaggtctttatttaaaaagatacaaggatttcttatgaaactcaaggaaagacatgcacctaagcctcaggtagtgctagaaacaagaacatgtcctactaggacattttatgtgatttcaagtttattttctctatagccaattgggacccatgcttttcaaagtctgagttacgtgataaaaaaaaattttttttagttccttcagggaggagtgtgttagttttgttaataatgcctgataattgtccccatccaaggcatgatttacacgcaattccatttccaaattcccagggaaggagtttgattggctcagcttgagtcaggtgttcactctaggaccatcagctggatagggtgcatgggatctcattgtctaaagaaacaagctgttattgtcacctacggctagagaggtccgggaaagggtcatgctatgagagtccactaccatctacccaaagctgtactaatagggcggcaacatggcgttgtgctaagaacatagaattttagttccgccacttgatcgctatgtagccttaagctcgccactcaacccttctgagcaccagtttccttagctataaaatacagaaaagaataatctaccttgtggtgttgtgaacattatataagagaacactggtaaagtgtctagcagagtctggcatatggtagacttgccacttccttcaaagtctacaaagtggttaaatgtaagcatgaatcttcatgtagctaatgggaagggagaaaggagaatctgtggagcagcggatccaacagaactttctgtgatgacagaaacgttctagatctatgttgtacaacatggtagtcacaggccatatgtggctattgaacacccatattgtaattaggtaaggaactgaatttttaattttatttaattttaattaatgtaaatgtaaacttaaataggcagcagcattcttttctctttttttgagacagaatcttgctcttttgcccaggctggagtgcagtggtgtgatctcggctcactgcaacctccacccccgagttcaagtgattctcttgcctcagcctcccaagtagctgggattacaggcacccgccaccatacctggctaatttttgtatttttagtagagatgggggtttcactctcttggccaggctggtctcgaactcctgaccttaggtgatccacctgcctcagcctcccaaagtgctgggattacaggtgtgagccactgcgccgggccagcagcagagttcttaagcagtagtttctatcttggctacacattagaatcactggggagatgtaaatactaataatatccagttcctacctagagagattcttgtttaattgctctgggataaggcccaagcctaggtgcttttttttaaaagcttccctgggacttctactctgcagcctgaaattgagaaccaccagtaaggagaaggaggaggaaaaatgagggttctggaagtctcaatgggttccttttctgaactacttgcatgcagtaattaggctggctagtctagctttgggttttaccatgctttaggcaaagtatttctacaggaagattcatgttaatcagcgacacctaacttcagcataggtggcttggagagccattttccttttcccacatgatctcttctcttcccttgccagggttcgtgtgagccaggatgggcagtttctgcactacatctttccataccagttcatggactctcctgagtgggaatcactacagccttctgaggagggggtgttccaggtaacagggagcctggtggcagcaccgcctcaccccatcccactgtagcccagcaatatccgtgcctccatgtttcccctcttacatctgtccttcgcacccctgccagtgtgaagctacaggcgggggcactcttcctctgaaaagagttcctgggctcctagccataggtgaggtagggtaggaagatgctggcccctgggtagaccatgttacttgtatgcttaaactcttctggaagaccctagtgccacaacataaaaacccacacttgttatagggtaacttaaaccttttagtgctctctagtcacatttccagctctccctccttcatattttttgctcatactagccatgctgaaccactagtacttccctaaacacaccacattgttttgcagctctatgccttggcccctactctcccctctgaaatgcatttccccttctagatgagaccacggaacctcacttccactgtgaagcctgcttccaccccacagccctcaccagcttccaccccacagcctagcactcctgtgtgcctgttctagtccttttacttatgctaactggtgcacatcttgctgtctgttctaataatctggtctcctttctgtcttctgcacagtgaactctgaagtacaaatctaggcttttccctctctggtcccagactctaaaggaaagtacctggagcacagcagctgttcagtaaagaattgcttgccgggcgcggtggctcacgcctgtaatcccagcactttgggaggctgaggtgggtggatcctgaggtcaggagatcgagaccatcctggctaacacgatgaaatcccgtctctactaaaaatacaaaaaattagccgggcgtggtggcgggcgcctgtagtcccaactacttgggaggctgaggcaggagaatggcgtgaacccgggaggcggagcttgcagtgagccgagattgcgccactgcactccagcctgggcgacagagtgagactccgtctcaaaaaaaaaaaaaaaagaattgctgaactggtttgccactgggcagctggtgtcccagaggactccatggggcattcacatacatgctccaatgcaggttcctggctgcctggcccctactcttcttatctctgccaatccctcaggctttggtcactttctttgtagctctcacttattgaatggctagcatgtggcaggcactacgtatcatattgcctcattgattctcataacaactctatgggttgaatatgattattactccatttaacaactgaggaaactaaggcccaaaaacatcaagtaatttgcccagggtcttcagctagaaagtgacaaagccaagttgcctggatctaccatttctgttctttattaaaatgggaaggtcaccagaagagtagagtttacacacacacatacacacacacacatgcacacgcatgcacacacgcgcacacacactcactcacccttttaaggactcccctgcctggatagtttgctggacctggaaacactggattccatgtgtctcctactacttttatcagggagtccctcaagccaacatatgagccaaccccggaacagacacacaccgggcagtgctacctggcagggcctgcttctgcccccaccctgacacttggctctgtgatgatggagcctgagaggcagtcctgatcccactgccagggtcaccagccacagatccacttccatcatgttcctaccctgacctccgtccacacaccctccctaactagtccagaaaccttcttcaggaactctctcaggcacatgagaacctccaggagggctcagtcaggacctgagccagctggaccaggcctctttctgacactgacacggaggaacaggtggtgggtaagccgggtgtcctcccctaagttacgctcaagaggaagggctgtaaccccacatggcctctcagcctggaatgtaggtatggtcatgttcctcccatttatatttttagcgtgtacctcctttgggagtaatgagagccacacatttgctattggctgtgtaaagtcccatttcctctttgcaaatgtcaagtgttatcttaagttagagttcatcctgtccttgccttttgcaattacatagtctttgttgactgagagcaatccacagtgacagcctaaattataattcacattgtacctaatataaatcaatcagcattccagcacacctctcgacaattcaattaagtcagaattcattgtgtgttcggcactgtgacactcattagtcaccaagaacacagcacaggagggatcacacagaaatcatcactgtttttctaatttgcatcctatcttactggacctaagtcctatttacataggttatctcatttaattcattcaaccaacatctgagatgagtattaaaaaaaaagctaaatacttgtcaaaacgttacaacagatatgtctatatatatgggagaaccaatcaagaagcagatttcaggaggacctttggggaaggattttatacaggacatgagaaagcaacattagaggctgggcgcggtggctcacacctataaccccagcactttgggaggccgaggcagttggattatgaggtcaggagtttgagaccagcctggccaacatggtgaaaccccatctctattagaaaatacaaaaattagccagggtggtggcaggtgcctataatcccagctactcgggaggctgaggaaggataattgcttgaacccgggaggtggacattgcagtgagctgagatcacaccgctgtactccagcctgggtgacagagcaagacttcatctcaggggggcggtggggtgggggaagaaagtgacattaggttgttttgcaatatacaagattggctgtcttcccttgattcatttattcacttcaataatatttattgaaaacttagtatataccaggcactgttaaaaggatttgaaatatatcagtgaacagaacagatgaaggtccctcccctcatgcaatttacattctaatgggggagacaaaaagccataggcataatgaataagtaaattatataatttgttagaggataatcactgctagtttaaaaaaaaaaaacctagagtagtgcaagggagatatggtggcaattttaaatagggtggtcatggaaatccttgttaagcagataacatttgagcaaaaacctgagagagatgacaggtgaggtctgtgaatatctgggaaaagcatatcagacagaggaaagagccagtgcaaaggccctgaggtggggccagtgtgtttgatgcacagaaaggaggacagtggacctggaatggagagaggaaggggagggaatagcaggagagaaagttggagaggtgacgaggtagcaagatcatgtagggccatagcatatattgtctagatacagccaaaaggattttctaaagggttggatatagtatgtgagagaaagagaagatcaaggaagactctaaggcttttggcctgagcaactggacaggtggtgctgctgtcagctgagacaaagaaagctgcaggtagagctgctttcgggggactaggaagttcagtgtttgatgttaggtttgcatcatctgtggacatttgaatggagatgctgcataggcaactggatatttaagtctgaaattcaggaatgagatctgggcctgagacataaatttgggagttggttgtatgcagatgatatttaaagccattggataggatgagctcaccaagtgagtgagtgtggatggaagagggaatggttcaagagcggagccctgggatactttagtggtgaggagttggagaggaaaggaggaagcagcaaaggagcttgaaaaggaacaatcatgagattgggcaaggagtgtatggcatcctgggaaccaagtgaagaagatatatcaaagaggaaggggaaattgatggatgccatgaaaactgaccatcagactcagcagcttagaggtcattggtgaccttaacaggaacagtctttgtggactgctagggacaaagtcttattggtttaagagagtgagaagagaggaattggagacagttaagtataaacaggtttttttttcttcatgagttttgctaaaaagggaagcaaattagtggagtgatagctagccagggaagtgaattcgagaaaaagaatttttatttgtaaaattttgttttattttaagatggaagaagtacagcatatttctaagaaggttcacagtctttgtgtttggctttaagacattatttacattcggcgtagttcttgctcaaacacatgtgcttcatatttggtactctgatttcttgtttgggaattgttcataagtacatctaaggtacaggccatggcagatgtgacaactacttgctgaactattagtaatggacagattgtattattttcagaattctttctcatgaggcaagagagattaagtaatttatctgacatcatacaactgatagaggtaaagctgaaacatgaaaccacttctggcctcgataacgtagtttaggtcctgattgcagtgctagcaattagtggagaaaagttgagaggaggaaatgaataaaggacgtgggggaggggtatagcagaaaggaaagaagagaagaggagggtaatgggagatccagtaggcaatacaggaatgaaaaggattatatataatctctaataaagaatgtttggaaagctaccctactttaaatttgacaattcatataaagtgcttaacacaacgcctggcacctcttgacaaatattagctgctaacatcattatcatcatcatttccactgtctccatccacaaaaatatatcatgaactctgccagcccaaagtattagggtcaattagattattaaaaattgtgtgattctgcacccttttcctgcactgtcctaagcatgtttccattttaaccccagctttaccacttatcattattttaacaaggatttatcaaacacctgctgcatgctaggcacacgttattgcttatttcccatgcaagcgtaatttagctttgcatcatgggcacatagtgagtactcagaaattcctagatgaataaacaaatggagaatggggtgccctttgattttctaccctttagagtttgtcttccgctatgccctttttctgatttcagtcatcagatccttttggttacttgaagtggccaagttacgagcaatttcgtaacttgctcgtatcccaacctgaatcccaggcttgggatcctgatgtagcttggcatacctcatcagaagctttttctcaaactgaactttccaactctttttatgtccctaccccaatatcttacccttcctcattcttaaaatgaatagttgtcagcatttcaaccactcttcagagcacaagaaggccccttctttctctatcttaaaatcataagactcagaactttctgcagtcattagtggcattagccacggaaccacagaattacagttgaggaaagtggatgtggaaactgaggcttcaggaggtgatgggtgagtgagtgaatggctgatcccagggctcctgacacaggacccccccatatcagtgcacacaagtgaaagtcatccactagacctcctccaggcaaggccatagaggggtactcccacacagcttcttcagtaaaagtacagctgtttgccaagtgactgaatgatctctgtgctcagcatggacaaattttctagtttaaacttttattgtctgcttctgacccctctcaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactgggtgaggactccaccagtctggtgctggaggattttgaggaggtgtcaggatcagaatcgtttatggattataggagtgatggggagtacatgaggtgaagggagaactaacatgggcacagccaccggctcaggatcctatgtaagtactcagaaggcagccgctgcacattcctgtcaatggctggccttaactcagcttgttagggcaaaaaaaatcattcgtggaacatttcctcttagaggactcacagaaagtggcattaacccaactttgaagatagcaactcactccgggtgcatgcaaggcatgaagggattttaaaaactcattcgttattaacttgattgcattttagaaagtgggctggttgatacgttgagcaggaaggtagattgctgtttttttgcaagtttattctaatagctgaggccacagctggggcttaaggggcttttatttgtggcatgcattttaaaagaaaaagaatgtggcagggttctaattctgattgcttgtctttcctgatacagagcccgtcctggaaagcagttgttatttagcctagactgggcaggcatctctgttaaaactgcatattttaaagaggattgtgattatgagctaatagctcggggaggaaaatgtcctcatcttgctttcctctcacccagtggagaatgtgtttgttgatcacacagacagaggactagatactgctatgattaaatgttactatgatcagataggtatatggcagcctggctttccccagtcacccacacctgtgggaggtaggatgtgcataaatcctggagggcctaacagtgcgtgcaggatttccctcacagaatttccctcccagagagtctacaagaaaggctgtgcccagtggttctgggaaattgctctcatgtttccctggctgccctcataatactgtgatgtttttctctgtaactccacccaaccatgatgtaggcctgaatttcctgaggaaaatcccattgttcccaatttggaaggcgcctcccatggttcttcagaaagcaccaataaattacctgagaaactagcccagtgaggaaggcctccagagtacatgaaatgaatgagtgaatgtttgtctattttgaaaaacaggttatataaatgatgaaagaggccatagagatgactgatgaaaggttagagatttagttttgtagatatggaatttacaatctcctgtgttaccagcatccttagaaccatagttcagctcattctgaggtaattccaaggatcaatctaacaccccagatcactttgttgagttccccgaagtgtgcattgacaactctgatcactcctttccctctgtgcagctgttcgccttcctactcgttcatcctgcatccacgcatgctccttatgtcctatggatccctcttggtccaacttgcccatccacctatacactctctcttcgactcacagcagctctctgttttctcatgttgttcttcctggttttcttctcttttcttggttctatttttctcttctttcttctccaatttcttctcagtccttgattgcctcagtttgatgttctgttcttttttccttttctttcttgagacagggtctcactctgtcactcaggatggagtgcagtggcatgatgtcggctcactgcaatctctacctccaaaagctcaagcgatcctcccatcccagcctcccaagtaacagggattacaggcacatgtcgctgtgcctggataatgtttaatttttaaatttttttgtagagacaaactctccccatgttgcccaggttgttctcgaactcctgggctcaaataatcctcctgccttggtctcccgaagtgttaggattacaggcatgagccaccatgcctggccagtttgctgctcttaagtgtccattttctatgtcttctcagttcatttctccctcttcacttgtctcttgttttcttccattttattgttcatatatttatctctcctattacctccttttttctttttcccaccttttttgccttgctgtatctattcttcctcctaaacaccctgtacccccatcttattagtttttaatcctaactcttccaaagatcagtacttttccctctgcctataaagaaaaccattcaagtgaaggtgtaaaatccccagctttaggaatgttttccaaacatcaggaggcaggcagcatggtaaatgagaaagaggccaggactgggagtccaaagtcctggcttctatgtctggctttgctactaatcaaatatgtgactttttgcaaaccatacctcactaaaccttactttcttcatttgagcgtgttggaccagctgtccccaggaacccccttggattgatctgagaaggcaaggataagtttttcaaaggaagaaaagaggagtagtcagtccgcagtacagtagacacaagccccaggacatctgagtgtctttcagcaagaactctctgtgatatttcactacaatttctctggcaccttgggactctcctcagcccttgtggtggtgggtcttgtttaactagcagttccctccattctatgcctgtgaagaatctatcacctaccatgtgattacagtgcagatttttttttccttttccttttctttttctttctttttttttttttttttgtttgagacggagtctcgctttgtcacccaggctgcagcgcagtggcgcgatctcggctcactgcaagctccgcctcccgggttcaccgccattctcctgcctcagcctcccgagtagctgggactataggcgcccgccaccgtgcctggctaattttttctatttttagtagagacagggtttcaccgtgttagccaggatggtctccatctcctgacgtggtgatccgcccgcctcgggctcccaaagtgctgggattacgggcgtgagccactgcgcccggcctacagtgcggatattttatgagagaggagatcacaactcagtccccaagccctcaacccttaatacatactatcgtatgaaatgcctctttccaaattcagccttttctaaaactcaagatgagaaaactgctgatgaggctcactttctaaaataccggaatttgcaatatagggagaatagtttttcatgtttctttgtttaagcaatagagagaaaggaaacttatgtcgtttacttttcaggccatagaggttttcagaacaacttgaaaacatgatcaaattagccaaacttctgatagttttcaatgtagtctgtgatcatgggataatttagcctcagttctttttctgaaattgtgttttgaatgtttgatttgacttatttaccatcaaacttgctataaggttattactctaatgaataagcatattcccttaattgggagcaatttactattatttctttcataaagtagggcaccattcaccatctatttcctggctctttagttatcaaaatgttaagctcattgctattcatcccggcacagcacttatatgagaggcatgaagctggctgaattctgcatcattaggaatgacacagcctcatcacattgacaccagtgcttgtctctcacaccaatccaaattaagaccaactgaaaatagtcagagtttcctctggagctcctttttgaagagacatatgttttttagtctggtggtacccaaaattgaacaaaaaatgggtgctgcttctcttaataggcaaaactatgctgcaggataatgtattcatgcagggtcttccagccagaccccaaatcatccctcccttcactagaatttttctgtttaattcgatggccactctccacagggatccattctgtgtcttattacaggagatgctcaatgaatgagggacttatcttctagaaatgcagctccgaggtagtctgttgagtgaaataatgaatccattatcacaaaataaattgaaagctgtctgacatttggacaatttttattttgtttcacattgttctgaaaactatactgtttcttttctccctattatttaaataagcaaatgatgaacagattacaaaattgaggacactcgaggtaagggaaggagcccctcgacaggaggatcaggacatagtaccaagggcaagagaaacgattcaataaacactatttactatatattttaggcatggttctaggtaatcacatgataagtagttgaaagaactgaaaatgttttatctgcaagaaaagggcaagtgtaatatcttcaaattttagaaagaatgtaaattagaatttgacttaatttggtgtagttcttgtgggcagaaattgaattgaataggctgaaagttataagaaggattttagctcagtattgatactggattgctcatgggtggtgagagttactcatcactggaagagttcaagcaggggccataagaaatctcagggattttataaggtgattcatgctctgggaaaaggatgccttggattattgtgtcagggtaacttctaactctaggattctgtgtttctaagatctggactctagtcttgccactcacctgccatcaagaacatgttcctcatctgcaggacaggaccaagatggctctgtctaccttaccgggttgctgtgaggcgtgattgtgataaaatacataaaggcagtttttaagctctgaagcactagttaaatgtgtagcgtattttaagattctgttgtatgtacaattgtttagcagtctctctctctttctttctctttcttttatcagagatagatgattttccctcttatttccaccagtttggcttttcagggaaggtggcagctggcagaatcccctgacaacaaaaggtacagcaaaaagtggaggcctaaagaaaacatgtgctagctctttagcccctgaatagctaagtcacatgtcagcctgctctccttcatctgtttgggaggaggcagattagagtcacactgtcatcatgctcttcccctcagaagcagctgtaaggtttttggtagctgtcagtgctagcaaacagtgcttttctcacagaactactggaaagagtcctggctcggaaaacttgctcttgaaagtggcacggccagagcaggggtctctagagggtcgtgccacctctacctgccacaggttccattgtcggtcaggtaagttagaggcagcagttccccacctgccctctggataacagcagcctggggctgctcctgagtcatgtttccacttctgtcttacaggcctcattttcctacccatctttctgtaaaaatgaaagtcaggagtcttatgaaacttaccattattcaatacaggcttttggtttttttctttaaattagatagggttaggtaagaagtagagttctatagaacgttcataggaagcaacaaaagttgatctcttggtctctacaataggagaggattgggctagataccttcaaagctgacttgccctaatattctagtatgaaatgattcgaaggtacacctgcccctatcatgtcaggcagtgagtacagttaaaacattgggaattggtaaaggaaagaaaaaaactgaaaagaaccctttgaagttagacaaactgtccagagacatagtgctaaaatcctccctctttttctttccacagcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcacgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttccctatgttgtttctttgcattgtctgaaaggatcagtggagtcaaagatccagcttttcactggtggttattttttatttttcaattaagattcaaatttatggaagtggaaatttaaaaacctcgttttcccttaggctgtgacattcaacttacaaatctctttttctgttgatgaacctagtattaaacaatagtttttagagggacttttacaaacttagttaattagattttcttaaacatcttaaagtagatttataaatgtaatatattctattttcctttttctttaaatacttcaacatatatttcagttatctattgctgtgtaatatcaatccctaaaatagtgacttaaaattgtcctaataatatgtggtgctcatgagtgcgggacctgactgggctcagctaggcggttctcactcagggtttctcatgttgtttcagtcagatagtggctcagtctagaatcatctgtaaggcttctttactcacctgtctgggaagactcaaacagatgagggctgaaacagctgggaatccttgggcatctctccctctcaatagttttttcatttttgttgttgtgtgctctttgtatgactataccacaatttatttatccaatctacaattgatgggcatttggatagtttccaccttggggcaattacaaatagtgctgctataaacactcttgtacctgtcttttggtatacatatgtatacttttcttggatatatacctaggaatggaattactcaggcattgggtatgtaaatacgaccaatttttctaagtgattgtaccaatttacatctccacaagcactgtatgagagttccagatgcttctcatcctcagcaatagttggcattatctttttttttttaattttagttatttgggcatgtttagcagcatttttattttcctgatgggttgagtagcttttctttcttttcttcttcttcaatttttttttttttttggccatatggatatcttctattgtgaagtatctattcttgtttctttttttttgtccattgctctttctttttttttttttttttttttttttttagacagagtctggctctgtcctgaggctggatggagtgcagtggtgcgatcttggctcacctctgcctacctggttcaagtgattctcatgcctcagccacccaagtagctgggattacaggtgtgcatcaccatgcccagctaatctttgtatttttagtagagatgggattttgctatgttggccaggctggtctcgaactcctggcctcaagtgatccacctgccttggcctcccaaagtgctgggattacaggcatgagccactgtgcccagcctgtatgctttttcttattgacttaaaggagttattcaaataatcaggttaaaagtccttctgttacttattgagattttatatatatatgtatatattctcctacttttgtgggtattgtttttctctaaatagtatcttttgatgaacatagtttttaatttcaatgtaatggtttatcaatctttctgtctctgatttgtgctttctgtgtcgtgtttaagaaatcttttcctcccctgaaggtactctcccaataaccttctagatttcttattgttttacatttcaaagttagacctacaatcaacctggatttggtttttgtatatatgactaagggccaagattcattattttccatgtggctatccaattgactgagcactccctattgaaatgattatcctatccctactagtgttcagcttatcctttgtgacaaatcaaattttcctatagatgtaggtctgtttctgaattttctattgtctgatggttctatttttctaccctttggcagtaccatctggttgtaattattgtagctttacagtaagttttgatatctggtagtcttcaaactttcttcttcagctccattataatcttatgggaccaccata

SEQ ID NO: 13512 - DNA, 13445 bp, Human
attgatgaaacagaattatctctaaagtaattgtcattttcagtttaaatttcatacacacacacacatacacacacacacacgcattgaaagttatttgcaggtaataaccttgggtaagttttgaatctcaaaccgcttcttgtcttctcccttgaatgattttctcaaaagtgttctatgggccaggtgtgatggctcatcgctataattctagcactttgttaggctgaggcaggaggatcccttgagcccaggagttcaagaccagcgtgggcaatatatcaaaaccctgtctctacaaaaaaaaattttttttttccaggcagaatctcgctctgtcaccctggctggagtgcagtggcatgatcttagctcactgcaacctttgcctcctgggttcaagcaattctcctgtctcagcctcccaagtagttgggactacatgtgcccaccaccatgcacagctaatttttgtatttttaatagagacagggtttcaccatattggtcagactggtctcgaactccgcccacctcagcctcccaaaatgctgggattacatgggtgagccaccgcgcctggccaaaaaaaatttttttttaattagctgggcatggtggcaatcacctgaggtcccagctagctgatcaggaggctaagttaagcattgcttgagcccaggaggttgagcctgcagtaagctgtgatcgcaccactgcactccagcctggatgacagagtgagatattgtctcaaaaaaaaaaagtgatctgtgaatcatctgtagcagaatcacttcaggagtttgctaaaaatgtggattcctatgccgggcgcggtggctcacgcctgtaatcccagcactttgggaggccaaggtggggggtggatcacaaggtcaggagttcaagactagcctggccaagatggtgaaaccccgtctctactaaaaatacaaaaaaaattagcgaggcatggtggtgggcgcctgtaatcccagccacttgggaggctgaggcagagaattgcttgaacccgggaggcggaggttgcagtgagccgagatcgcgccactgcactccagcctgggcaacagagcaagactcgtctcaaaaaaaaaaaaaaaaaaaaaaaagtaaattcctgagccctagctcagactttccaaagtcagcatctctgggttgggcccaggaatctgccaggggaatcttatacaggttcaagtttgataatcagactgagcacggcggctcacaccgtaatcccagcactttgggaggccaaggcgggcagatcacttgaggccaggagttcaagaccagcctgaccaacatggtgaaaacccatctctactaaaaatacagaaattagctgggcatggtagtgtgcacctgcagtcccagctactcaggaggctgaggggtgagaattgcttgaacctgggaggtgaaaggttgcagtgagccgggattgcgccactgcactccagcctgggcgacagagcgagaccctgtctcaaaaaaaaaaaaaaagaaagaaaaaaaaaagtttgagaatcactactcttgaaagttgctagttgatcagcttaactgttattttttttctgattagaactgcatggttgtccgggcatggtagctcacgcctgtaatcccagcactttgggaggccgaggtgggtggatcacctgaggtatgcagttctagaccagcctgcccaacatggcaaaaccctgtctctactaaaaatacaaaaattagctgagtgtggtggtgcatgcctgtagtcccagctactcaggaggttgaggcaggagaatcacttgaacctgggaagcgaaggttgcagtgagccgagatcacgccattgcactccagcctgggtgacagagtgagactctgtctcaaaaaaaaaaaaaaaaaagtagtgtatggttaaatatcatagatgtatagattttaaccttccctccctctcccttctcaaaatccaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggtgagattacaggaaggcttggccacctggcaacatgacagctaaccgaggtggtctgtctcattggttgggctgatcttgatgggcagatgagccattccaagatatgaagggcatggaggaatttggttcttttctgcttagcaaccaatcagatatcatgaggtgccccaacagtgccccaggtaagccaccccacatgtgcagcaagcttcccctttgggagggatgtgagaacagaagactgaggattgtctctaactctaggattctttgatgattgattggattggggttttgtgttgtgtctaatattacggatgctaaaatgcctgtacttccaaggtgatagccaccaataaccatacacgtactagtcatcctagaagtgtttttatttcttctgttggttatcttccctacccctagggttggtgtctgtttcctgctacttcaggttggtttcccactgggaggcttctgctgacagaaagccccatgctttgtactgaggaactgtgtaccggaaaagcaggctccccctaattttttttttttttttgagacggagtttcattctcattgcccaggctggagtgcagtggcacaatctcggctcactgcaacctccgccttccaggttcaagtgattctcctgcctcagccttgcaagtagctgggattacaggcattcaccaccacacccagctaattttttgtatttttagtaaaaacgggaattcgccatgttgaccaggctggtcttgaactcctgaccccaagtgatctgcctgcgtcagcctcccaaagtgctgggattacaggcatgagccaccctgcccggccctggctgctttttaaaacattaaggccaggtgcagtggctcatgcctgtaatcccagcactttgggaggccgaggcgggtggatcacctgaggtcaggggttcgagaccagcctggccaacatggtgaaacccccgtctctactaaaaatacaaaaaaaatcagccggacatggtggtgcacacctgtaatcccagctacttgggaggctgaggcagcagaattgcttgaagctgggaggcgaaggttccagtgagccaagatcgcatcactgcactccagcctgggcgacagagcaagactctctctcaaaataaataaataaataaaaataaacaatcaaaatttgtctaacatattttactccgattgcacataggatggcagtcataaggcctaaggttattttgatgaagatgagacccaagaaaagatagtaattttcttgtgtttctgaaaaccacttcagcatgagcctgtctaaaaggtttagatgacaaatttagaaagctgagagtagccggctgtggtggctcacacctgtaatcccagcactttgggaggccgaggcaggcagatcacgaggtcaggagatcgagaccatcctggctaacacagtgaagccccgtctctactaaaaatacaaaaaaattagccgggtgtggtggcgggcacctgtagtcccagctacacgggaggctgaggcaggagaatggcctgaacccaggaggcggagcttgcaatgagctgagattgcactactgcactccagcctgggtgaaagagtgagactctgtctcagaaaaagaaaaaaagagagagaaagctgagagcatcttgaggttgggggctattatgaaggtggggctgaagaaaagcaatatagtttgtgtgcatattcgtaagaaagtgcaagtacagctctggaatctttcttttgcttgaccagagtgttgaagaaaaagcaaagcgagaattaacagtaagcctcttgtatcttccaccagccttagcgatgtgaaaaaggagaactagagtaatctagaatcagtatttagagccgtggcatttaaagtcaaggacactgcttcagagaagcctggaggtagagagggatctcctgtcattttcttcccaacccccagccctcccccaactcccatcaggtggagattaaaggatagaactccatgctcctggctgtgtaaccaccgtagacagtgcccttcacgggatctttaggccacaaaagaggcagcaagctactaggcagctagagggtggggttggggacaggcaggggagcactgcaaaataaaccagtttgagtgagtaaagtgagattattatatatgatttgattttgataagaaagttcttcccagattggggccttcagcaaccaagttcacaggaaatgatatcaagagagatccaacaaaaaactatgagcaaaaaataaaaaatgatttttgtatggaggagaaatagtttgaaggtcacttaattagtttagtagatagtaccatggtgtatagaattgggtagttaagactgggatttcaaggttaatgagattagattatggttaatagaatgatataaatttagagaatttaaccattatttgaaatgggttatttaataaaaatgttaattaagaagggaatctgctgtctattgtcctttcgtggtaacctttggggactagagaaaggtcatggagttttgctgtggaagcgcttttcactgtgagccactggttgaccgtgtacctccctaaggtggtgcctctgacccaagctcttgtccacacaccagcttcctggtttttgccttaaaaagagtcacttaagtggaattcctttccagcattgcttagttgaagtacaggcctttagtaatttttatttattagggctaaaaatattctaaaactgaaagactttactagaaaaatatcaataaagatcgaatggtttgaggttcactttcaaacgtgaaaactgtgcaataattactgaaatgccctaaattcctgtttttttcctccctaccccaccccacctccccaaaagctggcccaaatgattaggcactgaataggcaagtcaggtgacatctgattctaacaactctgaaagaaaatgtacaaaggtttaaaaataaaaaaaggacctggaatttctgttgcagtttcaagtgtttaaagacagacacatacatcgtacatgtttaatcaaaacatatttaagagacctgtcttgtactgcttaacaataggtagcctcacgggggcgagttaaggaaacagccatggagctgctagatggcaagccacgcccctctgtggatgaagtagggcaggtacatcacttctcattagtggagtagcttaaacacatgatttgagactatggaagttagtgattcctgggatggatttcagggtcccgttccacctggtgtcctgaaggcagcacatacgaagccattacaggggtgggaagtaccacgtgttgttcaccagcctctgcttcaggtgtggaaactgacttttgagagaggatggaaccggggtttcttttcctcattggtgctgactgggaagccagcccattgtatgattaaagcaggttttcacgggagaccatcaggagcagagagtaggtaaagggcacgagaagcagaaggagatcatcaatctcagaaactctgtcgtgccaagaggcccactgtccaggggagtgatgaggagagacccagttatgtcaagtggatgaaagcggaaagaggagaaactgaaaaatgtctgggagggagaaccgaagccagactccattatcaacatggaggaagtgtcactctgcgccctcgaggtcaggcccaggttgccagggcccctcctaggatgaaacattctgcactgggactctcagtcttttttttccctccttgggtgtctagaaaatagtgaacaaaggatctggcttagagccagagaaaggtatcgagaaatccatccctcctccacccacagacctgaacttgaaccccaaaccacagctctttctgctgttacagttccaggcatttgaagacattttctctctaaaatactctgagtgtgcatgtgtgtgtggtatgtgtaattaaaatgatactggctttgaatttcctctcaaagcagagatccgaagttttaacctgacctctagccatggtcaccacggagacttgcctcctcccataaccttaagccagcagatcgtgccctgggtgctgctctccaggccaccccctcatgctcaccttttcttgtgatgtctgccccacgttcctctcctcctcctggagacaggagccatgagcaggtcacataggctttcagttgccttgtgtccacaaaaggggccatgagcagtccgagcgccgagctgtgatccgtgcctgagtcagcctccagaggaacactaaatgctcactcgcccatttcttggttttgcttctttttccttgatttgggggacttgtccctaatatgccacagaattttaatttttttttttttttttgagatggagtttcgctcttcttgcccaggctggaatgcgatggcacaaccttggctcactgcaacctccacctcctgggttcaagcgattctcctgcctcagcctcccgagtagctgggattacagatgcccaccaccacgcctggctaattttttgtattttttttagtagcaacgaggtttcaccatgttggccaggctggtctcgaactcctgacctcaggtgatccgcctgcctcagcctcccaaagtgctgggattacaggcgtgagccaccacgcctggcctgatattttgaaaaacaaaatttaccacttctttctaggcctggcatcagttattgttgactccaggtgtatatggaactgcttatctgtgagtcagacctcaggtttatttttaaattttcaaacttttctggagactaagaaagcagtctcaggacatgcgatttcactacctttctggtgcaatgccctttgtcaccagaaaaaaaaactactaatagcgagccatatttgatggaagcagcatccagctgcttcttgaccctgggggcctgatggcacaatgaggtaggctgcattgctcagcaagggtccgagcacctcatcatcttaaagcaattactgctgtgaccacgtaaccagcatggctctaaaaaccaggcccacacagccatggctgccaccgcttccttccaactaccgagcagtgatggatgcaatgtacagagatcaaatttaagagagcagcatagtcagagaccactcttcccttggaaagaagcagtgcaccttaacttctgggatgcagagatttgggaggagtgagtttcccctgtatgcttaggggtggcctgctgtttctcccagtggttataggggagaataatattgtgacataggaaactttatttcctctctaggaggccaaacaaagctcagtatttgaaattccatgtctctctttagtctctgttattgaattgaagctaatcaattcaaattcagtttcagcaagattggtcaggggagggtccagggaaggaaggaagggaggactattcataccgtaagatcgtcatccccataatgaagatcaaatgtacagaaaattggtcaaaccagtttttaacaataaagattcggccaggtgcagtggctcacgcctgtaatcccagcactttgggagactgaggtgggtggatcacaagatcaggagatcgagaccatcctggctaacatggtgaaacgctgtctctactaaaaatacaaaaatattagtcgggcatggtggcgggcgcctgtagtcccagctacttgggaggctgaggcaggagaatggcatgaggcggagcttgcagcgagtcgagatcatgccactgcactccagcctgggcgacagagcaagactccgtctcaaaaaaaaagccttccttgccaggtgaaagcaagagtggtatggaacatttatttaaacataagaagcagaaggttcctcctcttgcaagtatgttttctctaaatgtagcatttccactggaggaggtggtctgggtggatggttaatatgtgaggattgtgcagccaggcagataaccaggcctctgcatatacagatacccacagcccaggaatcttgagaactgaatggcccataacaacctctggcactatcggagctgcagggaggcttggctggggctactccagtctcaggcccctgtttttagcggaagtcacaaggaggataaaaccagaattcctccttttcccatcttcagggtgcttcccagctcctctttaagcttggggcagaacccttcacccggcaggtacccacatccgtggagaactggtaagcagctctggagcaccacgctgggcaccacagcttgccattgccctgctctgtcctgtgccttcatctcctcagctgtgatagagaaataacactagcacctactttgcaggcttctacaaggattgacttaaaagatgtgaattaagtgggctgtgggctagacatcatgttaggttctgggaatataatctccagcaagtctgatgggagcctcccctaggggagcttgggcaccaccattgcctttcctttccaggaggcagcttgacaaagcttgccctgatgtgattgacaaagcttgccccagctagatccatggccacgtgattgaggaggtaccattgttggccaatgcctccccttccctcccctcccacctccagcccagttctcttctgcccagcacaagaaagatgccactccccaagcactagccgcttcagattagaggggcctcccgggcccagggcagccacagggctcggtcccctgtttacgctccctgtgcttcccacactcagggttgcagcggcagctgcaggggcccaggccgggggtcagctggcagggactggcctctgtgcgccctctgttggcaggacagtggctagaagggcttcaccactgctggccctcacaggcacctggagacaccagacactgtccctcagcagggctctgccgtttgaaccctcctttgcctccataacagagacccggcataaaaccaccccacaccctccaccttctgctttgggctcctgcagctgagtaaatatttttcctatctctttgcctgcattcatgttcagttatatgcaataatctctccttaatcagccataaagcaaggaaaaggcaaagcgctattcacatagtgtgggcacactgtccttgatttctctgagaagatggtttgagtgcgagcctccgtagaggagagagtgttgaggtgcccacctttgagtgtttgtgtgagcccctgaaggtggaaagtgctatgtaagtgctgagctattcagcttcccaggcgagagaagatgcttatcttattcatccctcttttatttgtaaaatcttttttgtctcttgacaggtgatcttttttttttcctggaaaccaattagctactaaaattaaacatgcttctctttaaattaatccttttcataaaatggtcttaaaattggccttagcttctcagagtaagtagctgaccccattgtaattagagatgcgtttggagtcctcatttctcccacctcggcattcctctgcccttccccctgctgctgccaggtgctgtccaccttcgggctttcggcgccaccggcctcatcttggcaaaggtcagatgtcggctctgggacagccgtcagattatctagttctgctgcccaagtgcactgacagcaactggcagagttgtaatcactgtaaattcaggtgacggtcagatgagccaggagagaggatgcctgctggttgtttttttgcagtgatgtattgtttatgggattaatgttccgaatggccaagggtgtcagctgatatttattactgtaagctgtctcagctgttcaggttcggcagctagatccatggccacaggaaatgtgggactcggtggcatgtccagtatggctgatgtgtgcagatgtagctgggacctccgtgagcctctgttacagatgcaaggggaaggactcatggcagcagctgccttggattttgttcagggcttctgagggaactccacacactcttgaaggttggggagactctagggaaggggagagtgtccaggtttggctccaaagggggttgggaaggagttcacctctgacaggcctggcatccgtaggaattatgctgcctgccaggtagctgtaggcattgtgtgatttttaccttggtccctcttcagccttctaagagagggcgctttcaaggtcattgtgcctttaagggaaccttctccccagtccctctggatgctggtgcttaaagctataagaagcgggccagacccttttaaacctatctggagtgctgcaggaagagaagtaaatgcacatcgccctggtgtgtgcctcgcaacactcactgcagtaggtttgtttttccaaaaagaaatttaatttaacccaagtgtacactgtcacactgtaaacacatggggcaccaaaagggtggcttattgaatttaatgccctggcaaaggtcaccttttagaaaaagccaaaaatggctggaatctttcctgatagctcttcagtcaggctttggatgcaggcagatgtgtttattttttcagagggagttcctgaggacccatctcaagttcaggcgctgggcatccccctcccatcgccctcttgtgctctcagagacctccctcctcctcctcctgggaggtcactgtccctggtcacccaggtgggcccctgagccaagcaaactccctaaagctggcggtctgggagggagggcctgggacccccactgcccgcccctccaggctagagtgtgtggtgcttttcttataactaacactgcctttctctgcccatttccctcaaaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccatcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaagtcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccag

SEQ ID NO: 13513 - DNA, 17415 bp, Human
  misc_feature (1)...(17415): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccgcgcagaagtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccgggcaagtaccctacgcgcgcgcgcgcacacacacacacacagacacacagtcccttcctctctcccgccccgggaccacccatcccgacaggctgactcttgtgacatcaggccagtggcccctggccaaactcttctctgaaagtttggggacagggtcctgggaagaagggccccgggtcgctacttggtacattctcgcacctgtgcgcacagggtccgtcttctgagtgctttatgggattggggtgtgggaccgtcaggggtagagtctgggtgttgcttttctgtggtgcgcagctccctcccccagtcttgttgctgtaggccctacgggaagtcaccgaggcagtgaccccggtcctgcctctccagctgctgtttatgtaatgagtgtcccggtgccgctgctgtggctgacatgatccatgatgctggcataccaatgaggaagtaaacaaaagcagccatgttagttttcagcgctattggaaacacactggggggggagtggggggagtttccagagggagagcagaactccggccgtctctctggacagggcctgggcagccagcgaggccccgacagcggctccgctatttggattcctcccgagagccggctctccctgtgtgagaatcgctgccctgtgtgcctgtgtgtcgcacgggccgcatgaacaagccttcaagtatctgtcttcatcatcctggccctttcgcctagcacagccctctcgccgccctcccacatttggggaggggaagtggaagacggaaaaagaatcctgtgggtttaaggttgagccgccttgaaatctggtttcaggcagctggctcccctgggctgccggctgggtgattacggaaccgcgtcccctcccattgtatacaccctgcggccgcggccaatgtcaaaccgcctcccccctcaggcctctgggcctggttttggagctggactgaggcaatacttccgtccccttcagtggagggggctcctcctaggtccctccccagtcctctggctttcagggttgagtcataccaaaatgaaggggttggcctgacaccgaggagtcctctctgaagccccaccttggggcctggggcctgggtgtgatatctgggggctaggctgcactctggtgggactgggagtgtctctgggtggggatccctggaggttagtggaggccagtgcggaggctggctatgaggaagctctgttcagggcatgattggagatggggctgtttcctgtgtggggggaccagtcagaatgagtcactgtttagcaattaaaaaacatacacatacaaccaacaaaaggcaggagggccaccacaggctggggcgggggcagcaaatacgatttgctgtataattagtttccaatcggatggactagccctgggtttgtgtgccaggataggcctctggtttcttaaaggaagtgtgtcctccaccccctgtgtcctccatccccgttcagggcaggcacagcccacactttccccagtattgggaagctgctgctattaataaagatggaagggctgggggaggaggccgggaaaagtgcagaggcaggagaaaggagggctgtccagttctgtcctgggattggcagtggaaaatgagaggaggggaaaggagatgtggctgaaaggaacaggggaggggcagcaacctgggcgatgggcggatgcctgcccgcacccacagtgctgctgtagctggtctgagttctagggatgtctttaattggggtgggggagaaaacgtcattatacctgacttggtgtaggaggatagctttaggtgtctgtgtttttgaatgtctttgagactgtgtgcttcgccctccaatgcacctgtctcctgtctctacagttcagggcacaggcaggggtgggtgggtggcatgtgcatgcagagtattccctggggtgccccccagcaggcccctcatttccagactcgtggattggatggaagcaggcactgaactttgtcggcaactccgcagggtgtgtgtgtgcgtgtgtgcgtgtgtgtgcgtgcgcgtgcatgcgcgtgctttcttgtgcctggtgtgggcaggctcagaagtagtgggttgcatcagggccagatgtgcaattctgtgcgttcagcagctgtgccctgcagtggcagcctgagcctcatccttctccaggttccccctccccaggcccctgattctttctggtgccccaggccactggggttggaaacccttcagtagcccagtgtcactcaagtatgagtttgacttattgaatgtggaggaataggggccctgcctgccctcccaggagggagaggagggggtgaaccataggaacctaaatggaagaaccctctgcactctctgtaggccaaacagggggagtgggtggagcgctcttccttggccccttttctcttcccggagggagtctgccttaaagggcctttgctggtgttgtgggcgagggccacagaattccccaggatacaggggcagaagcacagagacctggcacctgccttaaaatctaggctctgcttcttgtgcgtcctcttctgccctcccagggggattgctgacatgcctgtcaactggctagaaataggaaactctgattaacccctccctggtggcctcaccctcatatacttacagcatccacaggtgcacatgggccatagcctagagcagggacccagcaggagagcaaacaggtcctccatccatcctggggaactacaagggggactctcagaatcaggcccaagcaggttgttgccctaatcttcccttgggaagccagtgtgtcggccacattgccgaggcctggatactcactggatgatcccgagaccattgtctaggatgtgcctagatcctaaatgtgctctcccatgaggctgtggggaagctaagggcccaagatttggacatccaggtgggctcaggcctggcagtcctgagtggtcagacccctcctagcccccaggttcaggggttcatctaagcattgaaggactggtgggagctggggggcatccttatctcatgaccccccatgacatggaaagaagacccaagagcaggcccggttgcatgtgtgaggggcctgcaggtatgtggtgcgtatgtgtctatgcaggtgtatctgcttgagtcttgtgcagttacggttgtgtttctgcatcgtccctggtgtcccagagcaaggccagacatgttgctagggccctgttccttgcattttcagaggttcagagtcaagaagaggttctctgggggaggagatcccactgcttgggccagtgtggggtttgcccctgcttggagtgagggtatcctgtgcacattgccggtggctggaggggtcaccctgagaccctggagggaatcctgggtttcctctccatttatctgtctctgagtacgcagtgagagtgagggctggctctactggggctggtgctgaggctggggctgcagcctgactccagcagtgcaaacctcactgctccctctccctacagcagaccatactcctgcaggggtgtgtgtgtttgtgtgcacgcacgtgtgtttgtggtgtgacggtcatgtggccccttctttggccacccccgagtcttcgtggaaggaggccctggcttggctttctccgttgcccgtgaaagggagcctcaggcagaggcccagctgcccacccctaccccaggatcctgctgacatggccaggcacctgtcatgcacacactattattactctgccttctgcggccctgggtggctgcacatctgtgtctgtctgcaggtgtgtgtgtgtgtgtgtgtgcgtgcatgtgtagccagcacgtctgggtcgtgtatcttggatgtgactgatctttttgcatctcacatgggtgtctctgagaaggcgcagcctgcctgacttcagtccctagttgcgcagccgtgtctgcctgccgggcttgctgagcgcctgcgagttgaagttgagtgtgccttcctgacagttggcagcactactgtgctgctgtgtgagtgcccgctcaggtgatccttgcttggtggctgtgagtttgtcaggggtcctgggacttccccctgtggtggggttgttggggaaaggagggaaagatgggcttccccttggggtgagcctgtggcgggtattggaggcaggagctgaaagggtcctgcgctgttgtgttgggtgcagtctggcgaggcggagcaagcccggcttgggcccctgccccgggccgagcaggctggcctggctggcctcctccctggctctgggaaagccttcctttcccggctggcctggcattcaaagccagacaaaggggggctttctctctcgcctctttgttctgctgccccagagcgctgctctctgcatggcaaaagctaattccactctgcagctgggaagccctctctggggtctgccgggctcgcatctgaggtgctgcctctctccttgccctggcgcctgccctggagccccttccctctgcagcttgtggtttccccagcctggggttcagttcacatgatagcccaaggcagtggcttgaggcatggaaagggggtttagggcaggcagaagcttttctgaggaaaggggagagtgctatgagcgcagagacccagggagagatggggacagggaccagggggaggagtaggggagggttaggatggggtggctctgagaagggggctggagccagaactggagctggccgggcagggacctaagcaggaagaggctgcccagccccctcttcttgcccctccctgccctgcccctcccaccaccacaggggcttctggagctagccatggtcttgtctgaaaacctagggactgcctctgtcccagtccctggggccctgtttcctcctgaccttgtttctcttcaaggttgacttgagggttttattattattatttattaacttttatacagcccagagtccccaagcctcacccgtctgcccagtctagtctggcatcaaaaatggcagctggcctggccagtcagtctccagagggacatgaggctttcctggggcaggaatgtaggggctcagggttcgctgctccaggccgggaggggagtcagaggaagcagcggcaaagctgaggagtgggggcccaggtggtggagggtgggaatggcggctcctgattcttcatgcttttgtcctcataggccccgggcagatcaccaaaggcctgaggcccgacaggcagggctgggggtgtgaaggtcctccctgggccccacctagtcccagtctccctggtggcctggggcctccagagcttctagcccaggccacgttccactctgctctgctcctgcatgctccagtgtacgcagtccaggccatgcactgctgtggggggatggggcggtggcatgtgtaaggtgcctccagcccacctgcctgcgcagagagtacttgctctgaactgagctgggaaatctggtcggatctcagctatgggtttttcccaggtgggaagtggggccttggctcttagccattccctggggaggcaggtgggggttgggatggaaaggaggctgctggtggtggggggtctgggccttgcttcctctgctccctgttttccagcattttccagtgtcttggcaacctgatttgctcattcggtgaactggggtggggtcgtgaaggggacggcaggcaggtatttcccatcttccttccagtttcccaggcttgaagcggcagcagctcccactgttctcccaggcgctgtctgtagcaggagttggccctgagggagagcaggccagaccagtgcagccccccggactcctccctggctggcaccccctggccagcctccttcctcttcctgctctcactccaacccctgcagcagagacaggagcccagtggcctcagcagcaggagggggaaatgaaaccctcccacctgctagggactgtgtggcctgggctggtgtcccacccagattgcctgggacagacagaagcttgggaagaccctgccggctcccagggtagaagtgctgtcaggggaggctgaggaaagcccggaagaagagggaaggggctgagccccacccccccaggactggacaggaaggccctccctctgctgtgccctgaggggtcactccctgggcatcagcaagggatggggcaaaggggcacccaccagcctgcggggtgggtgtggacagctcagttcctgtccccaaggaagctgcgctgggaccttggagctgcctctttcctacccctcccctgggactcacctgaatcctccctgaaccagctcctggtgggtttggtcgtggagaagcagccatgcagtaagcctgtggtgtgagatgtgtggggccagcagggcctttcagatgtcctgggcactggatggagggatcagcctggactctgaagagcacctggggggccctgtcctcctgagggtgggcttggggcaaccagcaggcaagaatttgagggccaattgttccaggggaggtcagtgggcctgatgttcccagagtgtcctggccacctcgccatcgtgccaggcctcttgccattgtctggggcctccaggaggtccagccttccctgtgagggggttgggtcaagtgcctttgcacctctggctgtgcccgccagcatacctgaggcgggctcggggctcaggtggcaaggtattcccatgtgcgtgcgcagctttgtgccaggtgcccctgcgcctgcccactcatgctgtgtgtgctgtcgggctctgacccttgggctggcagcagattcctgtgcctcttggtgcttctgggggcagggcaaggtctcccaggcctgattcttttagaggtcctgtcctgggtcactgaaaggttaagttgtgtgtgggccccctgcacccagcttataaggtgaaagcctcacccccacacttcctcctgctcccagggttctggttttttccacagtagcctccaacacaaaatagggtcaggctgaagtctgtggtgggccttggtttgcccctacgtaaaatgggctggcggggtgaggaagggattgatggcagcttgtcttcggggagccagctgggagtggctgggatgggagtcatggggttgaactggagggttactttgaggcccccacagaggaagaaagagaaccactccttgcagcatgacagttactgtgaatgtctgtggttacacagagctgctttgcaaattttagtttgtgtatggaacccatgggcttattgagtgaatttgttatgcatctcaggccgcccaggcctttgtgtggcctgcctctgaaggaaggtggagaaagacagcagcaaatccccattcttaagaggccctgtgtcttgtagggagatgagaccatggtttgtgaggcaattagaagactccagaatagtgctgtctaatagaacttctgcatgatggtaacattttataactttagtatctgagactagtgatacgtaggtactgggcacttgaaatgaggttggtgcatgaggaaccgatacttaacttttttttttttttttgagacagactttcgctcttgttgcccaggctggagtgcaatggcgcgatcttggctcgctacagccttcgtctcccgggttcaagtgattctcctgcctcagcctcctgagtagttgcgattacaggcatgcaccaccttgcccagctaattttgtatttttagtagagatggggtttctccatgttaggctggtctcgaactcccgacctcaggtgatccgcctgcctcggcctcccaaagtgctgggattacaggcatgagccacagcacctgaccttattttttattttttgttaacttggatttaaatagccacatatgactagtggctaccatattggacagcacaacctgagagggagggcagaatgggacagccccaccccgtagccaggacagggagggacctgcacaggctcagagcaggggtcatggaaagtttcctagaggagtggggacttcagttgggccttgaagaatagacaggggagggaggaggcactgtgggctgcagaagaatgtacctagagctacagggagtttccatgtgtggagggctggggacaggataccagcccagctggctggaagagtcagggtgtaaaagagccttcattgccatgctaaagtagttgataggacggagtcacggagagtttttgagcaggggagagagcctgtctaaagaggcatatctggtgagaggagggcaggagagatggagtgactggcaggaaaggggttgtggggacaggagattatgagctgagaagagcactttggtccagcaccttccagcagcctggcctcaggtcttaggagacctcaaatctcctttctgcctgggtcccactgagggggctgagggagctagccaggactccagagtcctagctctcagtcttaagaacaagggagggggtgactggcctgatgccccctaatgtaaggcgagggtaaagtgagatctttggactgggacagaggttcacgtggctatggaagggaatttgaccccctgcatcttagggtactcatctcttagaggatgctccccagggagaggcagcacagcctgggtaagaacggaccctgctgccagatcacctgtgtttgtgcccaagctctgctatttacaagctgtgtgactgtggacaaattacttaacctctctaggcctcagtttcctcttctgtgaaatgagaataatgatagtacttatctcatgacattactgggatgattagataaatctgtacaggaaaagtgtttagaacagaggttggtgtagccctgccctcagaaagctcagggtttaaatatgcatgggggctgggcatggtggctcacgcccataatccccgcactttgggaggccgaggcgggcagatcatttgaggtcagtagtttgagaccagcctggccaacatggtgaaaccccgtctctactaaaactacaaaaaaattagctgggcgttgtggcgcacgcctgtaatcccagctactcgggaggctaagacaggagaatcacttgaaccggggaggcggaggttacagtgagccgagatcgcaccactgcactccagcctgggcaacagagtgagaatccatctaaaaaaataataagataaataaatatgcgtgggaagctattctggggagagctgggaataggcccctgggattggagggggccaaaggggctgggtagcagaggcttggtgccatcgggtcaaaggatccataggatgcatgtgttgtgtagagggaagcatgggtcagggttggagccacagtccctctgatactcccacccaaatgtccctgcagaagatgctcatgaagcagcaggaccggctggaggagcgagagcaggacattgaggaccagctgtacaaactcgagtcagacaagcgcctggtggaggtagctaagcccaaggccatgctgcggggtgggggtggcttgagcgcagggctttgggtgagttccttactaaggattgattgtgtagccctatgccagaaccactccatcagtcattcaatcaactgcccgtggatgcccactggtgccaggggatgctggcccagagccctgtgctaccagtggggaactggcaggtcagaccttgcccttgggagcctggggcagcctggtgacttagggttctaggatgtgagaagggtaagagggggggaaaccaaaggtttccagtgcttacctgcctgcccactcctgccctctgtactcgcaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaaggtgggctgggctcaggaccaggcggtggcacccagagggccatttccaaattgagatctgcagtttcctgcacctgtagctcacatgcccttacctttggagccagcatgcatgggttcaaatccacctgcctgctctttctagcactgtgaccttgggcaagtcataggtacatcccgggccttgttccctcacctacgaagtggtgttgatgatacaggtctactattctttatccacaattccacatttataaacatctctggaaactaaacaaattttggcatctaatttaacagcaaaaattgacctaaactgatgttaggcaatttatggtctttatcttgcttagtatgaaaattcaaacattttgctgcagaaatgttgctgtattagattgttgtgtcttgctggggatgataatgtaatatatgatacaggcactgtattctccgtctaaaatccaaaaaattccaaattccaaaacacatctggccccaaagacttgagctaaaacagtgtgggcctgcagagcccttctcctcgggtatggatgaagttatggatgcacagaaagcacttacaatgcctgggtcacgtggcaagagctcagtaaatgttagctcttcttccgcaaatggccacccccacccctgccactttctgtccagaatgagaggatccacccagcctgggggaggctcagggggggcagcttttgtcttcccctctccccgggctctccctggactgcttttccactgacttgactcttttctctccccaacagaacaccaagtctgtgaaaatcctgatggacaggtaagctgagggccctagccctcccgggggcacatcctggggagggcaggggggccaggcccatggcggggaggtagggcgggctcaccggtgatgcctcctcacagcagatgccccgtccactgcccccaggacccagacctgcacgagcagcagcctttcccccactaagatcggccacctgaactccaagctcttcctgaacgaagtggccaagaaggagaagcagctgcggaaaatgctagaaggtgagggtggggtgttccgccgaagggagacagggacctttggggaggggttcagcgccacagccttccctccaagaggcagtgtggcccagtctgggagacctgtcctcatatccaggctttgccacttgtagctgtgggacagtgggtaagcaacatgacctccccagcctccatttcttcagcttaaagtggggatataactattctgtacctcctaatggtagaggagcaagcatcacctgagatgtaacattcttgggcctctaggtgtcaatggtccccaggtccaacccagggagaggaggcctgggttgcttggggtgggagctttggcgacttttgccccaactctccacaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttacccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagccctccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtcccactccctgcctcgcctgttcccctatcccccccaggcctgggatcttcaggcgtcggtgtggggaggggcccctgccctccttgccttgattttgctcccctgggtccagctggttccaggcctgtgaatgtcagttcgtcgggcactgactccgtctgctcttggccttgggttcatttgacaaatatttgcccagggcctcccaggcccagccccatgccacctgggccccggcatctctttgaggttctgccaatgtgctcttagctgaggacgaaggaggaacacctttctatgagtcttgcaaagtttacctccttcaggccacaaatatttgagtgcacactacgtgccaggcactgtgcagggctgcaggcatagagacagaatgtaatctagctgggccttggaccccatagggagaggggaccactcaggtccatacttcctttggacttggggctttggccttgggaggggtggaggtggggtggcaagatgaaaaagacatcctgcccccatccacttcggcagagcttctcaaagtctcaagcatgtcttgggagcttgttaaaagggccgattccttgctgtggctcacgcctgtaatcctgacattttgggaggccaaggcaaattgcctgagctcaggggtttgagaccagcctgggcaacatgtcggaaccctgtttctacaaaaaatacaagaattagttgggcgtggtggggcacaccacacctgtggtcccagctactctgggactgaggtgggagaactgcttgagcctgggaggcagaggttgcagtaggtttagatcaagtcactgcactccagcctgtgcaacaaaacaacagagcaagaccctgtctcaaaaaaaaaaaaaaaaaaagggtaagggtgctgattcctgaggcctagcttagactcatcgggaatctctgagagcccaggaatttgcatttttaactctattctcccatatcctgggtttagagaagtgctgccattgtggtggtcagggtcctccctgctgcttgtcacagaggccactgcggggagaggaagctgggacacccccaaggcccttctctggagaggggcctcaccttcaaaaaggctccggttgttgcctgatgctctgcacagagctgtaagtccgcagcccatgcacttctgtaatctgctgggtgcctagttatctttcttcttgtttgggcagaatccgggcctgaatgccacccaccccaggaagcccaggacaaggcagacagccttgtaaagtcccattcctgccaggcgcggtggctcatgcctgtaatcccagcactttgggaggctgagatgggcggatcacctgaggtcgggagttcgagaccagcctggtcaacgtggtgaaatttcatctctattaaaaatacaaaaattagccggcatggtggtgggcgcctgtagtcccagctactcaggaggctgaggcaggagaatcgcttgaacctgggaggcagaggttgcagtgagccgagatcgtgccactgcactgcagcctgggtgacagagccagactccatctcaaaaaaaaaaaaaaaaagtcccatgccagtggtccaagcctcactgacccctagccacccctcccctcagaaaaataaaggcttgccgagcacgttggctcatgcctggaatcccagcagtttgaaggtggatggatcacttgagttcaggagttcaaaaccagcctgggccacatggtgaaaccccatctctactaaaacgaaaaattagccaggcgtggtgccacgggcctgtggtcctagctactctggaggctgaagtgggaggattgcttgattgaggctgggaggtggaggttgcagtgagctgagatcttgccactgcactccaacctgggcaacagagcaagatcctgtctcaaagaaaaaaaagaaaaataaagactttggggctggccagaccaaaccatagccttggtcttgctaact

SEQ ID NO: 13514 - DNA, 47698 bp, Human
  misc_feature (1)...(47698): n = A,T,C or G
ctcgatctcctgacctcataatctgcccgccttggcctcccaaagtgttgggattacaggcgtgagccactgcgcctggcagggggtaattctttgttgggaaagaaaatagttaattaaaggaagtttgggagtatacttcccaggggaggccagattgtatttttggctgaggacgagttctggacagttttctgagggttttttgggtgtgtgtgtgtgtgtgtgtgtgtgtgcctttactagtgactcaggtcacagttttctgagattttttttctcccctcaagacagaatcttgctctgtcgcccaggctggagtgcagtggcctctcggcccactgtagcctccgcctcccgggttcaagcaattttcctgcctcagcctcccgagtagctgggattacaggcacgcgccaccatgcctggctaatttttgtatttttagtagagacagtgtttcaccatgttggccaggctggtcttgaattcctgacctcgtgatctgtccgttttggcctctcaaattcctgagattacaggcatgagccaccgagcctggccagttttctgagtttttatttgaaatcaaaataagctttttttttttttttaatgggctttagagtccagggtaacgaacactttttggtgcctattactgaaccattcagggtattcctggggtggtgaccgtgttcatttcagaaaccaacatgttcatttcagaaaccaaactcgggtaacttttgataagttcatcaactaaggcccatggcagaatttgagggctaaggggtgtaattagtgtatgggtagaaataagtgccttctttctatattttggcgttgtaggaatttaaagtgattctgcagtaagtctcaggagacaattttcttagttcttagaagttggaagataaactttggacaatgtattacactatgccctttgtaattaaataactcaagataatgtgttaaagtttagcggagatttaaattcctgagctgattaaagagagctgttaaggccataggttttttaaaaatgagttaatattactcccagaaattgtaggcactatatagtgatgaattgcatatttttattgcttattattttccagtcttgcagaatggctcagggttagtagcaactaaaagataatacattacaattcaacctgaaggccgggacgaaggtaggaattggattttaggctggctctgggctgtgtccctcccatccatgggatgtggagccattgaaggttgtggggtcacgatgcaggtgctgtctcagaaagatacatccgactgtgtgtgcaaatgggctggggcggagaagagagagagaggtagagtccatttggagactactgcaatagccaggctgacgagttaagagcggggcacagtaagaatgggaagaaatctaagaagaaaatggtagtgcgcggggccaacaatggacgatgaccgaacccaggtggggatgggtgagtgacgagaagaaccgctccgtgccgtccagggagccccttgacttcccttctgttcttagagcggacgtcctcctaccagcccccaaccagcgccaccagggtggcgcaagcctcaagctggtcaggtcagcaacagccgcaacggaggcaggagccgacacgctcgtaccccggccccctccccgcccccgcacccccggcagtccctccggtttgaccactccccccggtcccttgcctcccccgacccccagcctccgtcggccgccggcaccaccctccgcccctctccgccccctcccccgtggggcgctgactcgcccggctgccacgtctcactgatgacatcactagggcagctcggccttagccaatccgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctggggcgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatagtgagttcaggagagcaccggtcggctgggtccgtgggccagcttgggggatcttaaaggggtcgaggagggttggggcagaagtcggggcatcggctggggtgaggcgagggtgatgggtcaggagaggctggcggccgggagtcgggccccattgtctgacgcggaggggcggccgcgcgggggaggggtcgggccggaggggtgagccgcccgggcctggaccgggtcaggttagagggcctgactgcggggcgggtgctgaggaagcctgccgaggggcctggggcggtgtgaaggggtatcttctctcggaggcagtgacttttgaaggaggacttgtctctaaggggaggggatggggtgggagagcccttctagagggcactgtcagaccctgcgcccgcactctgcggagctgtcaggatcttcggggtagaaaccagctttacttgtaaatcctgagcttgttgggtctctctccttccatcctccccgccaggtttcaggtaatatggatgcttttcgggactgcgtgggattgaggggaatgagtagatggtgagaagcaactgaacatttattagttctctttttgagttgtgtcttggaggagttgtttaagagctcgccgggtccattgccctcctataaaaacctgggcatttgtgagaattttgttttttttttttttaaagaggacacctaagtcattttgtcttctgtgggtcaagggaaaaaaaaaaaactaaagccaagaaatgtctttttgatactcgcagattaaaggaagcttgctgtcaagttgaaagagaaacgaacgggacctatgatagatctgtatgtaggttttggattacctgcttggatgcttgcagatagggaatgaggttccatgacgtgtcatgaaaagttaatgcatttctttttcttgcttactcaagaagtcaccacagcagatgtgacacacctggcacctttcctgggaactggtgttcacttcccttgggtagagtttgttgggctctcctcaatggccctttaaaaatttcctctacagtttacatgcatgtaaagtaatgaataattggaagagaccgaattggtattccttttcagtgtcaaaggcctttgagggatgggggaaaatcagtatttgttgtaaaagttgagtttatttgctggtttggtcaattactgctagacattttcccctaaaaggtccacccaccagtttagctgactgtcatatgtgtgtcacatggctcttgcaaaatgcttacaagttttgtaatagtgtggcttgaagctgaaatcttttgcactaaacagaaaccgtagtattttattagaatttcatgctttagaagttgagggtagtgttcttgtagtgacatttgctgtgttgacagtttaaaaaaatttttttttcaagggctccaaggacaaagttggttttgcacagttgaacggaggtgaacttgaggttcttaatttagtagttttcttggtaacaataaagaacatggatttactgctttatcgaggtttatagacctctactgttcaggaaattttctgaatttgctatatatatgtttattagtgtaaataaatcttcaagattagttgagaactttgacaagttactcagcctctgaattttttttcccttttgtaaaataggataattggagtcattattcctgtcagggtagtggtgaaattcaaatgtatataaaagaatttgaaaaactgtgtgagcattcttcaggtggtatgcatcattttcatgaaaggcattctattagtaccaggatttaggaatataatccttgcgcttaagaagtttagatataggccaggcgcggtggctcacctcagtaatcccagcactttgggaggccgaggcgggcggatcccgaggtcaggagatcgagaccatcctcggtaacacggtgaaaccccgtctctactaaaaatgcaaaaaaattagccgggcgtggtggtgggcacctgtagtcccagctactcgagaggctgaggcaggagaatggcgtgatcccgggaggtggagcttgcagtgaaccaagatctggccactgcactccagcctggacgacagagcaagactccgtctcaaaaaaaaaattatttattgttttgagacggagtttcaatcttgttgcccaggctggagtgcaatggcgcaaatctcctctcaccgccacctccgcctcctgggttcaagtgattctcctgcctcagattcccgagaagttgggattacaggcatgtgccaccactcccggctaattttgtatttttggtagagacggggtttctccatgttggtcaggctggtctcaaactcccgaagtgatccgcccgcctcagcttcccaaagtgttgggattacaggcgtgagccaccgcgcccggcagaaatagattttatacatgtcaaataccagtagatatagcaaattccagatgtgtggcatggatgagagcaacaagatttcagggggatggtgggttgtggttggctatctgggttttggaagactttatagaagagagacctgaaagggatttatcagcaattagatttggaggaacagagggagtgactaggaattttcaagggggagaagaaggaggaatggctcataaatgacaaggacagtaataagtaaatacggtgtcaaatcatcctttcttttgaagactaatgacctcaaagggatcaaacccagaaacagtttttatattttttctgggatcaaatacatgggtatctggcctactatatttgtattctagactgtttagtaaaataatacaggaatttgagaaaacctttgcaaaagtgttagtgaaaattacttagggtgagaggaagtgagggatattttattaggggaggtcacaagggcagtgagcaatcagatttttagtaatctgacttaagcagtttctttttgttttaatgaagcttgttatctttataaaagtaattagagaaaatttggaaaataaaggaaagaaagaaaagttctttagtgttttatcacgcaaatacaagctcattcgtttttaacatcttgttccaaactccaaagtcttgctttctcttcaattaaaactttaatgggtggatgcttttcctgcttccagtatgttatcttaataactaacaatggtatattagctaatgtttacaaatgtactccagatgttccttaagttactttggtttatcattaccaatttatattgtttcttttagaaatttataatctttgttaatgggttctgctaaatttggtagtgaaaatgggatcttgagaaaaaagattctgaagcaacagaatttttagatttatattggtttacataagagttggtagctgtattactttttttgtttgttttgttttttttttgagacggaatcttgctctgtcgcccaggccttggcctcccaaagtgttgggattacaggcgtgagccactgtgcctggctgtttgtgtttttttttgtttttgttttcttttctttttctttttttcgagatggagtctcactctgtcacccaggctggagtgcagtggcgcgatcttggctcactgcaatctctgcctcctgggttcaagcgattttcctgccttggtctcctgagtagctgggattacaggcatttgccaccataaccagctaatttttgtatagagtacccagccatctctaatgttgatcaggctgaagcaggtggatcacctaaggtcaggagttcaagaccagcctggccaatatggcaaaaccctatctctactaatacagaaaattatctgggtgtgttggctggcgcctgtaatcccagctactcgggaggctgaggcaggacaatctcttgaacctcggaggtggaggttgcagtgagccgagatcacaccattgcactccagcctgggcaacagagcaagacttgtctcaaaaaaaaaaaaaaaaaaaaaaaaaaggcaattgaaagtgtaatctgaacagttaaaaaagtagatagaaagggttaaagcttttttttgaggatctgaagaaaaatgtggattttttttgagctacgttttgaagcaggcagtgattatttcagcacattaagaaatgcttaacatggccaggcgcagtggctcacgcctgtaatctcagcactttgggaggccgaggtgggcggatcatttgaggtcatgaccagcctggccaacatgatgagacactgcctctactaaaaatacaaaaattagctgggtgtggtggtgcacgcctgtaattccagctactcaggaacctgaggcaggagagtcacttgaacctgggaggcggaggctgcagtgagtccagatcatgccactgcactccagcctgagggacagagtgagactcctcaaaaaaaaaaaaaaaaaaagaaagaaatacttaacattattctcgtgattattctcataacatttttcataatccactggcttccagtggatttttttagtgtcaagaaaataattttgattggttcatctttaaggaatgtgttaagaataaagcatgtctacctgtcttcagtataccagctaactatagtaggaagaaatatagtagtctacttagatcaactataattctttaatgcagaaaaagtttaaagtatttaccttatttttagcccccatccccttaagtatatcatggctccagaatctctgaaaatgttatcagtctttcagactttgctcttctttcatgttatactcaagaaacatttgacctttttttttttttttttgcttgcattgtgtttcaaataatttttaacaaaacttaagtgtttgaaagtgaaagcaggttgtctttgtgacttttggtggtggtttgaaaaactcagaaaagtttaaagaagaaagataactagtattctcattgtccagaatatgattttttaaatgtctatagaatatcaccatctgtaattcttccggtaatttaagtattcagtagttgtataaaacctttaaaatatatatattgagaattttgtgtgaatgagatgatgagataatcttgtaggatcatttaaagataagaactgaggcctggcacagtggctcatgcctataatcacagcactttgggaggcccaggcggtagatcacctgaggtcaggagtttgagaccagcctggccaacatggcaaaaccctgtctctactaagcatagaaaaattaattgggtgtggtcgtgcctgcgtgtagtcccagctgcttgggaagctgaggcgggagaatctcttgaaccctggaggtgggcattgcagtgagctgagattgcgccactgcactccagcctgggcgacagagcaagactctgtctcaaaataaagtaaaataaaatgaagataacaactgaaatttcacattaaaaatttttttgtagcgactgtgcctcctatgttgtgcaggctggtctcaaactcctggcctcaagcgatccttccaaagcactgggtgggccaccatgtccagcctgaaattttgcattaaaaaatttcccgcttttggctgggcgaggtgtctcacgcctgtaatagcagtttgggaggccgaggcaggcagatcacttgaggtcagttctagaccggcctggccaatgtggtgaaaccctgcctctactaaaaacaccaaattagctaggcgtggtggtgtgcgcttgtagtcccaagctactgaggaggctgagacaagagaatcgcttgaatctgggaaaaagaggttgccgtgagccaagattggccactgcactccagcctgggtgacagagtgagattctgtctcaaaaaaataaaaaataaaaatttccccctttaatcaaattaagttaaaatgagggatgttagacagtttttaaccatcaaatattttagtttagttttttttttttaacgttgtcttaaagatggaagtgcttcaaaatcaaatcttccttgccagttctctacttggcttctttttttttctttttgagacagagtctcactttgtcactggagtgcgttggcgtgatctcggctcactgcaacctccgccttccaggtttaagtgattcttccacctcagcctctcaagtagctgggagtacaggtgtgtgccaccacacccggctaatttttgtagttttagtagagacagggtttcactatgttggccaggctggcctcaaactcctgacctcgtgatccacccacctcagccaaattgctgggattacttgtgtgagccacgcgcctggcttctacttggcttttaaagggaattttgctttctgagtaattttatttctcaggtatcttggtctttttaattctggaagcaatcttaataatttatgtatgtgccctgtaatcccagcactttgggaggccgaggtgggcgaatcacgaggtcaggagatcgagaccatcctggctaacacggtgaaaccccatctactaaaaatacaaaaaattagctgggcgtggtggcaggcgcctgtagtcccagctacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttctgttgcccaggctggagtgcagtggtgtgatctgggctcactgcaagctctgcctcctgggctcacaccattctcctgcctcagcctcccgattagctgggactacaggtgcccgccgccaggcccagctaaatttttgcattttttagtagagatggggtttcactgtgttagccaggatgatctcctgaccttgtgatccacctgcctctgcctctcaaagtgctgagattacaggcgtgagccaccacgtctggccagaatagctttcttttgtggcaagctatatactttcctaatatatgaacatgtttagggtaaaataagatgcttcttaacgttttgagatttaaaaaaaatttgctaatcaactttgagtgtctgttttttgagatatagggtcttactctgtcacgcaggctacagtgcagtgatgcaatcataacttactatagcctccaactcctagccgggtttcagtgatcctcccacctcagcctcctgagtagctgagaatacaagcgcgtgccaccacacctggctaattttttttttttttttgtattttttgtagggatgggatttcaatatgttgccccaggctagtctcaaattcctggtctcgagatccacctgcctcagcttcccaaagtgctgggattataggcatgagccccacgcttggctgagtgtcttaagatgaagaaaaactgaaaatgggtgtagtgtgccagtgcatgaggtattttaaatgtgtagcttaccagcttttttttttttttttttttttttttttttgagatagagtcttgctctgtcacccaggctggagtgcagtggcacaatcttggcttactgcaacctctgtctcccgggttccagcatttcttctgcctcagcctcctgagtaactgggactacaggcgtccaccaccacggccagctaatttttatattagtagagatggggtttcaccatgttggccaggctggtctccaactcctgacctcaggtgatccgcctgccttggtctcccaaagtgctaggattacaggcgtgagccactacgtttggctgcttatcagctttttaccactttgtcgccactacattttggaattttcctttgagaattaggcaaaatgcccagactcccccccggcccccgctttagagggagaggggagcaattagactattcctttgtttccctatagaaggtggggctgagattactgctttgatatctggaatgtaatttagggaagaaaatttaggtcttggcctttctttggaaccaccctgggagtgttgcagattattaatagggtaatggtggaatgatattcaggggaaaaatggtcctgaggagccagagaactaagtgttagtttgttggctgactgaaacatgtgagagatagggtacagaagaagtaggaaatagttttccttggtacttctgtgacaggttggctcaattggctggaacaccctacactgctttattaaatccaaggttgtgataggttccagttaagtttactgtgttctatgcttgtagatttcctaattaggacaagtagtgttaaatatgcatgcctttattcacaagagggaccattcttttggaaacatcactttttaataatactaggtgctatttagcacttactcggtgccagccacgtggctatggttttttttttttttttttttcgagacatgatctagctctgtctcccaggctggagtggtggtagcacagtcatggctcactgcagtctcaacctcctgtactctagtgatcctcctgtctcagcctcctgagtaactggcaccatgcctggctaatttttttttaagagatgagatgtcgctatgttgcctatgctggtctcgaacacctgggctcaagtgatcctcccgcctgagcctctcaaagtgttgggattacaggtgtgacccacctcacttggccatctatggtctttacatagggcattttgtgcagtctgcgtctcaaactagtgatcttcaacagtgaaactcagtgaattatgtaattcatgttttccaagaacaatgatggatttaatttctctgaatgtatttcctttgtataataatagtacttaagtggaattactctttgtcctttctactctccttatagatattttctggtatcttgatttgggactgttacatttaacccatttatggtcgtgtagccatactcacgttacatttgatgcatctgctccctttgtgtctatatactcatataacattttgcataaagttataggcagttcacaccaaggctgttcatgaacctcagattaagaatacttgatttaggagattgaaaacagaaaagagaatgttaactatcattatcaatattaaaatgtgaaaatctgagagtgacaaagcttagctttaaatctggtatcccaaactcatttgagtttttttttttttttttttttttttgagacaaggtgtcgctttgtcccccaggctggagtgtagtggtgtgatcttggctcactgcaacctccacctcccaggttcaagtgattctcctgcctcagcctctgaagttgctgggattacaggctgcgccaccacgcccagctaattttttgtatttatagtaaagacggagtttcaccttattggccaggctggtctcaaactcctgatcttgtgatcctcccgcctcggcctcccaaagtgctgggattacaggtgtgagccactgttcccggcctaatttgagttttaaaatgtggagtttaagatgttagtcttaaagtgggttagatgaaatttataaaaatagtcaaatagctaaatttataaaaggccatttgaaacaattttgtgaaatatataatgtggataattatgtagtgctttatgtgtagattggtggttagcatctgcctgatgaagagcagttggatttcttacttactaaagctagtgaaatctgaactccaaattaggcatcttcaccaggcttttttgagccgagctaacttactctcttttttatttttattttttaattaattaatttttttttttttttttttttttttgtagagacaggatctccccatgttacccaggcttgtctctggctccttggctcaagcagtcctcctaccttagcctcccaaagtgctaggattacagctgtgagccactgcgccaggctgagcttattctctactaacacaagtgttctaatttaatttaagcagtgaatcacacttttctttgtatttggtcaggttctgggtgctagtttatatatgatttgattcattctgatagggtttttttgtttttttttgtttttgtttttttgtttttttttgagacagagtctagctctgtcgcccaggctggagtgtggtggctcgatttcgggtcattgcaacttctgcctcccacccaggctggagtgcagtggctcgatttcgggtcattgcaacctctgcctcccaggttcaagcgattctcctgcctcagcctcctgagtagctgggattacaagcacccaccaccatgcccggctaattttgtgtatttttagtagagactgggtttcaccatgttgaccacgctggtctcgaactcctgacctcaggtgatctgcctgccttggcctcccaaagtgctgggattacaggtgtgagccaccacaccaggcctcaagaactttttatttttgagacagggtctcactctgtcacccaggctggagtacagtggtgagatcatggcttactgcagcctggacttcccaggctctggtgatcctcccatctcagcccctggagtaattaggaatatagacacacacccatgcctggcagtttttgtattttttttcttttttctctttttttgtagagactgggtttcacatgttgtatcaggctggttttgaactcctgagctcaagcaatcctcactctttgacctcccaacgtgctgggattacaggcatgagccactgtacctggccttttctacattaaaaactttttattaaaaaacccaaatcttccttgtggttgtatatacatatatacataggtacacacatggagaattttaccttggaggaaggcttggtaaagaaaatagccctttgggccgggtgcgggggctgacgcctgtagtcctagcactttgggaggctgaggtgggcggattgcctgagctcaggagttcaagaccagcctgggcaacacagtgaaaccctgtctctactaaaatacaaaaaatcagctgggtgtggcagcatgtgcctgtagtcccagctacttgggagcctgaggcaggagaactgcttgaacccgggaggcagaggttgcagtgagccgagattgtgctactgcacttcagcctgcgcgacagagcaaaactctgtctcaaaaaaacaaacaaacaaacaaaaaaggaaaatagcctttctctatcatcagagtatattaagagttgagtttttttttctgttttttaaaatttttgttgtttattttaaattacaaaacatggactctgcttacaaattaagaaaatgactcatgttcaaacaagcataatcaatataacagttaatacaagttaaatattgtaatatgtttacggaatagcatggcaaaatagtgcaaaagatttggggaaggggcctataatttctgttaacagaaagttttagttatgttgattcaactggagaggaacagagctcccagaaggactccagaacacttgatgcttgtctgagtggggtcagcagcactgagttcccaccagccagaaagtttgtgtgtgtacattatttcccttaactgccacaataatcccatgaagaaaatgccctagttttacaaacaaggaaacagaggcagagaagagttaaatgacttgcccaagggcattcaaagtaagcaactgaattggaattttaactcaaaggcttggatgtcccactacaacaaataggctgtttctgctttactacatgtgcttacttctaagaatttaacattttaggctggttgtggtggctcactcctgtaatctcagcactttcggaggctgaggtgggtaaatcacttgagctcaggagtttgagaccaacctgggcaacatggtaaaacctcatctctaccaaaaaaaaaaaaaaaactagctggacgtggtggcacgcgcctgtggtcccagctactcaggaggctgaagtaggaggatcgtttgagcctgggaggtggaggttgcagtgagcccacattgcatcactgcactctagcctaggtgacagagtgagagcctatctcacacacaaaaaaaagaatttaaaattttagtcaagtaattaggcactaacattttgtggtcagttactttacgaattcatggttggaggcctgatgtggtggctcatgcctgtaatcccagcactttgggaggctgaggcaggaggattgcttaaggccaagagttcaaatcagcctgagcaacctagtaagatcccctttctgcaaaaaatttaaaaattagctgggcatggtagtgtgcacctgtagtcccaaccacttgggaggctgaggtgggaggattgcctgaggccaggagtttgagacctgggcagcatatgaagaccctgtctctaaaaaactaaaaataaaaaatagccaggtgtggttggtgtgcttgtggtcccagctactcaagaggctgaggcaagagggttgcttgagcccagaagttggaggctgccgtgaactgtgattgcaccactgcacttcagcctgggtgacatagcaagaccctgtctctgtggtggtggtgggtgggggtgggggaaggatttaagaagggtttgtgaggtatgtattatttataaatgggcttttaactttacccttcacatcttgggttgaaattaattgtatccattctcagtttttctgtcttgctatatatttaaacttggagacttagaggtcatggatgtctttctatgaaaagcaaatgaagcagagggctgccttctcttgctgtagagggcacacttgctgcagagcatgttactgttttatgcattgctaggctttgggagttgtgacttgtatgatcatagtacttacaactattagttggcaatttttaaactttaactttagattatatatgtaaactcctgtgttcctttgtcactgataatctgaacagaagccttggataaataattttgaagtttttgtctgaacctctgaaatttgtattgttatctcatggttttgctgggaggaaggagaaataacaatggccacttactgtgcttctgtatgtgccagacagtatgtgctagatgtttcagaaacgtgatttgtaatcctgacaagaagcctaattgggtggtagtgggtgctaattgaaccttatagatgaggaaattgaggctcatggtggtaagtgaataacttgcaccaagatcctatggctggtatgcagtagagcctcaattcaagtacgggtcttccaggtccaaacccatgcaggctttgagaggtaaggaggtagagaacgttgacacccccttcttggtgtgtttttcagcaaatacttgtatgcatattaaagactgtctacccttttgtcatcttgtgtcacttgctgcttcctttggtactacccaaatttctttcagcatttcagctttgaatttttatttttattttatttaatttatttatttttttgagatggagtctcactctgttgtccaggctggagtgcagtggcgtgatatcagctcactgcaacctctgcctcacaggttcaagcaattcttcctgcctcagcctccttagtagctgggactggaggtgcccaccaccacgcccaactaatttttgtatttttagtagagatagggttttaccttgttggccaggctggttttgaactcttggcctcaagtgatccacccacctcggcctcccaaaatgctgggattacaggcatgagccactgcacctggccagctttgaatttttagaatactgttctaaacagaactatattggaacctggaaaattaatctattgtctctaaataccaaagaaaaacatgtaattttagtggttgattatgggaacaattttttttaagatggttcatctgaatggaagcatttttttttaattgcttgactatttctttaaatttggagaaaagaccattgccctctcagatttctggtaattggtcacattgatcatttatattgactgacaggctgctttgtccacagctgaaggattgtttaattttttttaaattataggaataatatgtgctcactgtaaaattcacagtacagaagcatatgaactaactaaaagttcttacctcttgtctccagcaaggagtaagtgtttcaacctgaaggttggttttgaattgtgttctgtggagcgtacttaaagtgagtgaagaagaaaaatttatgtcaatcatgatcattgcagctgaagtttttattgtttcaccccctaaaggttattaaaatagtatgtagtttagtagtcttgataattttcccttaagatttattggccagtatatcaggattttgttttaaatttgatatgtgagcttagttttatgctattttcaaataagacatttagaagaagataaaataacattcctgtcttagtctgttttctgctgctataacagaatagcacagactgggtaatttataaacagtagaagtttatttggcctgtggttctggaggctgggaacttcaagagcatggttctgccctttgtgctgtgttatcatatggtggaaggtggaaaggcaagtgggtatgtcaagacagagagcaagaaggggcttgaactcacttttataacagagtgactccagagatagctaacccacttttgagagaatgcattaatccattcatgagggcagagcccttgtgacctaatcacctctcattaggctctgcatccttaaactggtttttttttgttttttttttttgagacggagtctcgctctgttgcccaggccggactgcggactgcagtggcgcaatctcggctcactgcaagctccgcctcccgggttcacgccattctcctgcctcagcctcccgagtagctgggactacaggcgcccgccaccgtgcccggctaattttttgtatttttttagtagagacggggtttcaccttgttagccaggatggtctcgatctcctgacctcatgatccacccgcctcggcctcccaaagtgctgggattacaggcgtgagccaccgcgcccggccccccttaaactgttgtattggggattaagtatctaacacaggaactttggaggatacatttaaaccataagaattcctgtcatgcaaatgaatccattctagatgaaagagaatgaatttagtttccattgaactttataaataggccttttctaaggtacttacagctgatattataaaatttatatttgtttttataaatttgtatttgtatttctgtttgtacaaatacaattatacactatagttctctgctgttagattttttttcttccttagcatgtttccaaagggtggaatgttgaaagttgggttaatgtcaatcagctttcttttgtaaagtgttcattgacatgtgaaccttgtctgagaatctaaattttatttcatgaaagaagaaaacagtatattctcatttaacccagaatttaacttcatatacttgtggctgtattgggagtatgccattgctgtctgtttacaacctgacctactctacctacttagaagtaatttgtgttatgataggtgtgctgtgctgacatatgctgaacatatttgtaagggtgttaagtcattgaataaaacgcttttctcctcctttcaaataacattttttatttctggttataaaagtcatacaagcttactgcaggttgttaaaaaggtataaagaagaaaccgtcaatccattatagtcctacagtttagacttcctgctccagcctctcagagtgctgagatgagctagccatgcccagcccctcaaaagattttttaaaaaacaaaaatgaggttatactttaaaaaattctatattcctttcacataacagtgttattttggaggttttagaatttccagtagcattttagattcagaaacaagctgattcatcctctactttgtactttaggcaagaaaagaattttacctaaatagaattttgaactgaaaatctgtttttctaactttttatttaaagaatattgttccatgctttcacagtagtgacttttaatttttatattttttattttatttatttagagatgggggtctcactcttgttgcctaggctagagtgagtgcaatggttctattcctagctcactgcaaccttgaactcctgggctcaagttaccctcctgcctcagccttctaagtagctgggactacaggtgtgcaccactgcaccaggctttttttaaaggcatagaaaatggtagtgcttgcatacaaaaatggcgtaggtacatacatcagcggacatcaagactatgttcagatcataaatgtacatatatgtaccgatgccatttttgcacgcaaacaaataatggaaattgaactctaaactgaaatttgaaacaagggttctggggtgggccctcttgctgatttgtaattgaatgtatagttcaatttttccccatctgttaagcaaaagacaattctaatgttagcaaaaatccacatatcctgtcattgatcattttttccttaattttctttaagagatggggcttctctctatgttgcccaggctggtctggaactcttgggctcaaatgatcctccagcctcagcctcccaaagtgctggaattaataggcacaagctgctgtgcctggccctgtcatcagtcatttaacttcatgcaaactgagtagaataaaactcgtccttactgtaccttattgcttttgttttattgttggaacctccaatattgcgaaagtagaccaaaagttgacttataggaaaaactgatagcaaaaataatttttctcttgttgctgtatttcatgcccaccatccagttgttaaagcctactgttaatttctctcagcctcctcctttctgtccaggcttattctatgccattcttaccttaactgtttttagctttctcatagagtgaactttttaaattaaaataaaatatctgctcgtagtattataaaattcaagcagttcaacagaatttttcactaatagaaatacttgtacctcaaaagcagctttattttacaaacccagcccaatttgtgattagatttaacttgagaaaacatgaaatgtctctcatattgtttaaaaatatcataagtggctgggcacggtggcttatgcctataatcccaacactttgggaggctgaggcaggtggatcacttgaggtcaggagtttgagaccagccaggccaacatggtgaaaccccatctctactaaaatacaaaaattagctgggcatggtggcacacacctgtaatcccagctactagggaggctgaggcaggtgaatcgcttgaacccgggggaggtggaggttgcagtgagctgagataatgccattgcactccagcctaggcaacagagcaagactctgtctcaaaaaaaaaaaaaaaatcatgagctagcatttttgaagtgattgtttgtcatttttcgttttgttttgttttgttttttttgagatggagtcttgttctgttgcccaggctaaagtgcagtggtgcgatatcagcttactgcaacctctacctcccaggttcaagcgattctcctgcctcagcttcctgagtagctgagactacaggtgcgtgccaccacgcccggctaattttgtatttttagtagaggcagggtttcaccatgttggccaggctggtctcaaactcctgacctcaggtgatccacctgcctgggcctcccaaagtgctgggattataggcttgagcctcgcctggcctcctcataattttttaacctttataaaaaccttttctaaaaccctttttattttgaactaaatttagatttactgaaattgtgaaatcaatgtggagttcttgtatacccttctttccgcttttcctaatagtaacatcttacatacatggtacatttgtccaaattaagaaataaacattggtacagtgttaactatagacttaatctggtttctctaattttttcactaatgttctttttctgttctaggatctaattcagtataccatattgtatttagttgtaggccatgttagccaccttcaatctgtgacagtttctcagtctttccttctttttcgttatcttgacaagtttgaagagtgctgataggtattttatagaatgtccgtcagttgtctgtcagtttgtatttgtctgatgtatttttttttttttttttgagatggtgtctcgctctgtcgcctaggctggagtgcaatggcatgatcttggctcaatgcagcctccacctccggggttcaagtgactgtcctgcctcagtctcccaagtaactgaaactacaggcatgtgccaccacgcctggctaattttttgtattttagtagagaagcagtttcaccgtgttgcccaggctggtctcgtgctcctgagctcaggcaatccacccgcattggcctcccaaagcgctaggattacaggtgtgagccaccatgcctggccaatattttgagggatatactttggtgaggtcatgcagatatcctgtttctccttagttttatcgattaatttagcatttatccagtaaatcttccttgcagcaattattttttctttttcttttttccttaattttttttttaagagatgggatctcactctgttgcccaagttggaatgcagtagtgagttcatagctcactgcagcctcaaactcctgggctcaagtgatccttctgcctcagcctctcaagtagctgggactacaggcatagaccaccacacccagctaattaaaaaaaatatttttagagatgggggttttgctatgttgctcaggctggtcttgaacttctggcctcatgtgatccttctacctcagccttacaagtaggtgggaattacaggtgtgagccaccacacccagcattgcagcaattattaatgtagtgctactggtcattttctgtttttctcatttcttcagcatgtgttattgacttgtctcttccctcccatttataatcatttatactgctatgaattcatgagtatttattttgtgagttataatctaatacgtacttaatttattttgtgcctcaaattgttctggcttggccatttttttttttttttttgagacggtctcgctctgctgcccaggctggagtgcagtagcgccatctcttctcactgcaacctccacctcccgggttcaagcgattctcctgcctcagcctcctgagtagctgggactacaggcgtgtgccgccacacccgtctaattttttgtatttttagtagagacagggtttcaccatgttagccaggatggtctcgatctcctgacctcgtgatctgcccgcctcagcctccaaaagtgctgggattacaggcgtgagccaccaagcccgaccggctcctgtatccttttaacatgaggtgctgtcatcattttttccccctaatattttggccaaaaatgttaatcaaggatggcacaaattttctgtagctgtatctcacaacgaaagaggcctgattaaaaatgtaaaactaaaatgttctctgatctcttagcacatgctttgtaaaaggcacagtgctagatccttgtatacgtagatgagtaagtcagcttaccttccacacccacagatagctatgtcaaacgtaagggtggagaaacacagaccccaaacttctcgagggtagaaaatatgaggttatagtagattagaactacaaaaagctagaggaagttctgaactggaaacagtggataggatttactagaataatttacgagggtgacaattgtaaatcttcataggtttcttttttttcctttctctttttttttttttgagatggagtctcgctctgttgcccaggctggagtgcaatggcgcagtctctcctcactgcaacctccgcctcctgggtccaagtgattctcctgccttagccacccaagtagctgggattacaggcatctgccaccatgctgagctaatttttgtatttttttttttagtagagacggggtttcaccatgttggtcaggctggtcttgaactcctgacctcaggtaatccacccaccttggcctcccaaagtgctgggattacaggtgtgagccaccgcgcccagccaaatttttattggtttctaaactagcgtaatttagtttttttcacttaagtcaaaattatattattgtaggataaaaacttagtgatccaaattcatgaggaatgaagaataaatacatttaaagtcttaccatttgctaaattagtcttggctctttgtaccaaaattctgtccttgtgctctgtaattttatatttgtatattttctatcaacatttttactgtgtggtgttttgtaaattataaaaacgttttaaagcaaactcagaacaatgaattctcacgaatattcagtatatttacagttgagaaataaactacttctgtagtaggtaatttaaaatgtcccaatgcaagttaacgtgtcactgatcacgctattcaagtgtgtgtctttgataaggggaggtggggaagtttgtgggtttgattttatttgcctttctcatgtgactgttgtcatgttagtaaacaaatggtttgcgagagaaccagtagtcttttgcaaagattgtcttatacagagcactcaattcttcatattatttataatggctttaatttaagccttaaattattagaaactcataaataatttttttatttgtttttttgagatggagtttcgcccttattgtccaggctgaagtacaatgatgtgatcttgactcactgcaacctccgcctctcgggttcaagtgattctcctgcctttgcctcccaagtagctgggattacaggcatgcgctaccatgcctggctaattttgtatttttagtaaagacgggattgcaccatgttggccaggctggtctcgaactcccaacctcaggtgatccacctgcttcggcctcccagagtgctgggattacaggctcactgagccactgtgcccagccataatgcgttaaaataagagtgttatatttgtaaaacttaaaaaaatgtagtggttgaaaaaggtaatttaaaaagaattgactattaatttcttgaaaccataatgtaacttgtagtgcaattaggaaaccttcatgtttctttctttctttctttttttttttttttgagatggagttttgctcttgttgcctaggctggagtgtgtgatgtcagcgcactgcaacctctgcctcctgggttcaagcaattctcctgcctcagcctcccgagtagctgggattacaggcgcctgccaccacacccagctaatttttgtatttttagtagaggcggggtttcatcgtgttggcctggctggtctcgaactcctgacctcaggtgatccactgcacctggcccccgttcatgtcttttaaagctttatggttgctctgaaatagagttgttgattttttttttttttttgagactcctcttttgcccgtgctggagtgcagtggtgtgatctgagctcactgcaacctccacctcctgagttcaagcaattctcatgggtcagcctctcaagtagctgagattaaagctgcccaccaccatgcctagctaattttagtatttttagtagagatggggtttcaccgtattggccagggtggtctggaacttctgacctcaggcatgagccactacgcctagcctgggttgttgatctttaaggtgatacttcaggcaacatctgaggcccagtacagtcctttacttcaactggctccagtacagcaaattcagggaatgtttttgagtgtttactggatgcctggcgtggagttcagggagattggtacattgagtccagttgttgtgttgaaacttctgtttaaaaacctccctactaagtcccagctactcaggaggctgaggcctgagaatcacttgaacacctggaggcagaggttgcagtgaatcgagatcgagccactgcactccagcctgggcgacagagtgagactgtctaacaacaaaaacaacaccccccaaaaaaccaacctactatggtagtatcaatgctgtgatagtcttcctttcttcatacaggtaaattcttaacatatactcattgttaatgttcagtgttcagtattcttaagagtatttggggccaggcacggtggctcatgcctgtactcccagcactttgggaggctgaggtgagcagattacctgaggttaggagcttgagaacagcctccaacatgatgaaactcccgtctttactagaaatacaaaaattagctgggtgtgttagcacatgtctgtaatcccagctacttcagaggctgaggcaggagaattgcttgaacctgggaggtggaggctgcagtgacctgagattgcttcactgcactccagcctgggcaacagagcgagactcttgtctcaaaacaaacaaacaaaaaaagaatatttggggccaggcatggtggctcacacctgtagtcccagcactttgggaggccaaggcgggtggatcacttgagatcaggagttggagaccagcccgaccaacatggctaaatcccgtctctactaaaagtacaaaaattagcttgagcaacagagcaagactctgtctcaaaaaaagaaagaagaatatttggtttaattaagaaggaaccttatcaatagtagtaaagtcagccagctgaactgccaagtacaaattgttggtattaggtatcaatcatttattaaggataatattctacaatagcgatctttttaaaaattttaaaatctcaaactggaaaggatgtctagttcattctatgcttcagtcccctcttctgatttacttgtttagaagatttttgtttccttctctgacttctattttgctgctgactggcacttgggatttttaaaaaattattttcctcatatataattaaagacaataagtataacaataagtataatatggtaatttgctaaaacccaaacaatgttttaagtaatgcatatcattatgtaaacctacgtaatagttgaatattcacaaagataatcgcttatagaagttttatatcctctcttctttggcagtgcaattaaaacaaaaaaaataagttttatgtcttgtttacatgtaaataattttaatctaaattgtgacgtggttttcactttagcatatttttgaaagtaaatcaaaaaggacaaaatacaaaatcatgtatatcttctacaaaaacgatatataaattctaaggtttttgtccttttgaaattgcttaaaagaatgcatagaactggtgtctgagttgggaaggatctatgagggatttccttggagactgtgggtgaataataatgttgtcttagttccatgaaggaatctctggggatagtttttgagttaggcctggcaatgttagagatacataaagagagccttgttttatcactgggtgcggtggctcacacctgtaattccagcactttgggaggctgaggcgggcagatcatgaggtcaggagatcgagaccatcctggccaacacggtgaaacccgtgtctactaaaaatacaaaaattagctgggcgtggtggcgcatgcctataatcccagctactcgggaggctgaggcaggagaatcacttgaaccagggagttggaggttgcagtgagccgagatcgcgccactgcactccagcctgggtgacagagcaagactccgtctcaaaaaaaaaaagcttggttttcaatggttctgaaaaatgctttaatacaagtgtagagtgttagtcaagttttgcacttggataaacagcctgtgaatttatcacatttctagtttataatatgggctttcagaagttatatgaacattgttttgacgggagaattcaagctggatgctagagaaggatcgtgagaaccccttcattggaggagtgctatgaaattatttgatcttggaatttttttttttttttttttttttttttttgagacagagtttcgttcttattgcccaggctggagctggaatgcagtggcacgatctcggctcactgcaacctctgcctcctgggttcaagcaattcttctgcctcagcctaccaggtagctgggattacaggcatgcgcaaccatgcccagctaatttttgtatttttaatggagacggggtttcaccatgttggtcaggctggtcttgaactcctgacctcaagtgaactgcctgcctcagcctcccaaagtgttgggattacaggtgtgagccactgcgcctggcctgatcttagaatttgaaggagagactaatatttcatgggcaaaaacaatgaaaagttacctttctgtattctaatactatagaggagtgggatttatttagaatgttttaagtatcttgggcagtccaagagtgcgtatcacttatttttcttttccttctttctttttaagtggaagttcactgatgttagagatcataggtggcattgcctactttttacataattttatcatgtttagtgatctgtcagaagggctgtggctgtttgcagttttggcttaagccatgcatgggctttataggagatgtagtcttcacagtgagttgttatttgtagctgtgtttttgtttttgtatagcttatagcaatgcagtgtgctttttattaacatcattttctttttctttttgcagtgattatttattcaagttacttctgattggcgactcaggggttggaaagtcttgccttcttcttaggtttgcagtaagttgaaattgaaatgtctttacaattaatggtacaattaatgctatgtatgttttctaggtagataaaattaaacagttttattcagaataagttaattcttccagaatttatatatttaaagactccaaatatacatccccagtggtatcttggactgttaaatagaaaaatattgttgctcttaaaagaaattcagtgaagtctggttataaagtcagaatgtctaatacttttggtcagagtcaaacagcagttccaatataggcagcaagttaaaggggtagttggtggcctgtgttgaaagcgacttgatgaaaataaatctttaaattaaactttagtagaataaaaagaaaaagcagagccaggtgacgcagtggatcatgcctgcagtctcagctactcagggtgctgagggtggaaggatcacttgagtctaggagttttgagaccaacctggacaacatagcatgactctgtctctgaaaaaaaaagttaataaaagaaaaagtagggtcttggacaaacttcgttggccaatggcatagttctaaatgctgaagctgacagataaaggacttttgacttaacagaatccacagtgtccttcatagtctttatcaactacctttaaatttagcatgtttcctggccaggtgcggtggctcacgcctgtaatcccagcactttgggaggccgagacgggcggatcacaaggtcaagagattgagaccatcctggctaacacggtgaaaccccgtctctactaaaaatacaaaaaatcagctgggtgtggtgccacacgcctgtagtcccagctactcgggaggctgaggcaggagaatcgcttgaacccaggaggcggaggttgcagtgagctgagatggtgccactgcactccagcctggcaacagagcaagactgtctcaaaaaaaaaagaaaaaaaataaaaaaacaaattagcatgtttcccttctagagatcattgtttctcagagcatggaccaaagactcctgggggttaccaagaccctctcaggtagcccatgaggtcaaaatatcctaataatactaagatgttagtatttgtaaggaaatatttacttggtaataatactaatataaaagatgtttgcgtttttcagtgatgacattggctctggtacaaaagcatgtgggtaaaattgctgctggcttggtacacatcaaggcagcgctaagctccaaattgtactcatggtgatggcattctttacctctgtgccctcacaggaacaaaaacaagccgtgccatttttattgaagattgtccttgacaaaacagttaaaatgattaatttttgaaaaatgttgatccatgagtattcctttaaaaatatttgtgaagaaatgggaagttcacataaaacaatgttttttttttgtttttttttttttttttttgagacagattctggctgtgttgccaaggctagagtgcagtggcgtctggctcccaggctcaagctgttctcccacttcagcctcccaagtggctgggacctcccaagtggatgcgccatcatgcctggctgatttttgtatttttttgtagtgacaaggtctcactgtgttgcacaggctggtctcaaacttctgagctcaagcgatgcatgtgcctcagcctcccaaagtgctggagaaagcactttttactgcatactggctagtgtgttggttattttggagaaaagaaaagcatttgtagttttttgagttgtaagctgagctaactgctttatttttttctgtggaacaccatttctttttttttttttgagatggaatattgctttgttgcccaggctggagtgcagtggcacaatctcggctcactgcaacctccgcttctcgggttcaagcaattcttctgccgtagcctcccaagtagctgggattataggcacctgccaccaagcccagctagtttttgtatttttagtagagatggggtttcaccatgttggccaggctggtctcgaactcctgacttcgtgatccgcttgtctcagcctcccaaagtgctgggattacaggcgtgaactactgcacctggacatttttttttttttttttaacttgaaagaacagctaacagacagattagaacagaattggctatttgacagattttctcagatgaactgtgatagtcatttcaagggaagtagctgcaagcatttgttggctgaaataaaatttaagtttatcatggaaaattagaatttgaaaaaacttagagtttaccacttgacagtatcctaaatacatatgacttttctgatgagtgccgatattaatgaaggttatttaaaaaatattaaataatgtataattctttttatataacagttaaaaataaaaccatgagtactagaataaaacataggtggctctttaatcttggtttgtgaaggtattttttaaaataagaaaaaagcaagaaatcactgctaaatttgactattaaaattaatttatcacaggcacaaaaatgttagaaaactaatggcaatagcaaatatatatatatgaggattggtattctcaacatataaagcacatttgcacatcaacaagaaaagaatatttctcctaatggaaatagtggcaaatacatgagcagtcagttgaaaaaagaagtaatacaaattgctggctgggtgtggtgggtcacgcctgtaatcccagcatttagaggctgaggctggcggatcatctgaggtcaggagttcgagaccagcctgaccaacatggagaaaccctgtctctactaaaaatacaaaattagccggatgtggtggcgcatgcctgtaatcccagctacttgggaggctgaggcaggagaattgcttgaacccaggaggcggaggttgtggtgagtcgagatcgcaccattgcactccagcctgggcaacaagagcgaaactccatctcaaaaaaaaaaaaaaaaaaaaaaaaggaagtaatacaaattgccaataaatatggaaaaaaaaaaaggctcaactttatttgtaattaaaggcctttaagttaaacttaggtgtcatttaatttttattaaattggcaaatattaaaattaagcataattcttaagcaactctcggtaggtgggaagaatctagctgtagcctcaggtgtttgtgcctcaaggaaaaccctctctgggatgtccattgcttgaagtcaaaggttttccaataatacctggaaactatttttaaaatgctgatccccataccctcaaaatattaatagagacaatcgtgaggactataataaagaaatgtgcaataagctctgggggcacagagggaagaatctattggctgaggagttgaagaaattgtttggacactcagtattgcctgagctcaaaactgaaggatgaataaatgccacatgaccttggggctggggagtaagtagggttatgcagagagagataactgaggcttttgggcagacgaatagtaacggctcaggcatgggagtaaaggtcatttagagatttacaagaattcagcatttctttctttttcttttttttttttgagatggagtctagctctgtcatccaggctggagtacagtggcatgatctcagctcactataactcccacctcccgggttcaagtgattctcatgcctcagcctcccgagtagctggtattacaggcgtgtactactgtgcctggctaatttttgtatttttagtagagatggggtttcaccatgttggtcaggctggtctccaactgctgagctcaagtgatatgtgcacctctgctccccaaagtgctgggattacaggcgtgagccactgtacccggccaagaattcagtatttctatccaagtacctgggggatagatgtgctacatgaatatttattgcattcattttgttctctgcatttttttttttttttttggtttgagatggagtctcgctctgtcgcccaggctggagtgcagtcgtgcaatctcggctcactgcagcctccacctcatgggttcaagcgattctccatcttggtctcctgactagctaggtttacaggcgtgtgccatcacacccactaattttttgtatttttagtagagacagggtttcaccatgttggccaggctggtcttgaactcctgatctaaagtgagcctcccaccttggcctcccaaagtgctgggattacatatgtgagccactgcgcctggcctctatatacttctatagtacctgatacttattaggcactcaattacaacataactttttttttttttttttttttttgagacagagacatgccttgtcgcctgggctggagtgcagtggcacagtctcggctcactgcaaccttcacctcccgggttcaagtgattctccttcctcagcctcccgggtagctgggattacaggcgcccgccaccacgtccagctaattttttgtatttttaatagagatgaggtttcaccatcttggccaggctgatctcaaactcctgaccttgtgatccactcaccttggcctcccaaagtgctggtattacaggtgtgagccatcatgcccggcccatatttctaaaaacattttcttataaaatgacattgccattatcaacctgcaaaatacagtttccatttggttgttttcttgcttagtcttttaatctagagttttataccttatcttttttatttatatattttttatgtcattgactttttgcagaaactgaagcacttgtcctgtagattgtccaatattctagatttgtcattttgcttccttgtgatgtccttatgcttatttgtttgtccctctttctgtaattagaagacctagaactgcactatccttagagtagctactagctctatgtagctatttaaatttaaattaattaaaattgaaaaagtttggtggctcacacctgtaatcccagcactttgggaggccaaggtgggaggattgcttgagtgcaggagttcaaggcttcagtaagctacgattgtactctagcctgggagacatcaagaccctgtccctttaagggggaaaaataattgaaaaaatcaaaaacttagtttcttgtttcacaagctgcatagggctaatggctaccatattggctagcacagcttatagaacctttccattgtcacaggaagttctgtttggcagtgccgttctcattagacctgattcgattaaggtccatctttgttgacagagtacttcttaggtggtgctttgtggttcatatgatgatagcctggtctgttcattcatatatcttttcacgagaaatatttttattccattctgaataaaatttcatggcaggtacttgcaagaagcagttataattttaaaagtttaacattaggttaaaaaattgacaggaaacatatattcacaggaaaacttgtacacaaatgttcatggcagcattattcataatagccaagaagtggaaacaacccaaatcaatttatgaatggataaaatgttgtatatttgtagtacatgtaatattattcagccaataaaatgggccaggcatggtggctcacacctgtaatcccagcactttgagaggctcaggcagggggatcactagaggtcaggagtttgagaccagcctgaccatcatcacgaaaccctgtctctactaaacgtacaaaaattaggcaggcgtggtgatgcacgcctgtagtccctactactcaggtggctgagtcatgaggattgcttggaccccgggagacagaggttgcagtgagctgagatcatgacactgcactccagcatgggcaacagagcaacatcctgcctcaaaaaaaaaaaaaaaaaaaaaagaagtactgttacatggtacaacatggatgaaccttgaaaacattctgctaaatgaaggaagacagacacagagggccacatattttatgattccatttatacgaaatgtccaaaattggcaaatctaaagagaaagtagattagtggttgccagggagtgaagacgggttctttctggagtgaagaaaatgtcctggaattcgtggttgtagtttgcaaccttgtgaatgtataaggaccactgaattgtccacttcaaaagggtgacttttatgttatgtgcattatatctaaaaaaaaaatcataattaggaagcaagattgacttctaagaaaaagcggagtgaaattgttgttttgtggtgaataaattgggtgggtgggtcgcaagagttttgctgattagtgattagaaaaattattcataatcattgaaaatataaaatatttttctatatgatgtatgtaaagaatttggcaagagatgatgtttggaaaaaataaagaatggctattgtagagatcttaaggaaagaaactacagttaagtagtgctttgtaatcagaatatgaagtaagtactgaaagtggatggagtggctgttgtcagcatgttatactttatacatttcattcataaatttggactgtagataaaagtaaactttttttttatttactcttgaacaacagtttttttttttccacttagacttgcatctgctccactgaacaatacatttaattgttaattatttcccccttcaggatgatacatatacagaaagctacatcagcacaattggtgtggatttcaaaataagaactatagagttagacgggaaaacaatcaagcttcaaatagtaagtgacttggctagtaatttttttgaaatttattttggtaaatttgtaatgtattgttattttgtatatatttactatgctaacaaaattgaatgtaaaatgtcttaagattcatgtacttaagatagaatggtagaataagaattacttagattaaaaataatattttcaagattacttaagcctcattgaattttctgttcatgaagcagagaaactcatgttttaagtcaaacttggtcctcatctttttcttttatcagtggaaatctaagttcaagtttaccttgtcctacactgcaaatgttatagaccatttttgtttgtcttttactgtgctaagtgcatggaacattaaaggaaccctaggaagagattcttcatatgtggctcagttgaagagaagtacttatgtagttctaagtatttttattagatagtgtgcaccaactctgtagaaacacagaattttgttggaaaaaggaacttagtttttgtaacatgttcattttactgctcaaaaaaacgaatgctgaaagatttaatgacttgcctacagttactggtagaaccaagtgaccgaagctctgtcttcaatattttgtgtctgtgtgccatcctatcccccttatccatctttacacccccagcccccaattaaatataggcaattataatagttcagttgtgcctcttcagtatgggtctgagtcctgtcagtgtgggcatatctgtggtcttttaaaaaataaatctctcagtatttttcagagtaggctattagcaagaagtaggctataaacacaggaaaccagtgactgccccttttcatggaactgatgacacatggaattggaaggagtcctgcattaggagtcagaagacttagatttgttgtcttggttctagtatttacctgttagagaatcatgggtttgtgtctctggggaaaaggccgaagtaaccctgagacccagtttcctttctaaaatgtgtgtgatgacacctgatttactaatttataagctagttgtgagaaccaactgtaatagctttgtgtatgtgacaatacgtgtgaaagccctttgtaaacttttgggcagcatatagatactacttatgatatgacatgcccagataaatgggtgtttgataggttaagttgctcccttttcttacatgactctgatgaggaaaagaaggtatgttaacaaaagataggtggctgtggatattgatataagtaaacacacttgatgtgtcaaattaggacttgcaaggatttagttttcagaaatagcttgaaatactttcaatcagtgaacaaattaccctccatattttttcccacgatataagtacagtctcaaccttttatttggcaccataaagagcacataaagatctacccaaaactgtactttaaagcactggtatggaataattgtattatgtgtgatcattggtgtttataagatttgggtgtgtattcgtgtgtgaaacattcatattttgttactttcctgtggctggaagggatcttataggacactgtctttcatctttgtctgtctttcatctttaataggaatttcttttccatgcctgaaggcctcattttgaacattttgtttgtttgtttttttattttttgagatacagtattgctctgtctcccaggctggagtgcagtggcgcgatttgagctcactgcaacctccgcctcctgggttcaagtgattctcctgccttagcctccctaatagctgggattatatgtgtgtaccaccatgcccggacaatttttttttttttgagatggagccttgctttgtcgcccaggctggagtgcagtggtgcaatcttggctcgctgcagcctccgcctcccaggttcaagcagttctcttgcctcagcctcctgagtagctgggattacaggcgtgcgccaccacaccctgctaattttttgtatttttagtagagacagagtttcaccatgttggttaggctggtctcgaactcctgacctcgtgatctgcctgactcggcttcccaaagtgctgggattacaggcatgagccactgtgcccagccttccgataatttttgtatttttcgtagagatgggatttcgccatgttggccaggctggtctcaaactccttacctcaagtgatccacccgtcttggcctcccaaagtgctgggattacaggcgtgagccaccacgcctgggtttttgaacatttttaagaagcttaccattttttcgaaatagctagttccattttacacataacttcagctaggcatgttgcctcatgcctgtaatcccagcactttgggaggccgaggtcagagagtcacttgaggccaggagtcaacatagctcctgtgaccagcctggtcaacatagagactctatctctaccaaaaaaaaaaaaaaaaaagtaaccaggtgtggtggtccatgcctgtagtcctagctccccaggagactgaggtgggaggaatgtttgagcccaggacttcaaggctgcagtgaggcaagattgcaccattgcaccccagctttggggacagagtgagagaccctgtctcaaaaacaaaataaggctgggcgcagtggctgtccgggcgtcgtggttcacgcttatagtcctagcactttgggaggccaaggtgggcagattgcctgagctcaggaggtctaagaccagcctgagcaacatggcgaaacctcatctttgcaaaacatacagaaaaaaacaaaaaaaaccacaaaacctctagttgccagttattttttttatttattcctagtgattcttctttttttcttttttctgagacaaaaatttcactttgtctccctcgctagagtgcagcggtcagctcactacatgattcttttagagacatgttaattctttatattgagctgaagcctgtttcttttacttctgtctcttcttattcctccgccttgtagagctgcctgaatcagattaattcctcttttattggcaagcctgcccttcagattgatcttatcacaacctttcttctacctctgaagtcctcattctttcctgtaatgatattttcagaaccttgtgcaatttgggttattcttacattttataaatgccttttattaaatttgatttcttaaatcaagtatgagatataacacatgaggtaaatcctgtcttgatttggagcctgaatgaatttctctcttgaacttcaagggctcatggccctttcttattattaatcaaagacaaccatttgttgtttcagtagctatattatttctagtttgggtcttaaggtttttgatttgcttgttttttcttttttcttttttttttttttgagacggagtttcgctcttgttgcccagactggagtgcaatggcgtgatctcggctcactgcaacctccgcctcccaggttcaagcgattcttctgcctcagcctccctagtagcagggattacaggcatgtgccaccacgccgggctaattttgtatttttagtagagatggggtttctccatgttggtcacgctggtctcgaactcccgacctcaggtgatccgcctgccttggcctcccaaagtgctgggattacagtcgtgagccacggcgcctggccgatttgcttgtttttaattaaaataggggccttggccaggtgcagttgttcacccctgtaatcccagtactttgggaggctgaggcaggcagatctcttgagttcaggagttcaagaccagtatgggcaacatggtgaaaccctgtctctaccaaaaacacaaaattcagccaggcatggtggtgtgtccctgtagttcaaggtactcaggaggctgaggtgggaggattgcttgagcccggagatggaggttgcggtgagccaagattgtgccatttgcactctagcctgggcaacagagcgagaccttgtttcaaaaaaaaaaaagaagagggtctcactttacacttctgtgactggtgttttaaaaatctaaacacaggccgggcacggtggctcacgcctgtaatcccagcactttgggaggcagaggcacgcagatcacaaggtcaggagttcgtgaccagcctggccagcatggtgaagcccatctctactaaaaatacaaaaaaattagctgggcatggtggcaggtgcctgtaatcccagctacttgggaggctgagacaggggaatcacttgaacccaggaggcggagattgcagtgagccaagattgcgccattgcactccagcctggtgacagagcgagactccgtctgaaaaaaaaaaaaaaaaatctaaacacaagattttacttttaatcctatcatttcctcttgcttggcttcagtaatccttcaagttttctaggtcttttcaaaatcttgattctgttgatttatattttaattatcttttcctttcagcttttcctgttcaggtgtgacatctgggtctttatctgagttttattagattataaaacattcagcaagatagggcaggtactgagtccagttgtacaccatggaaggcctctttctgtgattgttcattcatgaggctttatgaaaatgtctacattacaccaggcacttggaggttacagagatgaataaaacatagtccattaggaggcagacaatgggagagacaaacatgggaaaaagttactctgattatgaggagtaatgagaattacatatgaaggaaagtattgttagtactgttaggatttagtgtcaggaaagttttcagagtagcaaggaaacatcagaaattttactctttctgccaggcatggtgcatgtattattctgttctcacactgccacaaggaactgaccaaaactgggtgatttattaaaaaaaaggtttaattgactcatagttctgcatggctgaggaggcctcaggaaacttactgtggcagaaagggaagcaggcacgtcttacatggcaggaggcgagagagtgtgaaggaagtgaagggggaagagccccttatgagaccatcagatcttgtgagaattcattcactatcacttgaatgggggaaaccgtcgtcataatccaatcacttctccataatccaatcacttccctcagtgattacaacttgagatgagatttgggtggggacacagagccaaaccatatcagtgcctgtagtcccagttacttggaggctgaggcaggaggaacacttgagcccaggagttcaagatctgcctgggcaacatagcaatacctccattttggataaaaaggaaattttactttttgggtgccattgcttactttaatcagctgtaacttcttgttgacttttagtcaaaaaacaatttttccttctatctttgtgaaagaggttggtgagcaaggaagaaaaggaaacttgctttattgagcagcttctatagtcaggcacattttacaaacattagttcatttaaacccctttagctgttgtacaaggtgaatgctatctagcatttacagatgaagaaactgttaggtgactctccctaatattaaataaccaggaacctggatttgatgttttgaagtcagggtagcttgatcctcgagttcatgcttcctccaaggatacactgaaagactttgagcctctttttttttttttctctttttttgagacaggatctggctctcttgcccagagtgcagtggtgtgatctcagctcactgcaacctctgcctcctgggctcaagcgattctgcctcagcctctcgagtagctgggaccacaggcgcacgccagcatacttggctaatttttggatttttagtagagacagggtttcaccatgttggtcaggctggtctcgaactcctgagctcgtaatccgcccgtctcggccccacaaagtgctgggattacaggcgtgagccaccgtacccagtcccaacagttttttaaaacccagaactataatgcaataatgttagcatttgttttgggagtttgagcctaaatggttgaagtgcagtaaattgttcttaaaatacgttttatgaaagtatttggagtcatcttccttacatttttttctctaggatgaagacaacacctagccaggcatggtggctcatgccagtaatgccagcactttgggagaatgagttaggataattgcttgagtccaggaatttgagaccagcctgggcaatgtagcgagactctgtctctacaaaaaagaaaaaattagccgggtgtggtggcatgtgcctgtagtcccagctactcaggaggctcaggtggaaggattgcttgaggtgggaggttgaggctgcagcgagccatgatcatgccactgtactcagcctggatgacagaatgagacgctgcttgagaggggaaaaaaaagacacctgcttgggatgattaaagttctgtcttgactggtagttatttgaattaggtccctccagtgcttttaatcatggtagaatgtgctagcaagtgagtttgtcttacatggaagagttctgtgttcaagggctttcggccagtggcattcctaaacacagtgttaaaggcggtagggaatgtgaaaagtatgacatagttcctgctctcaacagcttgtaattttagtattattatcgtaagctcaattgtaggtactacttcttttctggactttcaggtgcttattaccgtgcaatttagtggtatgagttgaggactaatgtttctatatcacatcctgataatctccacagttatgaaaactaaactatttcccctccctcctacacttttccccaactttattttaatggaattgtttggatttcttgattgttttgtaatagtgggacacagcaggccaggaaagatttcgaacaatcacctccagttattacagaggagcccatggcatcatagttgtgtatgatgtgacagatcaggtaagttccaagaggagattgtgttacagtgaccaagtaggaagccattatttgattaatgtcagattcatttactacttcatatataagccatcagtattaattttatggcagaaaactttgtccactctcaaatataaatgtgaatcacttaaaagacatttgttttcctgtaataaataaaagattagtaattagttttacgtttgctttcaagggattctggttgtatttattgtcaactaaataactttgatcaaatagccaagactctaacatataggcaagagtttgtagggaatcgtgagttgcttggcttatactgtgttcttggtgttaagtattaacaggaatatggcctggtaattagaacttgtccatcagaattgccaaaagtgggattcgggggtctctgcctatggaggatgtggttcagaaataaagaatttgaataggataagctgtaggaggatcttagtatgagaatgagtatctgaagattagctgtgagagagggcagagcgatggagggaacaatgtgggacagtgtgaagcatgtgatccaggggccataactttttttgttactatttttttaaatcagaaacttagatttcagtgtcctttctatcaaagaaaaggacaaaagataaacgttcaaaattggaatttatttttcttttggcaaatgttaaatctcacctctaatgagaaatcatagctaattaggagataacttacatgtaagcatttagattcagtgccattagaagtgctgggtgggtgatatctgcaggagaaaaaaatgatgctagtttaaaaaatctctactattaccgtgaaatatttttaaatgaaaactttcgtcctctaaatatgactgtggaaaagaaaatgagtatatttaataacatcttttgacatctctagtagtaacagtaggtcatcttattcataaaccaaaattttaccaaatttcaggccaggcgcagtggctcatgcctgtaatcccagaactttgggaggccgaggcgggcggatcacctgaggtcaggagttagagactagcctcgccaacatggcaaaatcccatctctagtaaaaatacaaaaattagccaggcgtgggggcccgtgcctgtaatcctagccacttgggaggctgagacaggagaatcgcttgaacccagcgggcagaggttgcagtgagccgagatcgcgccattgcactccagcctggatgacagaacaagactttgtctcaaaaaaaaaaaaaaattaatcaaatttcaaaaccaggttttgtagtacatttaaattgcatattccaaagcagttgggtttgcctgcgttgcagtttaatattaagctatacttccctttcaaataaggtattttcatcgttaagcctgtaaattctagtttgtcattgtttagatatttatagtcattttaatatatctgtttacggccagctgcaatggctaacacctgtaaactcagcactttttgaggccaaggtgggccgattgagctcaggagttcgagaccagcctgggcaacatagtgaaactccatctatacaaaaaatccaaaaaaaaaaagacaggtgtggtggcatgtgcctgtagtcccagctatcccggaggcggaggcgggaggatggcttgagcttgggaggtcgagggtgcagtgagctgtgattgtgccactgcactccggcctaggtgacagagcaagaccctgtctcaaaaaaaaaaatctcttcactccttagcagtggttattttgtagctagagttgtctcactagctctttgttatttgtctgttaggtcaggaacgatgtttctgtttattccagaactatattatcgaactatattatcagtctttcaaatgtctttttaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggtatgtttaaagtttaattttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgctccattatggatggtagaaatgcagtaagaattagtgaaaaagatttttcagtgttaattgtgcctcattattctcttaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgtattataggcgtgcttggtggatctattcatcctcacataaggcaactgacaaattcctgaagttaccaatagttattttggtgaagatctttaatgcttcagaagttttgtttttgccttaatacagtataaagggggaaagagttcagaaactattttctaaagtagctaaatgacacaaaacaaatgtcaagatactgtgatgccatgccgtgcacttcatttttacacagtaaaagttgtttaaattgtcagcttattcttggtgagttagcggaaacattacatgaacttaagatgagcatatttacagacttaagtttggaaaattccagcgttcttttccccatggcagtaaagattgggatttacaacaaatttcagcatgccttaagatttgcttctatgtatacgccaataaatgtggttctggaaaaaatatatacccctttatacccccattttcaagtacaaacggttcaaagctactacaggttttaataatctgttcacttagtaaagggaattaccacttgttctaaatataaggtgctgccataaattagtttacatagtgaagaagagtgttcttaaatctaagcagctgcacactctgtgaaatcctttcagaatgatagtcattgtggtctgagcagtaatttcctattcttcgaccttggattgaatttcccttagcctacatcttgcctttccagcatatcttacctcaaaccttctttgtgttccattcccacctaagcttcaaaatagccctgtgttgacgtcgtcttccatttgctgagcttacctatggatctccaagaacccagatcttgaaactgctgatccagctttgagtatcatcacttccctgtggatttaacttccattaattttaagggactactaagttattccagtgtggcatcacagtgcagttagcaagctcagctacttgactctaatttggccatgtttgctcatagaaatgctgctggcagcatcttactaggctgaaacaatttcagcttgattttttttttttgagacaagagtctcactctgttgcccaggctggagtgcagtggtgccatctcagctcactgcaagctccgcctcccgggttcatgccattctcatgcctcagcctcccaagtagctgggactacaggcgcccatcaccacgcctggctaatttctttttgtatttttagtagagatggggtttcaccgtgttagccaggatggtctcgatctcctgaccttgtgatccacccgcctcggcctcccaaagtgctgggattacaggcatgagccaccgtgcccagccttcagcttgagttttaaggtaagtcttaaacttaaagcacggcggtataattaacagttgtgttgatactcttcagtagcattcacagccaggtccagggagttagcaccctttagtctcaccttattcagaggatgaacaaaaatatcttagatcatctctaggtaaggtagtactttcttgggaaacagggtattgtgtaacattctgtgcaaattcctgtcagttgaagctgattattagttgaatgggaatagaatgccacattctgcattcaattagtataatattggccaatttgtttctatagggttttcatctccaacttttatgctaattaatacacttctatgcctgtcaaatattagtaaataaatgggtttaatttcctaagggctattcagtaacatactcagtggaaggacatgttcctacttataaatatacatctaagagaaggtaaaatatatcaatttaagaagaggccgtcagacatctctacctttttaaccaactctaggttttcaagaatgttttacatacaggtttataattgacaattatttgctagagtggtttttcccttttaaagtctcagtgtgtatggaactaagatgattaatatggcaaactcataagccattttaattttgatcatgcccttaagcattatgataaagcataccacagcagcatcaggcacttgaaatactgcattttatgtgtagctactgttgaagagctaatctttaaagaatttaatggctattttccagtgactataaagtctcagaaattctgaagcagaaaagtcacattaataataggactttagtttccattgttactgtgctttcctccttccaggttcattcatggcccaacagaactttaaaagtgcttttctgtagaatctgcagttaccagcaataactgatcatcttgctgcaaaaagctatagaattgatgctttgaatggttgatccatagttttttttttt

SEQ ID NO: 13515 - DNA, 10840 bp, Human
gtatgcgtcctggaaggtatttgccgagttcgtgtgcacccataactcagtcagtcagcagctaggtccatcagtggtgggccggtagatcgttctatcgttggtgccactccggtcctggctaatcagccgattacctgtctcaggtggtgagagagcgccctccctggcacgcaataggcagactcagtcagatcgctcgcttgtagcagtcagaagtagcattgactcaacagctatcctgtctgtcaacggcagagtgagcgcaatgaatctacttccctttcgctcattcaattggctcatcaagctgttcgggcagggcgcgcggggtggctcctgtgtgtaattccaactgaatggcagagtcaggtgggcatcacatgaggtcaggagttggaggccagcctgtccaacatggtgaaaccccgtctctcctaaaaatacaaaaattagctgggcattgtggagcaggcctgtaattttagttactctggaagctgagccaggagaatcgcttgaatccgggaggtcgaggttgcagtgagccgcgatgaagccattgctctccaacctgggtgacaagagctagactctgtctcaggaaaaaaaaaaaaagaaaataggaaagctgcccgcaaagcctgcaccttggacacctcgtctgcactaacatttgggaaattcttcttattatttctccggaacatatatatttacattctttacatgtctgtttcacgttaaagaaaatatttctggagcaatcaatttttttttcctttttttttttttttttttctgagacggagtttcgctcttattgcccaggcggagtgcaatggtgcgatctcggcccactgcaacctccgcctcccgggttcaagcgattctcctgtctcagcctcccagatagctgggattagaggcatgcaccaccacgcccggccaatttttttttttttgtagtagagacggggtttcgccattttgcccaggctggtatcgaacttctgacctcaggtcatctacctgcttcggcctcccaaagtgttgggattataggcgtgagccactgcccctggcttccaatttttttttccttttttttcttttcttttttttttttttctgagacggattttcgctcctgttgcccaggctggagtgcaatggtgtgatctcggcccactgcaacctttgcttcccgggttctggcgattctcctgcctcagcctcccgagtagctgggattacaggcatgagccaccacgccccgctaattttgtattttgtatttatttatttatttattttcgtagatacgtggtttcgccatgttggccaggctggtatcgaactcctgacctcaggtgatccgcccgccttgccctcccaaagtgctgggattacaggcgtggccatcgcgcccggccaaatatttttcaaaatctaattttgcataatgaccaagatttgcagaaaaatacaaattaaagagatcttttaaagtaaagattcgtcataaaagtcacagaaataatactcatgaataataaattagaatgggcaatgttaagtacttgaaataacaaaggttttagagtcagggtttctgcagtttccctagccatataacgaggagactgttagagaggatatcctaaaatgctttccaagtttacccacctctaactcggaagaaggcaatttaaactaatttggtttaccggaattcaaatacgtacaattcaacataatgaattgaactgaaattgaacacctgcttgcgtaaacctagtcggctcgagttgttctggttctggattggtcagtctagagttccaggggtgtggccaaaagtctgtgaggcggggccgtaggcagcctaaatcaggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagttatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgcagttcctcattgggctaggtaggcggcttgcaggtgatggcagtacaagaggtgaagaaggtgcgggcagcgcctgggcgagttgcggcaagtgaaaccattcccacgtgtaagctagaaaacttgtcagctggatggatcttcatgtttcatagtggggaaacaggccctggaaagagatgttataaaaaggtagtcctgccctaagtcatgcgttattagctcctccagcatccgtttttaactttaccagcaatcttttttttttctccttacctttgatccgttactttcaagaattgagtaccactgacgtggatttaatttggtgtggtttctcaaagtaaaatggagaaagtctaggaagttatttgctgccatgaaagtctcttgcgcctcctttttggtaaaattgttagcataaattgcttaatgcccacattttttgttaggtattaagtaaaggtgcagttcagtccttcagaagggaatatcgttttctctgatctctgctatggccattctagaaggatagattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtctagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaacttttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactcccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctcacagtcatcagcacttttgggaggtttgggtgggatgattacacttaagcccaggagctcgaggctacagtgaggtgttttttttttcgagacagggtctagctttgttacctaggctggtcttgattgaactcgggctcaagcgatcctcctaccttggccacataaagtactggcatgagcgaccacgtctggcttagagtctaaaaagtaccatgtctggataaactggagaaatctcaggaagcagtagagagctgaaagacttggttgggcatgaaggggactcaggaaaagcaataccgtgaaggcagaagggttgaggttgcaggaaggaagggtagtggaatgttttggagaaaagatggtcacagcccctgcatggagcacctacagacaggagggcagggctgagaagagttaagtcatggggctgggcctgctggccagggggtggttggagttctgttttcatatctacagaggctgtgtacttcggtttgtggggcctctggccctgtaggttctcttgctaaggaatctgctactactttgctaggaccaggaaatggcttactagtacagaacgtgtggaagaatggggtctttgatgtgatttgacattttttgatgaacagtgcataccaggctgaaggtaatgctaggggcagcaaaggttggggtttgagatgcagtttcctgtgactgagctggagtgtggaagcagagaaggcaccctgtgagcagcttgcagaggcaaggtggtgaggatcctgacagtgctgcagggatgggatgggatgggatgggacaggacgtggagctgggggtggttgctaagttgatgcagggagagtggaaggaagcaattgagaactgaagggtaggaaatagtttctgatgtgaagaaaaagggcatagctgcagagagcctgaatgattgaaggttggcatcaaagtcacgaagtggggaggcttttctgttcagctgtgctcagggcagaagttgtagtctttcagccagtagccttgggaagggaggtgggatgaaactcaggcttggcctatttttccagaggatccacttgggttgtgatattatagaaaatgtggcagtcttgctgtgagccttgttaggcataacatttggaaacttggcaaattttacgtaaaggtctggatttccagcctcttgaaataccagaagcagcagtagtagcccaccttcctgtttgataacaattggcagggctccaggctggctgcatctgttgggacaggtattctctggtctccacagcctttgctcctacggccagctaacaccctcctctacctgccctctggtcttctgtccctgctgcctgcttctcttccatctagtccatccaagtgttttttggggaagtcacctggtaccttgttagggttaatttgtcttttaaattgggctcccaagggtatctgctagctaccctggctcacaaggctattttgaggctgaggatgtaacaactgtgaaaacagtttggaaactagtgctaagcaattgtttgtcaggaagcagggacttgtgggaactcaaactgtggacagattcagcacattgtaggccctcacagtaaccaggctaccctgtgctgtcagcaggctttggaagagcctccataaaatgcaaacttgactttactaagctgaatcaatattgagggagcacatcccttccttcagcttgtcactgatgggaagctgtggcttagagagagcag

SEQ ID NO: 13516 - DNA, 10521 bp, Human
gactggtcccagttccaacagcctgcccttgggcaattcactccccagcccctggggcctggcttccccatctgcaaaacagagctgtctctcaggcagagttcacagctgggaaagggttctgagaactgaagtggtcaagtgaatgaaggcagcactcccctggggtggggatgctcatgcttcatcaggatggggcataaactgagtccccccaggagcaggcttgagaaacaacagggtacgctgagctacctgctgtggctgaaggtcctgtgagctcagggcctggaactggccgcagggaagcctggggccttaaggaagcttcatgacaaggcacatggcgtgattcctccactctcaaatccacaggatgcactggtagaggaaggtctgggacatgtgctgagggctcaagtgggctccccactcaggcctgctcacctcagggcacaatcataagaaaggaggggctgctccccagggcagagtgaggccccattctgggctgggacctggaatgcatcccacctgggcttcactgggtgcctaggcccctcctaggccaggaatcggagaagggggctatgaacttccagaagccaagctagccaaacttccagaggccaagctagcattcttatgaagctagggcactgctctgacctcatgaatttgcttggctggcattttgctgcctgacctgttcccatgagcccattcaggatctggggcaggtcagtccagagctggtccctactcctgcccacctgcctccaaggctcagccccacccctttctctgacccctcaggcctctaactgagaccgcagctctctgaatcccaaactgtgagaaagacagtccagactctgtccatcacagatgcccacaggcacagtacttagttgacaaatccatgtctctctcgttcattttatcctaagaacagacacgagaaaaaagcaggatgaggagcatgatcgcacccttaccctccagatgggaaactgaggcccagagaggcctggagcactggtgcaagctggtagcaatactccagggctccctagccctagccagtgccttcctgtgtccaggcctcagcttcccctggggacagtacaagtgttgggccagatgctctctcaggtccctgcgtggcatccatttattgcagacctcccaccaccttgcagtgagggtggctctggctgctgggaagcccactttcagcacgtggggtttaaatgctcctgctgtgggtctccccactgagtcccctcccagggtgcatgctgatgggagggggcagctggcagtctgccccggggctgtcagtgtgggtcctaggaggagggatcagacccagtcctggggagggctgggggcctgaaaggagcatgatgagcccaggctgcgttttcagtcttgctagaagcaggtctggtccccagaaacaactagagacaggcccaggccgggacaagcaggctagggggcatcatgggaggtgtctcagcttatctcctccctcttgcgcctctagctcactaatcccgcctctcatctcacctttctctaaccctctcagactgcaggacctagggcagcagggaagcttatttggcctgagccttacctgcaaagggctcaaaggtagacttttgctattatattcaaattgcaacgtatagatgctcatattttggaattaattacgttttagcagtttttctttttttaaaaaaatctgctggtaccttaataaacatggaaccagcaaccttttgccaggtgtctgttctccgggtctctgggcctggaggcgggagtgtttcaaagcacttcacgctccgcggccccaccggctggctgcgctgcccgctgcggccggcaggggtagtccacggacaggcctggaggaggcgggacgggggcagggccgggaacctgggcaagccaataaaggctgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggaggtgagaccgctcgcagggccggcctgggcgcgggacacgggcccggggagagccctgggccccgggcggcgcggtgccgggcgcgctgggtgaccttgggcctccccatgccgagctctgggcctcagtttccccatttctgagaatgggcgtcagaatgatttcttccggcctccctcggagcactggagcgggggagacgggagggagggcacgtgtggaggagaaagctcaaggtcagatcgcagagagggagggctcagcacctctgggccggcccgggcacgagggaggggctccaggagccttctggggctgagcctagatccggagctccgaggtgggtgtcgggggtcttggggtgagcgtcgtggcccagcgggtgctcacgtggcggcccttgcacaacacggagcgcttcctggctccggccccgcccctgcggtcgggctcacactgggggtgctgggaaatggagcgagaggtggtttccagcagtagtgcgggcccagtaggcctcaggccccggccacctggtggaccccagaatgcccctcctgcgagtcgggacacactcagagacagtgtgcccggcgcctcaacccctgccactgtccttgggggccacactgagcacctcccctaactctgtttttgggtcttttctaaagcaaagtaagaaacagtcaccagggtagctttagagggaaagccctagtggagccttcaggtcggccacacattgacagcaggggtctgtttgtgttgactggcccgtatcccagggagcccttagtatttcttcttcattctcagtttcttctggaaaatagggacacccttcctgcttccatttggttccagggtgggtcttgcagcttcgagggtagaggctggctgggatggggcttcagccttccctccccacaccctcatgcctctccctgggcctcagtttcccaaccccgaatggaggagctggtctggcttctaccttagacacactctcttgtccctgaatttctgatgctttgggcccagctgtgggagcactgccagctgtgtccacagaagtaggccaagatagcattgtcatctcttctgacagattaggaaaccaaggccacctcctccagccttgggttcaggaaacggctcccagaaatgatagagctgcctcccatgggggttggcaataatgggaatggaatgtccacgtgcttcttccttagcctccttggccactgtgggggtgggtgggtgctgagagacacccaccttcacctgcctctccaatgaccatcctcttttgtccttcttctcccccaacagctgaaggcagatgtcgtcccaaagacagctggtaagacagggcctggggccttctgagatgggtctagagggaagggggccaggcagggcaaggtgggtggcgtgatgagaagagtcggggctcagagacccctgacagatgggagctccatgtgtggctcagccattgggtgctctggggcagccctgccatccctctctgggcctcaacgttggctctgccctcctctctcatagtagctgggagcctcagagccagtggaaggcacatgtaaatttcccggagacttccccactcctggtgcccagtgaggcagggtgatgggcacacagcccttgagtccgtgccctgctggccagcacagccatgagcctgtactcttgtcacagtgctcaggtactgaggacagggaaggggagtgacttgtccagttacatagcgagttgggcagagcagacccaagaggtgggccagagtctttatccccctgttcactgctggggatgtagcagggattttggctggaacgggtatgaccctggaattggggcctggccctgttgacctgtgtttctcttcgaccctcagagaacttcagagccctgtgcactggtgagaagggcttcggctacaaaggctccaccttccacagggtgatcccttccttcatgtgccaggtaatgtagtttcctcttctgtaaggggggatgagagcaggagctgccttgtgggtgtgtgaagatgcctggtatgaggaaggtgctgagcagagcagctgcagttgctctgtcagccaggctgccctccctgcattagccctgtatccaggcttcactgcacatggaagcccagccccaacccgctgccactccaggccagtggcaggccctgcccgggggactgggaggtggagtctatcaagagagagctgggttgggagatggatgtgctgggggtggccttgaagactttgaagagccagcatattccagtggtctctgaccttgtcccctgtgtgcccctgagcactggtgtgggagataagagagggagagagagaagtggaggaggcggaggaggaagacaggtccagggcaggaacacacacgccaggacttggggcttcccttcccagagaaaggcattattctcggtgaaatgaatgtttttcggtcatgtgtcatgctcagttttcacaagcattggtattgctgtgtcagaggtttgggggtaggtgttgtagcaggagcttcctgtgggtcaggacccaggtggtgttggggctggtcttctattagcacagaccttcaagatcagggattgggtgtcctgggcaggcagagcctggaggcaggggcatggctgtcatgacctctttgaagaccttcctgcctggaattctctccccattccctccaccctgacccagtggccgtcatcgtaccgtggtaagtggcagcgggttgggactggacgtctatgtgcggcgaagcctggatacggggtgaacacagggacggcaggcctggcccagccctaaggctgatggtaaagtaggagctgaggtggaagtcctgagccagggtgggaactccagcgcgggagggctccctggcacaaggcggtggcaccgggagtccagaccagagtcctgagtcatccgttgggagggatatcaattagggagcacctaattgacacctgtggatgcttcagctgggctggtcagttcccctctcttacccacggatcccatctcaggaaaacagcagccagccatggcctgggctgggcagcgctaggcataggggctgctaccaggctcttctggccatgggtgccccatgcaggtttggccacggctgcctgggccttagctgaggcctgaggaaagatgtcagccttgggcagactctgtcctgggtctgcaagggttgggaaagctgctgggctgggtaaggggcagtgcgcggacagtgaggggactcggcctggggagctggtctggaccagctgctggtactcccacagactagactcgggaactggggggcctctggcctcttccttgttgccctccaggaggagtgggttaaattctgggtcactaagtatcatctcagaatggcctttaggtcttttgaagattacttaaaaatttgctcagacaaaaagtaagtcatttggaaacaaaggtagttacggtgacaaaagatatttaagttttgtcttttttttttttgcttattattcttattattagctcttattttattggatgtttattgacccctttacctgaggggcgccaactgggtgggcttgggtgggctgaggctgctgccagcgccagggccgtggcccccgcctgctccatggtagccactcagaaggtgctttgtgctcacaggcgggcgacttcaccaaccacaatggcacaggcgggaagtccatctacggaagccgctttcctgacgagaactttacactgaagcacgtggggccaggtgagtgggggcctcctctagggtgagtgtccccacagctctgacctggcctggaagccccagcaggccctgagaggccacatgcagtcaccgtccagtatctgatgagtctccttcctccctgcgacactgtaggctgtctcagcatttctggcttgttgagtttccctagagttttctcatctctcagtttaaaaagcagggtttcctttgggaactttgtggaagaacctttaagcagaatggaggccctggccacctccctgtttgtcctctgagtttcgggttggaaattctaggacacttagaattgttgcagaatggtccttaggtcctttgaggattatttaaaatcttgcttagataaaaagcaaatggtttggaagccagagtggttattgtggcagcatcgtgtcacctataagacccaaggtagaatgtggagatgtctggaggtcaggtcctggggtcctgccccaggtcccgccccagctctaccactgagagcttccacaaggccctgtcctctcaggccaccccactgagaactagcaggcagcaaaggcaggcataccctggggggctggtatcgggccctggttctcctcttctgggtcccaggatctgcagactcgaatgtccctggtgtggtttgcaccgtctgccctttcaaatgccctcccaggcaggtgcctccaggggcagcgtggctcagccctgctggtttttgcaggtgtcctgtccatggctaatgctggtcctaacaccaacggctcccagttcttcatctgcaccataaagacagactggtgagttccctgccccaggccctctgggaatgcgggcagccttgcagctggaggaggattcgtgcacttttaggggcaggcagtttacagccaggccttctgctctgggacagtggccctctcccaggctgtgtgtttgtatgagaaagagaaagttagtggaaggatcaagggagaattggggttgttcctgcaactctgtcatggttcgggttcccattgttgctgtcacctggaattttctgagtgtgttctgctcacacgcacacacgaaagggtttctctaccagatacatttgggaaatgttgcaaaacatattatgaggcctcaggagggactgagtagaagcccacttgtgtggttttaacctggagtttcccaggcttgtcttgaccatgggctgagccttggcaatgctgcagcagacatttggatatcagcaaatttccaaatgaagcctctgtattatcataaacctgcagatagccacaggcctgtaagggccctgttttcaatgcccatggattttagggatgtctctttcctggtacattttcctctaagggataaatttctctggccagagtcccaaatgtcctagccctggggcacctggggatgaactggctgggagctgacttggtaaagcccatttccgaggattttagggagacctaggtggggcagacactagaagtgtccagcctccaagcccaagagatgtggccggcagggctgggcaggtccttgctggctcagcctgctctttgctccttcatgggaccccagtggatcctgcagttctgctcttggctggaaccacgccagcttcgctggagctggactgagccgccttttacattattggactctctcgggttgagagctgcccaggactcctgcagtttcaccacccttgttcctttgactcttgactcatcattcatgaccgttaacgtggttccatttgtatggacttcttctttcttcagagcatttcagtatcctgttacctccccatgcagaacaaagaatactccacttttgatagatggggttaccaggattcaggctacatggcctgaggcaaggtcacaacatgagtgacagaatgtgtcctggaagccaggcatcctctggggtgtatttggggcgctcaacaaggcttgatcgagctttgggggtagatctagctattccatggggattcttttcagaattgctgttttcggtaactaattccatgaccaggtccatggcattggatgacattgcgctacactgttgctcacccgggtcacccgtcctcacaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccatgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtatttttttatagcaatacaagaatcctaacacgggttaacaataaggcccacctcgtagggtggtgatccacgtgaagtgcataacgcagtgtctggcgcaccttcctaagcactctggagtgacaaggatgatgacctttcccctgtcagggtcttaggaaggaggagggatgccagagcaaaggagcctccatcatctgaggttaggagtggacttcctaggataagccagttccatttggaattgacttctaggtgtttccaaattcacagggaaggcaggattggaggtaagagcttccctaggtagacagggctgtggtgtggcccggcagttgagtggtcaggcaggcagttctcagaggaaatttgggcccttttgagggcatctaacagaattatttctcactggggttccctgagtgaggttatgtgtagtcttaggttaatggagtcactctgaggtcatggtgactggggtcgggtcatttggagtcatggagagttcccatgaagtcagtttcagtaggacaagtagtcttaaaacaattatcaagagcgttaagagtcctcaaagcagacaaggaggacacaaggagcatgggcccctgaaccccatttgcagtcatagatgccctcca

SEQ ID NO: 13517 - DNA, 82125 bp, Human
  misc_feature (1)...(82125): n = A,T,C or G
aggagatgttgaggcaattggctatatagatctggagcttagagatgagggctgggcttgagatacacacttgtgtacatttgcatacaggtggaaaatgaagttgtgggtgtggaggggtacccaagaagagaatatagagtgcagtggcaagagggcgtaggaccaaacctgggagaactttaaggtagtaagtggaccagtcagggccagctagtcaccagctagaaaccagctaatcatggtcacttcagacatgggtgctgtgttagcccttctgtttcctgtttagttaaaaatgttcaagtctcattgtcttagtctctctagttccttttccccattaaaactttcaggggaggatctgaaattcattccagctgaagtgtaaataatacaaagtaggccacacaggttccttttccctggggcagtttaacttgttccttggaacaagtccttccgctatagaggcagtaggctgaagctaaagagacttagctggaagtcggagaactggagtctagttctagctctgtcactaatttggtgtgtggccttgggcaagtcccttttctctgggtttcagttttccaatctgtgaaatgaagataaatatccttgactcacagagctgttaagagtatcaaaagagagactgtgaaagcactgggtaggttactaaatgtaatagatctgtcgtgagtactaaaaaaaatgaagctctaactgtagagctttgagtagcggaccacggagaaggtgtggggagaaaagggaatctggggacagattgagaaggggttttactccttggaagaagaaggaatgaggcacttcacgccccaggaagtttcctacatctctagaattagggtagcgactgcgatttactcaatctaatgctaaccgcatgtcttggaagagggtctcagttcctcagaggaaaaccaaccccatttctgagggcgtttctgatctcccaggttatgcctggaacttgaagcatccgattttgggagctttatgtttgcgttgggggcggggttcgttgttttgttttgtttttgttttgtttcgttttgttttgttttgagatggaggtatcgctctatagcccaggctggagtgtagttgcgtgatcacggctcactgcagcttcaatctccgggctcaagcgatccttctacctcagcctccctagtagctggggccactggagcgcgccaccaagcccggctaatttttttatgtttttggtagagacagggttcgccatgtttctcaggctggtctcgaactcctggccttaagtggtccgcccgccttggtctcccagtgttgggattacaggcgtgagccaccgctcccggccctgggggtggttcttaagcatccccaaatctgtatggatgtatatctcaacgcctatccctccctctgctccccctcgcccagtctgtcccatgtgagtgttgtatcttgttcgccgtgaaaggtgatgagggtcggtgggggaaatctcagatccccgagcaggaaggttcttagtcgttctgtgagtgcccctcccttctccatagatctcttgtcccctagaacgggtttcctgttttcccgcccgactcacccgcagtcgcttcctctccagtcttggcgtcccactgcctcagggttactcagagcaactccatggcaactgctttcgtcaccacaacccggcaggcgccataagtactgacgcgatgcttaccgggaccttcagtttgtcaggggcggggcttcaaggccgcgggtgacgctgggatttgtagttctctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtaaccggcgcgggcccgcgtttggcgtgcggcctgggcacccctgcgggtgctcaggcctaaaaggggtgctggagaggccgctgcgagcggaaggcctcctccataaccgagtccgaaagggcagaatctatgggggtaaggtttgtgaggagaggcgcctgagagggaggagccggggggggggtgccttaaaggggagggtctgtttgggggcgtgtctgtggaattaaatctgaaggtgactggggtcgggggtatagggcaagttcccgaaaggcttgtaagcgaggggtcgggtcctggaaagtctttgccttttatcgttaacaatagcagtagttatggtagtgcagtagtcagcattttctgagctacaccgtccacaatgacctgccaaatgtttatctttttaatcttctaaccacctgttatactttaaagatggggagcctgaggtttataatgtttagcttggcccgggttacgtagccagtgcgaggttggctctactttgggtttatgggttgggcataaatggggacggggaaggtgctgtgtgggggcgcgcgttgtcttggactggtcagtgtattttgagcctcacttttcatatatgtaaacaatgaccttacctgccttacctacttcctggggtggttgtcctggtcaaaacaggttaagtcttttttttttttttttaactttttgtttgtttttgtttttcatccatggactctcacagataacatgtttcatacacgcacctcggagagtacaaatttatgactataagtggtgtgactgtgtgaagattgtgggtgggcgggagcccactgggttgatgctgccgcctctgggtactctcttttgcttacctctgagttagcacttgtcatttttttttttttttgagacggagtctcgccctatcgcccaggccggagtgcagtggcgcgatctcggctcactgcaacctctgccacccgggttcaaacagttccctgcctcagcctcccgagtagctgggattacaggcgcccgctaccacacccggctaacttttgtatttttagtagacacagggtttcaccatcttggccaggccggtcttgaactcttgacctcgtgatccgcccgcctcggcttcccaaagtgcttggattacaggcgtgagccatcacgcccggcctgccatctggtattttaaaagtctgcgtgtttgtctgcccttctagataacgagagactttttcgtcactgtatcctaatggctaggcaggatttgcgacatgtaatgggaataaatgtatgctttggaataatttcttgggctgaaagggcacaggaatttcgctttcccgttttcatttagtggcatttgaacctcagtattaagctgtcctctttactggaatggcactccctcttgaaaacgtgatgatattttcttgctttaatacataattccctctctctagtatctgttgcctggttctatgtttccaaacttctgggttgtctggtcgttaaagctttaatggtaagggagttgggcctctctgctttgtggagatctttactgctgtgaatatatgggaacctggggcgaacatgaggatcatgtaaggtagctttctgtcagcacagatgggtttatgtttcctcagtccctctttctgtgtggtattttcttctttagaggaagaaccacatacttttttgtgaaagcttccaaagtattcttttcgtagcctaagttctagcaagggatgactaattgtaatgtctaagctcttagttcacagcgaaaagcggtacattccaaaagcttaaagatcttacctgaaagctcgttaagaaacgtagaattcttttttacatgtggaacatggaagtgggaagaatgccttgaaataagacttgaattctagaacttttaggatgagggcaaagccctgctcaggtggctgaacagagctgatcaggggctgtttggacagctgtgtctaattgataaaactatgatcagaagatattaggtttgtgcaaaagtaattgcagttattgccattgaaagtaatggcaaaaaccacagttacttttgcattaacctaatatatggtgtggtcatttaatttagcctcttacccagtgtacactaaacataccaaaaggtgttgtccagactcaaaatgagtactttctagaatgagatcattcccaaagtcaatccatctctaagttgaacaattctaattgataattattattttgtagctgggcatggtggcttgccctgtcatcccaactactctggaggctgaggcaggaggagcaggcgggagaatggcttgagcccaggagttcttagctagcctgggcaacagagtgagaccccaacacaattaaaatatgtttattgttttgtattgttagtgattatttcattttacccatgtatgtctactgtttgctttttcactatttttccttgcattttattccttccttttttattgcatagatacatacatccttcagatgtttgtccagtgggaatctgttagtggtaaacactgtcttcatttaaaaaatctttatttcactttcagtttttttttttttttttttttttgagatggagtctcactctgttgcccaggctggagtgcagtggcacagtctcggctcactgcaagctccgcctcccaggttcacaccattctcctgcctcagcctcccgagtagctgggactacaggcgcccgcaaccacgcctggctaattttttgtatttttagtagagacagggtttcattgtgttagccatgatggtctcgatcccctgaccttgtgatcctcccgcctcggcctctcagagtgctgggattataggcatgagccactgtgcccagctcactttcagtcttgattggtagtttagctgggtactaggcttccaattattgtctcttagcactttgaaagtgttttttcattgaaattctggctttttgttgttactcttgagaactatgcttgcaaattaacttattttattgtgggtaacctgtctttctttctgtttgtttttaagatcttctttgctgtcatttgtgttctgtacttccattacatggtgtgaatttaattttcttaaatcactatatactgggggcatatagtaattccttaatctgaaatttcatatcttttcactaattgtgtaaaaattcccaatcattacctctttacctctctcagatctcatgcgtaacgtatgttgaacttcctcattctgttgtctacatcttattctttctttcataatttccatttctatctttctgtgttaacttctggataatttccttatatctatcttctagtatactagtttactcttcagctaggtctaatttgttttttgaattcttatttttattagctaactttttcatttattagaagtgctctttggttcattttcaaatctgcttgtttttcgtgatcttgtttttgtctcatgttttcaattttgtgtctgtaataattttcaagaaagttgagttttggcagatgtctacacctgtaaacagcagccataatcaagatacagaggatttctctcacccccaaaagatttctcatgcttttttttttttaagatggattttactcttattctccaggctggagtccagtggtgcaatctcggctccctgcaacctctgcctcctgggttcaagcgattctcctgcctcagcctcctgagtagctgggattacaggcatgcaccaccatgcccagctaattttgtatttttaatagaaatggggtttcaccatgttggtcaggctgatcttgaactgccaacctcaggtaatctgccctcctcggcctcccaaagtgctgggattacaggcgtgagccaccgtgcccggctctcatacttctttacagtccgtttttcctttcaccctgataccaggaaccactgatcgtttgtttgtttttcactacatattaatgtctgcttcctagaattttattttattttattttattttttgagataggatctgtctggctttgttgcccaggttggagtgcagttgcaggatcttggctcactgcaacctctgcctcctgggctcaagcagtccgcccacctcagcctcccaagtagctgggactacaggtgcacaccaccatacccggcaaatttttatattttctgtagagacagggttttgccatgttgcccgggctggtctcgaactcctgggctcaagcaatccacccacctcagcctcccaatgtgctgggattactggcgtgagccacttcacccagcctgttttgaattcctagacggtttttccctcctttctcactaggtgagcaaggcaagttttttatttctctctggacagattttttttcctagtctattatcttactgagtataaacttaagaatctcagcctctgcacagggatctcagtgccttttgtggactcaagatctgtcttctgaacctatgagggtgttacaaattccatacacggctaggacagctatgtcatcagctcgctaatcctcctcactaatttgtttctggttcctggggatttttcttactttcttgagagctcagtttatctatatgtcagttcagatccaatcagcaaaacagaaaccacacaatagagtgaactccataaaggagattgatttaaacccttggtggagggctgaaaaagcagaaagggaatattaaagtaacttcaatataataactgcataaagaatttttctcatccaggactgaaaaacaaagggaggaaggttggggctaccagaacctagaagtctagagggatctggaatagctgtacccagattctctggagagggtgttacctggtgctgctggtttctcaggcccttataggaggaacctggaggagctggcttctgttgagccttacttagctgatgctggtgcctttgaggggcaggaggctggttttgggagtttagaaagcaactgggaagaaccaacttctgttgtcaagaaacaccaggctacaagaaggaggaagtcccttgtagccttctcttgtcttctgttttccccttagcaccccctgttgacagggatccagctggcaaatgtgaaatggggtttagtggagtccaggccccagcatcacaaagcggagcataacagggtagatttggagctgagagacaataccttaatagctggcacagtctaaaaggatgtttattatatttttctgagcacttctaggcatatttagtaggaagggcttcaggttatctggtctgttttttgtattgtatattatttttattttatttatttatttatttatttatttattttgagatggagtctcactctgtcgcccaggctggagggcaattgcgcagtcttggctcactgcaacctccgcctctcgggctcaagtgattctcctgtctcagcctcccaagtagctgggattacaggcacgtgccactgcaaccagctaatttttgtatttttagtagagacagggtttgaccatgttgcccaggctggtctcgaactcctgacctcaggtgatccacccgcctcagcctcccaaagtgctgggattacaggcgtgagccattgcacccagcctgtttgttattttgagacagagtcttgctctgtcactctggctggagtgcagtggcgtcatcatagctcactgcagcctcgatctcctggactcaagctatcctcccacctcagcctgctgagtagctggaactacaagtgcacgccactgtgcctggcaactctttttatttttagtagagacgaggtctcactatgttgcccaggctggtctcaaactcttgagctcaagcagttctctcaaagtgctgggattacaagcacaaaccaccacacccagcctggtctgttgtatcaacatttagtaatagcaataggtaacattttttttccagcgtatattgtgaactaggcactgttctaagtactttacagaaactacttctttttattttttttgagatggagcctctctctatcacccagactggagtacagtggggtgatttctgctcactgcaacttccacctcccaggttcaaatgattctcctgcctcagcctcccgagtaactgggattacaggcgcacaccactaccgtctggttaattttttttgagatggagtttcgctcctggtgcccaggctggagtgcaatggcgtgatcttggctcactgcaacctctgcctcctgggttcaagcgattctcctgccttatcctcctgagtagctgggattacaggcatgcgccaccaagcctagctaattttttttgtatttttagtagagacgggtttccccatgttggccagtctggtcttgaactcctgacctcaggtgatccacctgcctcagcctcccaaagtgctgggattacaggcctgatccaccgcagccagtctcggaagctacttcttaaagctctgtgagctaagttctattattactattctcttttacagggaaggcaactgaggcacaggtagattaatctccccaaagccacacagtttataagtggtggagttgacatcctaatccaagcattctgggttctacatcccacattctgaacttctacaacatgctgaaatttcttccctgtggcaaaccaaaatcagtcttcctgtaacttccactcattagttctggttttgtattcttatagtggactcataagtctttctcctcatctatgtgaaagctatgcgtatatttgaaaaaagttttcttgttctcccctggctaaaagtgtgtagttcttcctccatatttgaaatgatatacttctagaccctttgccatggtcattggtgttcttcctctgcaagtcctctaactttgctcttcaaaggtggggcatagagtcatcttctactaatgcagcttaagactgcattgatgttttgggtagctctgtcagattcatggtttactgagagtgtgcttaataatggcctctcctctacctcctactgtgggcaactttttttttttttttttgagacagggtctcgctctgtcacccaggctggagtgcagtggctgtcttcccacctcagcctcctaagtagtgtagctgggactacacccaggctaatttttttgatttttagtagagacaaggtcttgctgtgttgctcaggctagtcttgaacacctgagctcaagcaatcctcctgcctcggcctcgcaaagtgctaggtttatgggtgtaagccattgtgcctggcctaggcagctttttttttttttttttttttttttttttgagacggagtctcgctctgtgtcacccaggcttgagtgcagtggcgcgatctcggctcactgcaagctccgcctcccaggttcacgccattctcctgcctcagcctcccctcccgagtagctgggactacaggcacccgccaccgcgcccggctaattttttgtatctttagtagagacggggtttcaccgtggtctctatctcctgacagtgtgatccgcccgccttggcctcccaaagtgctgggattacaggcgtgagccaccgcgcctggccaggggaatagttttgacaattcctctggcaaattggaggaggagctgtctagaaaggccagtatcttgggtctcattgaggggaggagagaaccaaggtaaagggttggctattaggtaatcagtcgcggtaataaggggccatttggcagaagtaaaaatgaggtatctgatggctgtagaagggagagaaggcattattgcatagcatgctcctgggttgaggcctctgttggcagctgtgtcgcctgccctttctgtcctattgaagggccagtttctttgaagtctgcacaggaaataccagtgattcagccttgcagatttcttctgccttattgcagctgaggactggtttatctggtgaggaggaaagactgcatatatttcaggcatgtttatttgatacttgagtgccttcctgtgactggccagagacacttgttttgcagattgtcaaatttttggtacccggtggcaaggtggatgcaatgtgacctcaactcttggtcctctgaggtcacattgtatccaccttaccactgggtactaacgtgtgggcagcagctgcattctgcctagcgagtgggcatttgttcagtgcctgtacttctgtgatggcctcaatgaggagtgaggtaattgcctgcttttctagatttcctgtggtgtgacaatgtgagttttggagaaacctcttattccctaagaatttcctactatacccctcatgagctgcagcaaagtggactctgtctgattgttgacctccaaatgcccagtttccttaggtagtgagcagatacctaaagtaatgagtgcctattatatctgtcacagagctgagtatataaaaaagtatataatacaggatttccctccttactaaattattttattttgaaaattttcaaacctatagatattttgcaaaataatgtaacaaatacttatatacttctcatttagagtcactattaacattttgccaaatttgctgtctatttgtccttcattttctgaatctttttgactgttagatgtaaatatcatgttatttaatccctatttcagcaagtatttcctaagaaaaaggtatcttcctatataactacagtactattaacactcaggaaacttaacattgattcaatacatccagtatataatacttgttcagatttctcatcttttcccagtgatgtcttttattgagttttttaaaattcaggattcattgaaggatcatgcatgtatttatgcacttagttgtcatgactatcatgtctttagtctgctttaactttgaacagttcttttttaatctgaatgcctttttgtctttcatagcatttgtctgattcttcttgattagattcaggttaggcatttttggtagaagaactatatagattaatacaatagtttgattgatgaggctgacactaaaatacatagaagcagtatctgattttgcaagacagtatataatttagcacttatttgtgttgtctaatctataaaccctataggaatttacagaagaaggaattcagtaggacttggataactaggaatgaaatactttggcagaaagatggggtttggaaaatgaacagaattggaggcagttgggatatggttagataagctgtgatttgggcttcccatcctactattaaggttgtgtatcatgaaaagtgactttgagggttctgtatcttccatggtgtttgcactgctagaagcctaatggtgtagagctcttgctttggcatcagacaggtctagagactgtgcccagcattttgccagttacctaaccttggggaagttttctcatttgcaagatagagtattaataactatttaaaaggttatcgtgatgctcacagtgagacactacataaatatttgaattaaaatatttgaatgcctttaggggggtgcagcgtttcctagatctgccatgtgccccactggatcattcattttgttttgtttggatacgtggtttcgctctgttgcccaggctggagtccagtggcacggtctcagctcactgcagcctcccaagtgggtgggacccaggcacactccaccacacctggctaattttttgtatttttgtagagacggagttttactatgttgcccaggttggtctggaactcctgagctcaagcgatctgcccaccttggcttcccaaagtgctgggattaccgctgtgagccactgggccttgcctggataatttgtttctgttacctgcctgacccctgaagatgtttgaatttaccactcctggataattgaaagcagggaaatgagaaaaggcttggctcacgcagagagaagtgggaagactggcttgatcaattcagagtatattctgtagaatagtgggaaataaggttgaataaatgacttgaggccatataatggaggatttggaaagttaagccaaagaatttagatatgatgctttagggagaagaaaactggaagatttttgagcaggaggagagacacttgaaaatgagagtggtgtggggcctcctgaggaagaagctttctggcttaaagactgaaatcctaacagggcagggccttcacagtgctgaccaagtgtgggtgtggcttggcagtcttgccacagaaggccagaatttctgccccagtgactcttcctgctctgccactgactcaccccgttgacctggcctgcatggcttcccttctgcttgctgtctgatccacagaacgctggggttgcccaggataatgtgaggctgagctcactaagagtgggtgggttaggggaatgaataatcattcctgtccctttgccccttccctaggtggaaactaattctaagccagactgctggagatcaccctgttctagtgtgtggaggcttccaccaggaggtaagtcaaaatggtttctgccctctagtttttgataggtcagctttgtcctgagcaggatctctaccatttactttttccctgacccagattcttcaaagtgattgtctttgtctttcaattatttgaggcaaacaggttactgtaggaggagagcagagaggtttaataaagatatttttctaactgtgggagggtggtgtccagaggttttcattggcccttgctctgaggtagattgcccagaactcttgtgagccagacactaaacattggccattgaggccactgcagagaagtcctggtttttaagccatcatttctctgctactgggtttcagaaccattcttggtgtgctttagtgtcccaagttatttctgtcccttttgatcaggggagtgaaggaagtgagaagcaggggaggaggagctgtatacataagtatgtgtgggtgcattatgctgggagtttgggtgtctgggtttctcatcctgactgttgctaaccagatgtgtgaccagggacaaattgcctaacctcaatggactgaacttttctcatatgtaaaaagggacagttaggattatatgatcttgaagatttcttccagggccaaaatttatcattatgtaatgtgtaattataaagtgatataatagttgaacaaatgtgacagatattgtacatgtcttgcccccttgattgtaattatggggcaattagaatgtttttaagtttgaccccttcaaagtaattgtgttctcagcctttagatttcctttggtgatggtgtcattgcctcagactgcctctgagccaatcttttgaatatcctcagaggtagcaaatctttactcttagcttggtggattcaatttttagaaacagccagaagatgccgtgagccaaagattcatgcaaggcaataccttttttggtgaaggatgaggtgtgactataaaacagtaacaccgaatttttctgtttgtctcacatggagtagactttaaaggcagctcccaaagaagtgttttgttagaataagtaaataacttcctaaggagagtattttgattgcagttttcatttgatttaataagattagaaatgtctgctggaaaacaagtcactttcctttatagtgactgtgcatatgcttgcttataggttggggtgactagataatggagaaaactggcctttcttttctttttttttcccagacagggtctctctctgtcacccagactggagtgcaatggcgggatctcagctcactgcaacctccacctctcgggttcaagcgattctcctgcctcagcctccctagtagctatgattacaggcatgtgccaccatgcccagctaattttttgtatttttagtagagacagggtttcaccatgttggtcaggctggtcttgaactcctgacctcaagcgatccacccgccttggccgcccaaagtgctaggattacaggcgtgagccaccgcgccctgccaaaaactggtctttctcctggtactcctcccaaatcacaagtgtgttgagggctgaaacacaagtgtgttgagggaacaagtgtgtttcaacatgttgctctataggaaactgcagctgaggagccattgcagtcccatctccagaagacccccagaaagagttggaagagttcttcaggctgtggcagccactgcccaccaacacacccaaatcaatcaagatgaatcccaggtggtgaggctgaagcagatggtttggtagctccagtctttttttaggcagaaatgatgtattaaatcactacattgatttttttgttgttgttagcagttgtgggtttgaaaaaaggtaggcaggaagatggtgaaggggtcaagcctaggggctgttatcttgaatatatgcaaattaagctgattatattgtagtgccctgtaacctgttcctggaaacagtggtcttgaaaactcatcagttaaatgaggtgttagacagcctggtcaaaagattctgtgactaagttactgtataatcatttgcaattctctttcttactctagacattgttttcctcatttttatattgaaagagttaagagatgctaaaaattctagatctgaaaattggataagcctaagaaggtttgaggtagggaaatgtctattctaagctgtttgactactggacttggggtaggagtggaatttcttttttacctcctaaattatagttactttactctctacttatagtcacagctgggtgatcagacattaagtagctatttaatgagaagcaggcactggaagcttgctccagaaaaacaatcacaggacatgttggtcctgagagaagtcattccttggtaggacctattgtttgaaggaggtgggggtgaatttcatcaaaatggacagtgtggatattgtgattcagaggattgagagactttgtttcctgctgttattaatttcaagccttttttaaagggattctcctagtgattggtacagtgggattcatttagagaaaaagccttgtgtaccagttggaagttaatgcccaagagcagggccagttgctggaggacaaagtggcctaattagttgcttttcaatacttagatcctacaggctaccccaaagataaaataggctactttgtagctcagatcttccagcctagtgcctagcaagctcactaagaagaggaggtgacctgtagaatccacacctcttaatctccctatttctcttctttccctcattgccctttagttttaattaggattgtgtaaacatagtcatcttgccagtcctcttaaagtggcaggcccttggcattttctgctggtcactcatgctatatgtataacttgcaattagagggactagctttgacaatttgccatccctggctgtaccactgaaagaattcagataagggccaattggctgtcatttactcaggcagcatatttagtacctactgtgtgcaagcagtgtgctggagtggaaatgattttaaaatggtttctgccctccaggagtttagtaaaatgaaacaagtattacagctagcatccacccagggaggattgtaattaagtttgtagaggaacaagcaatatgggagcacatagaggaaagaacaattgttcctgatggtgggggcgataaggagagtttgggagaaggcatttgagccaggttgtaaaggaagaataggagttcagtaggtttaggagacagggcatttaatggaggtcacaccatgggcaaaggcacacagcttggaaaatgcctggcatgtatggggaaaatgtgcctgaggtagaggatattttagggaatgaactgaagatgaggctgggaaggaaatttgagggttggatcttagagaaccttaagcgttatgctaagaaatttggattttattcttcatgtaattagctgttaagtgtttttgatttacagactaacatgacccaatctatgttatttaggtcctgtctattctttttttttttttttcttgagcagagtttcgctcttgttgcccaggctataggcgtgatctcggctcaccgcaacccccgcctcctgggttcaagcgattctcctgcctcagcctcccgagtagctgggaatacaggcatgtgccaccacgcccggctaatttttgtatttttagtagagatggggtttctccatgttggtcaggctggtctcaaactcctgacctcaggtaatccgcccacctcggcctcccaaagtgctgggattacaggcatgagccaccacgcccggcccggtcttgtctattcttaagtgtaaagtcttagaggttaggttgagagaaggtggtggtcctggttcttacagtacagtattaagtttgtcaggcatctcatgtttgagaacttgattcctcagttatatttactaaaacaactccaaaagcaagaaggcaggaagtggtcagagctgtgtccctttaaactgagctcactgacccaccaaagatgattttcttaggcatatacattatgaacagtcttcttgctagtgggttgcttactactgataatcctttgtggataaaatttcacacaaggagcaggcttttcattatagggcagaaaccaaaaacattttttaagcctgattgaaaaatagtatatattcattctaggatatgtgaaaaacgcagagaagtataaggaagaaaactgaaatcacccgtaatcccactatctggagaaaactactgttcttattttagcctattttctttcagtattttgtgcttgtatatttctggttttgcaatttccagatcatatattacctaaaattttatattctgcttttttccccatttaccattttttcattatataaatttatatatactcttcataaatatttgtagtggctgcataatagtctatcatataggatttttatatgctttcaggttttttcaaataataatggaatttttttcaaatcatttttgtaatagatataacaaataagtccccaaataagtctttaccctaattctgccctgcagaagtaaccattatttattaatagttttctgtgtatctttatatgaacattattatgcataagtttttgtctacgtttttggttattttcttatgatacatatctacaaatagattactagattaaacaatatgaaagtaattttttcctaattgtatatgatggtactatttagaaaacatgaaaaataatgtgttaagggggaaagtaaaaggcacccataattccacaactcagaaatgaacattatttggtatacttccttacacgtatacatacacatatacaaactcacaagtatgtggggagagggataaatatgtatatgatatatctatctgtctataaatatttgtatatatagtttcaaaaatggggccataccataatagttttatcctgcctttttgtttgtttgtttgttttgagacagggtctcactctctcacccaggcttcagtgcagtggtacgatcacagctcactgcagcctcaaccttctgggctcaagcaatcctcctacctcagcctcccaaatagctaggactacaggtgcatgccaccatgcccggctaatttttgtattttttgtagaggcagggtttcaccatgttgcccaggctggtcttgaactcctgagcccaagcgattcacctgccttggcctcccaaagggctgggattacaggcatatgccactgcacccagcctatatcctgcttttaaaattcaacctttcttgagtatttccccatgtcattaaaattatttaaaacttttttttttttccccagagacggggccttgctctgtcactcaggctggagtgcagtggtacagttgcaatcctagctcactgcagccttgacctcctgggctcaagtgatcttcccgctttagcttcccaagtagctggactacaggcgcatgccatcatgcccagctattttttttatttttattttttgtagaagtggagtctactatgttgcccaggctggtcttgaactcctgggcttaagcaatcatcccacctcagccttccaaagtgctggaattatagacgtgagccactgtacccagccaaacttatttaaaacattttaagtgactgcataagatttcatcatatgtatattcttgccataatttaagttattgttagatatttagttttccttcagtttttcagaatgataaataattctattaatgtccatatatctttgtatttcagattatttcctaaacttttatttctgtgattggaattatttgatgaaagaacatgagatttttttttttttaattctttttgtttcttttttttttttttttgacacaagatctcactctgttgcccaggctagagtgcagtggtatgatcacagcttattacggcttcagcctcccaggctcagactcaagtgatcctcccaccttagcctcctgagtagctgggactataggtgtatgccaccacacctggctaatttttaaattttttgtagagacatggtctcactgtgttgcccaggctggtcttgaactcctgggctcaagcaatcctcctaccttggcctcccaaagtgctgggatgacaggcttcaaccattgtacccagccagcttttttttttttttttttttttgagttttggtaagatgtatgtaacaaaatttactatcttaggctgggtgcagtggctcacacccatcatcctagcaccagcactttgggaggctgaggcgagaagattgctggtcttgaactcctgacttcaagagatcatcctgcctcggcctctcaaagtgcaggtgtgagccaccatacccagccaaatatgaacatttttgtttctttgtttctttgttttgagacagggtctcactctgtcacccaggctagagtgcagtggtatgatcacagctcaccacagcctcaacctttcagggttcaagtgatcctctcacatcagcctcccgagtaactgggaccacaggtgtgcaccaccatgcctggctaattttttattttttgtagagatgaggtgtcactatgttgcccaggctggtcttgaactcctgggctcaagcaatcctttcacctcagcctcccaaagtgctgggattttgggcatgtgccaccaccacacctggcccaaatatcaaggttttgttttgtttttgagatggagtttcgctcttgttgcccaggctggagtgcaatggcacaatctcagctcactgcaacctccacctgttccaggttcaagtgattctcctgcctcagcctcccgagtagctaggatgacaggcatgtgccaccacgcccagctaattttgtatttttttaagacgggtttctccatgttggtcaggctggtttcaaactcttgacctcaggtgatccgcccaccttggcctcccaaagtgctaggattataggcattaattttgatttgtattgccaaattcctatccagagaaccacttaatacctgcttatttgtgtaagaaaatgcactgttctttgtttgttttttgagacgaagtctcactcttgtcccccagtctggagtgcaatggcacgatctcggctcactgcaacctccacctcccaggttcaagcgattctcctgcctcagcctcccaagtagctgggattacaggtgcgtaccaccacacccagctacttttttgtattttaagtagagatggggtttcaccatgttggccaggctggtctcaaactcctgacctcaggtgatctgctcgccttggcctcccaaagtgctgggattacaggagtgagccaccgcgcctggcctaaaatgcactgttctttgattattaatttctcattcaaaattctagattaagttaaatttcgtggagagtatgatagctttttttttttaaccattattttgtaaaaccaaaatttgggagagaatgcgaggagaaattaaaaagatcactgatattacctaaatgaccctattacttaaaatgacgttttgaagtaagaggaaatgaaacaagttacactgagttcctccactgatgatatggggaggatgacacctttcctgcctgccgtataggaactgaatggcttaaaattctctggagaaatgacttctttcatggccaggatcttcagaagggtacaatctagaggggagaattggccttcctttcccacaatggtcaggggccctagctctcagcagtttgttcgacttgctggaaatgtgcagctgcttcctagcgaatctgctagcaaaagggaaggagacacctgtgttgtgttgtgtggtgtggtgtgatgtgtatgtgtgtttgttgggggtgtttagcagcagacatagtggagtttgctttggttttgtattattgtggtgtgtgggtaggaactacattgtcaaaatcattgaaggacagtaggaaccagatgaaattaaataaggggccaggcatggtggctcatgcctataatcccagcactttgggaggcagaggcaggattacttgagcccaggagtttgagatgagcttaggcaacatgacaaggccctgtctctacaaaaaatacaaaaattagccaggtgtggtggtacctgcctgtggtcccagctactcaggagtctgaggaaggaggatcgcttgagcctgggaggttgaggctgtggtaaactgtgattgtaccgctgcactccagcctgggcaacagaatgaggctctgtctcaaaaaaaaaaaaaaaaaaaaagaaaagaaaagaaacaaggaagacgaagagtagtgcatagaaaatcttttagtgttgcaacccataagtaaagataagtcttttgacttcatttgagtgttttgggctctttcctttgggattatataccagacctatactgcatataaagttatttgaaaatgagccacacactgtaacatagccatgctctggctgtggccaattagaccataactaatccccactgagaagcttttctttttttgttttgagacagggtcttgctctatcacccagattttggagtgccgtggtgtgatcatagctcactgcaacctcgaactccttggttcaaggggtcctcctgcctcagcctcccaagtagctggaactacaggcacacagcactgtgcctggctaatttttaattttttaaatttttttagacagtcttgctctgtcgccaggctggagtgcagtggcacgatctcggctcactgcagcctccaactccttggttcaagtgatctcctgcctcagcctcctgagtagctgggattacaggcacacgccaccacggccagctaatttttgtatttttagtagagatggggtttcaccatgttggccaggacagtctcgattctcctgacctcgtgatccgcccgcctcggcctcccaaaatgctgggattacaggtgtgggctaccgtgcctagcctaattttttttattttttgtagagatggggtctcgctaagccttcctaagtactgggattgcaggcatgagccactgtgcccagacctgagcttttctttagtttttaactcttgttttttttgtgtgtgtgcgttttgttttttcgacatggagtctcactctgtcttccaggctggaatgtggtggcacaatggcagttcaccacggccttggcctcccaggctcaagcagtcctcccacctcagcctcctgagtatctgggattacaggtgcatgccaccacaactggctatttttctaatttttgtagagatggaatctcgccatgttgcccaggttggtctcgaactcctgggctcaaacagcaagcagtccaccaccttcagcctcccaaagcactgggattacaggtgtgagtcactgtgcttaggcaagttattgtttctgtttagaccccagtagtaaatattttaggctttgcagaccatgtggttgtaactactcacctctgccattggagaacaaaagcagccatagacaatacttaaatgaatgggcgtggctacgttttagtaaaacctgatttacaaaatatgggctgctaacttataggccatagtttgctggctgctggtagggggaattacacttgacagaaagaggcctagttttgatgggaaattgttaaaaaaacagctttgatgtctggacttactggttgtgtcactctagcatctctgaaccctcatgtttaaaatcaaaatggtaatacctttcataagaaataagaatgaacagttgcatatgtgaggagatgtttaacttttctggaaataagatataaattaaaacaataatatattctatcttatatattgataaaatatattggtagaagggtgtagatgggaatttttatcctctgttggtgagactataaactagtacacagttttagatggtaatttgggaatatctgttgacatttaaaatacacaagcttttcaacccattaattctaattattggtatatatcctagagaaatattagcttgtgtgtaaaattagagatgtgctgccagtgttatcaatacagcattctttgacatgcaaaacactgtgaacaacctaaatgtccagatgtagcaaaatgggaaaataaagttgtggcacattcttacataggatttttttaagcttttaaaagtttaaggaattgccagccatgacagctcacacctgtaatcccagcactttgggaggacaaggtgggcggattgtttgagcctaggagtttgagaacagtttgggcaacatggtgaaatcccatctctacaaataaattagctgggtatggtggtgtgcacctttagtcccagctaccaggaggctgaggtgggaggatcacctgagcccaggtggttgaggttgcagtgagccatgatggtgccactgcactccagcctgggtgacagagtgagactttgtctcaaaaaaaattaattaaaaatgtgaggaatctgttttttgctggtatggaaacatgtcaaataaatttgtacgtgaaaagggcaagttgcagaacatattatatggtatgattacagatatgtagaccaaacacacatacctgtatgtgaatatatacctgtatgtgtacatgcttaggaaaaatccaaaaggttgtacaacagacttctaacagtggtcacttctgagctggggagtgtcactggcaaatgtgggttgaggcttaatgaagagggagttttacattttactctagatacctccgtattatattatttcacagtgataatgtattccttctcctttccaattgtttggagagctcctgggcctgtctgcacttgccagggttaggagtgtgacaaagtagctagctgtgctcacatcagttgagttggaagcagctgctgagaccagaacagggagcacatgtaaggggaggagggggatagcatgtgcaagtgactgagagaggcagccaagacaggccatttccaatttaccaacagtaactatcacatgtcttgtcttgacattctccaagttactttgctctctgtcatcacactggaccctgaggatgattctctgagcaagggaggtagggatgatgatgagaccaggagtaatcaaaacatgggacaacaaggaaagtatgtgtgtagaaatagttttttttctttaacttgaaatacgtcaaggatactcattacagcattgtttgaaatggtaacactgaaaatagccattccctcaatagaaaaatatgtgaacacgttatggatatcccttatatggacttttatgtagctttttaaaagtatgagttagaattttagttattgatgcttggggagatgttgataaattgttagatgagataagttgcagagcaatgtgtaaagtttaaacctagttttctaaaaacagagaacaacaaaaccctttccaatatatttgtatttatgtttttgggggacacaaaaatatgttaccatttctcatcttgtaggaggccttggagaggaatggaaaggggctgggagattactaattttgtcttttatctaactttgtattgcttcactggttttgaagaacaaggaaaacaaacttgtataagcaagaaatgaagtttcctaaacatcgtttcatcttaattaattattattatgtttttttttgagatgtagttttgctcttgttgcccaggctgtaatgcagtggcacaatcttggctcactgcaacctccacctcctgggttcaagtgattcttctgcctcagcctccctagtagctgggattacaggcgcctgctaccacgcctagctatttttttttttttttaatagagacagggtttcactatgttggccaggctgttctcgaactcctgacctcaggcgatccacctgcctcagcctcccaaagtgctgggattacaggcgtgagccaccgcacccagcttagttttttgtttttttgttttttgtttttttttgtttttttttgagatggtgtctcgctctgtttcttaggctggagtacagtggtgcaatcttggctcactgcaacctccacctcccgggttcaagcaattctcatgcctcagcctcccaagtagctgggaatacaggcgcctgccaccatgcccaactgatttttgtatttttagtagagatggggtttcaccatgttggccaggctggtctggaactcctgacctcaagtgatccacctgcctcagccttccaaagtgctgggattataggcatgagccacctcgcccagctttaattgatttttaaaggttaacttttattattttttagtgagttaatgaagtaaagaaatatgaaagtcaaaatagagttttaatatggaattaatatgtaaatcttcttttggatttaaaggaggcatctgggtagtggcaggagaacgagcattgaaggaaccagctttgtaattgtagttatcaactttctgatgtgtgagctttaatttagtaaggttatttaataacttaaatgaaggctttagtgtccttatctctaaaacaaagagcttgtacaaggagatgtgcttcacaaatctgttatcccacaattgagctaccttttgagattagaatatatttcctttgttttaaaatgctttctttcttttttttttttttgcttttttaatattttaacactgaaattggggtgtattttacaattgatagtatcttccaattgtcactggccatttttttttcacatttttgttatctctgaaattgagatatctcatcattgatgatgatgtaggatagttccattttcaatgccatttttgttttcattaacaaaaatctccgccctttcctgggcttctgttacttccagtcctgtcagattctttcacatcactaagacagtctggattgggacaattgggtggatatgttatttgagtgtgcaagaattttgtacatccttatataactggtagatgtcctatatgtagctactgtttgagaaattgagtaaaaaatgtgacgcatccaacttagtgttcctgagttttgattatcagtttggcttgcctttttttttttttttgtcttctttgtaaagagaagggattttggtcaggcgcgatggctcatgccagtaatcccagcactttgggaggctgaggcaggcggatcacaaggtgaggagttcaagaccagcctggccaacatagtaaaaccctgtccctactaaaaatacaaaaattagctgggggtggtggtagacacctggaatcccagctacttggcaggttgaggcaggagaatcgcttgaaactggaaggcggaggttgcaatgagccaagatcacaccactgcactctagcctgggcaacaagagtaaaactccaactcaaaaaaaaaaaaaagagagatgggatcttgctgcgtcactcaggctggggtacagtggcacaatcgtagctcactgaagcctcaaactcctgagctcaagtgatcctcctgcctcagcctcctgagtagctgagacttcaggcatgccaccatacctggctaatttttttttatttgttgttgtttctcttgagacagagtctcactctgtcacccaggctggagtgaactggtatgatctcagctcactgcagcctccaccttccaggttcaagcaattcttgtgcctcagccttctgagtagctgggattataggcgtgcaccaccacacctggctaattgtgtgtgtgtgtgtgtgtgtgtgtatgtgtatttttagtagagatgtggttttaccatgttggtcaggctgatctcgaactcctggcctcaggtaatctgtctgcctcggcctctcaaagtgctaagattacaggtgtaagcttccgcgcccagctgaattttttttttttttgagagatgggggtcttgctttgtcacccaggctggtcttgaattcctgggctcaagtgatcctcccatctcagcctcctgagccattgggattacaagtgcaagcctcctgacctggcttgcctggtatttaataattacagtatgacatatatacagaaaagtacacaaagtttacagctcaaggactttccacaaggtgaacacacctgtgttactagcacctacatcaagaaacagaacattaccagcataccattagccccttcccagtcactatccccctattgttttatttttaaacacagtgaaactatacatagggatgatgactcttggttcataagtgagtggctcatgttatctcaggtgagtcttctggaaagagccccagattaggagccagaaaaccgtggttacatcgtggcccggttgctttttagctgtatgaccttagacaaggtaaacttaacttttctggacttcattcctctttggtaaagtgaaaataataatgccctcaccttaaacagctgttgtaaggttcatctgacattattggtaaacaggaaataccttgtaaatgggaaacactttgttagttgtaaagagccatacacaaataatagtcatttttgttgagagctgtggaatctcaagcagaagagaaaatgatgatccccaaatctattctctttatcacctttgctgtctcatttttttttgttgacattggtgtcactgtctttctgttaaattctcccaaaacaaaaataatataaaggtcctaacaggaatccccagagatctggaatttctcctaaagttttttacttcctctcttaatgccgatgcccactagatctatgcaaggcagagaccttggtaaatcaacaaacttcaatcgcaaatgcgtacatcacccatttacaggccttacaagcaagcatgatcttctcatagacactcttctgaatttattcagtcttccaaatggagcccagatccttatctctaaccccaaatcatatttttcattagttactgattatttctaactgtatatccagtagatatctcacgtctaagacctaactctcaaactgcttgccaatatagcaagacggtttagattttgggcttggagtgggacagtcttggatttgaaacttaattctgctacttattagcctcatgatctttgctaatgaagatcatgacagttgcttaacatcgtgaaagatttattctataacttgagggtattaatagtatttgcttgataggggtgatactatgttcaaatgaatggaaattgttattgttactcttacattttttttttttttgagatggagttttgctcttgtttcccagggtggattgcaattgtgtgatcttggctaactgcaacctccacctcctgggtttgagcaattctcctgcctcagcctccctcgtagctgggattacaggtgcctgccaccgtgcccggctaatttttttgtatttttagtggagacagggtttcaccatgttggccaggctggtctcgaactcctggcctcaagcgatccacctgccttgacctgccaaagtgctgggattacaaacgtgagccaccgtgcccagccactcttacattcttatcttgctttttggcacacatgttcatttatttgttcactcaagctaggaaatttagaggtgcttcaagaattttccttttctcattcttcatttatacagttgtccctcagcatctgtggggattggttccaggacttcacacagataccaaaatccttggatgctcaagtctctatataaaatggtataatattagcatataaccttcacacgtccttcgtatagtttaaatcatccttggattacttatataatgcaatgtaaatactatgtaaatagttgttacattgtattgtttagaataatgacaagaaaaaaaagtttatacatcttcagtacagatgcttttttttccccaaaatgtttttcatctcaggttggttgaatccacacatgtggaacccatggatacagagggcctactgtaattggttgtcagggcctgtcataaatagttctcaaagctattgttgcatctttattgtcattgccttacttcagacatacattacttcttgcttgtaacagacaatggtttttgcactgcattctgtaaagctttacagaactatagaactgacttaagaaccagggggaagcagagggaacaagtctccaaatatcccttacttcaaactgtcttcttctgtgtgtcctggggttctatataaaggttacatttaaatagagttcatttaaaatatatagtttggaacctttcattcattcaagaagtatttatcaagcactcatgctgtgccagccattgtgctgatttctaagaattcagcggtgagcacacagtttgtgatttcatggaacttaaggcagtaagagaaagataaattaataaaatacaaaaaggcgtaattaggaactatgggctgggcacagtggctcatacctgttatcccagtgctctgggaggacaaggtgggagcttcactttagttgaggagttcgagaccagcttggacaacatagcaagatcctgtctctacaaaaattaaaaataaaatagccaggtgtggtggcttgtgcctgataaagtactattattattcccattttacagctggggaaaatgagggcacagagagagtaaataacttgcccaaggttgcagagctattaagctataaacccagaatttgtattaggttgtcttaagttcagaccttgtaatcttagccattatgctctattgccttcctcctgtgtcttaccattccagtctgtactttatacagtttcccttctgaaacatagccctgatcatgctgctcccctttaccctcttcctttagaaaccttgattgtcttctcatcacctacaatttcttagtatgaggcaagtgcctcacaatttaatattacttacccttggttttttttttgagatggagtcttgctctgactggagcacaccagactggagtgcagtggcatgatctcggctcactgcaacctccacctcctgggttcaaatgattctcctgcctcagcctcctgagtagctgggattacaggcacgtgaccacacccagctaatttttgtgtttttagtagagacggggtttcaccatgttggccaggatggtctcaatctcctgacctcatgatccacctgccttggcctcccaaagtgctgggattacaggcgtgagccaccgcccctggccttacttattacccttcttatcatctgatgcacctccctaaaactgcatgccattgttcaactgtaatatggtctgtctttgcatgtgctgttttctctgcctagaatgcttttttactttttggtgaaactctacttatcctgctcatattttaatatctagcttaaatgtcacttcctctataaagcattccccatcatcccatcctgagttagtccctcacgctcctttaaaccagtacctactcttattttctcattctgaaatctttccatgaaagcaagaatcttagtgttctctttagctccccacctttcccacgcccctatatgctaagagcattgtctctacgtctgtaatgcctttcagagccacctgttttagttcctactgcccctgccctggcagtgcagttttctctctacctctgtcgctgccacctaagtccattttctgcctctggcctcactgttgtgctagagtcatcttttcaaaaagcacaagtagtataccattctcctgcccaggacttttcagtgcctcccacttctcttcagtaagtcaccctgggttgttggtccccactagccttgcttgtgttatcttaccttcctttcagcacaccccaagcccatgttctttggcttcatattatggttacagatgtgtctcttcctctacaagattataaactcaagtttaaagatttacccttgggccaggcacagtggctcacacttgtaatcccagcactttgggaggccaaggtgggctgatcgcttgagctcaagagtttgagaccagcttgggcaaatggcaaaactccatctctacaaaaagtacaaaactagctgggcatggtcctgcacaccggtagccccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactttagagctgatccgaccctagcttggttctcagtaatttgcctctgtgacttgcattaagccacatagctagtaagtgacccatcacccctccaggggctttcaacaccagatctactatgttttctaccactatggaggctgtctccagtaagagtattccccctgcgtttcaggttctttcacatttcttataattagttctgtgtttgtgagcaaacattgtgctagatatgttgatatgttgcctgtagggacagagccattttactcctctgtgacagtgaaacagggtggagaggttcttagctgttttgtagaaaggccttcttgagagagaactgagtgggcctgttggatgttataatgaatcctctctgggttttgatttgccctctgcttttctctccaggaagcctcagacttaccaacactgcctcattaatcagccattatcctctggagagggacaatgaggccatggtaaataagctcaaggtcaggctcctgaaacagcagtccttccctttagcaccagcatttccttccagcctccccctctaacccttgagacactgccaacatccctcctagtacaagacttttcttggtgcttgctgtttttagaggagttttggccctttagtgtttgtaaagctctcggatcctcagaaaaaaattctttagtgattaattttgaaattggagctgtttgattattttgattaagaagctgattttcggcctggcacggtggctcactcctgtaatcccagcactttgggaggcccaggcaggtggatcacctgaggtaaggagttcaagcccagcctggccaacatggtgaaacgccatctctactaaaaataaaaaaaattagaccggcatgttggcgagcgcctgtaatcccagctactcgggaggctgaggcaggagaatcgcttgaacctggcaggtggaggttgcagtgagctgaggtcgtgccattgtactccagcctgggcgacaaagcaaactctgtctcaaaaaataaaaaaagttgattttcatgaggaaaagcacacggcttctttgatttgctgagaatgtgctagcttttattcattcactcaatgattgcctatttaacagctgtagacaataatataggctggctgggtgcagtggctcatgcctattatcccagctactcgggaggctgaggtacaagaatcacatgaacccgggaggcagaggttgcagtgagcggagatcgcagcactgcaccccaacctgggcgacagagcgagactccatcttgaaagaaaaaaacaaaaaagaataatatagggacaaggtagacaacttactacttacatgactagatcacgtaagtcacctaattcctgagcctcagatttcttcatttttaaaactgcccagtgcttggttcggcagcatgtatactaaaattggaacaaaataaaataggaacgatacagagattagcatggcccctgtgcgaggatgacatgcaaatttgtgaagagttccatatattttttaattttattaaaaaaataaagtaaaataaacaaaactgcccaatacaatgccttctagtcttttctctgtcacttacatcctggcatagtaaagactatcattatcgttgctgttactgttgtaattcgtagctaatccagagcctgtcccctgcggtcatcttgtctaattctcaggacaaactgtaactttatagacctgcctggcagagtggagggtttgggtaagggaataacgactctagaagctagaactctagaagctgcaggtcatggagggccttgagtgccaggctaattatttgtgtgagaatcatcccatggggatgactggggacttgaactctcctagtacttatttgtttttgtttttgtttttttttgagacgtgtcttgctctgttgcccaggctagagtgcagtggcatgatcatagctcactataacctcaaactcctggactcaagcaatcctcccacctcagcctcctgagtagctaggactacaggcacacaccaccatgtctggctaattcttttattttttgtagagatggggatctcgctatgttacccaggctggtcttgaactcctgaggaatttgaactcctgagctcaaattatcctcccaccttggcctcccaaagttctgggattacgggcatgagccaccacacccagctccagtctttttttgtttaaactttcaaaaatgataatgtaaatcctgatgcgatggcatgtgcatgtagtcccagctactcaggaggctgaggcaggaggatcacctgaccctttgaaataacctttgtgctcctaaccagtcaccaccccgcttcaacctctatctgaactctactgaaatttatttatttattttaatttaaaattctttttttttctctttttttgcaatggagtcccactctgtcacccagactggagtgcaatggcgcaatctcagctcactgcaacctccgcctcccggattcaagtgattctcttgcctcagcctcccaagtagctgagattacaggctcctgccaccacactcagctaatttttgtatttttagtagacatgggattttgtcacgttggataggttggtcttgaactcttgagctcaaacaatctgcccacctcgacctcccaaagttctgggattaaggcatgagccactgtgcccagccctccctactgaatttaaagtaatttctttccttcctttcttctctcttttccttcctttgttcctttctctctctctctctctccctctccccgctctccacccctttctttcttctctttttcttctttttttgagatggagtttcacccttgttacccagggtgtagtgcaatggcatgatctcggctcaccacaacctccgcctccaggattcaagcaattctcctgcctcagcctcccgaatagctgggattacaggcatgcgccaccacacccagctaattttgtatttttagtagagatggggtttctccatgttggtcaggctggtctcgaactcctgacctcaggtgatccgcctgcctcggcctcccaaagtgctgggattacaggcgtgagccaccgtgcccggcccttctctttttctagaaaggttttaccactcctttcccgctcttctgaggacagtaagaatcaggcaggagccatgtggccgcctgctgcctgtctaggctgtgagaggggctgtggaaattctgctgctgccacaggagggaggaagaggagggaaagcctggcgaaactggccaggctccttgggctgtcctgaagagctggcccagaaacttggcagctttgcagaggggttctaggggaaggttcagcctctcggaagctgcacagctggaagctgttgccttgagtttagagcaaggggccaggctggggagacctcttgtacgcttttgagacaatatcaattctatctgggctaggaagcttcagggctgatgcattgccatatgtggccagggcagttttagcaggcctccctcctattttcaccttatacattttctggagcattgataatgccagtctttaaattaagtttggccaggcctgtgatggctcatgcctgtaatcctagcactttgggaggctgaagcaggcagatcgcttgagcccaggagttcgagaccagcctgggcaacatggtgaaattctgtctctacaaaaaaatacaaaaattagtcaggcgtggtggcatgcacctgtggtcccaactactccggaggctgaggtgggaggattgtttgagcccaggaggctgaggctgcagtgagccatgattgtgccacttgcactcaagcctgggtgacagagtgagactgtctcaagaaaacaaaaacaacaaaaacccaaacaattatgtttgccactttgcttttctgtaaaagttttggtatctgctttgcctttgctttcatggtgctcctttggataagaacttccatttctactaatagtgattgctaactacagactacaaatgatacagtgggaatagcttacagggcctggaagaagcagcaggtgatggggagcctacagcaatgagccttggtctgacccccacccccacctcatcccaaccacccaccacagtcattctctggtggccagaaagttgaatttgtaaacctgacatccagatgtagtttggagaagcagatttaaggagccctagtgtgctaggtgttatgggggatcacagagagagagaggtggaactggttatgcccttgaggaatttccattctagatgtgaagacaagattttcatgcatatacacataagtgccaagagtaggaggtagttacatttttcttatcaccagtgtaatacaagattattaaaaataaatgcaaggccaggcacagtggctcacacctgtaatccagcacttgggagcctgaggcaggcggatcacgaggtcaggagttcgagacaagcctggccaacatggtcaaaccctgtctctactaaaaataaaaaaatcagctgggcatggtggcaggtgcctgtaatctcagctacttggtaggctgtggcaggagaatcatttgaacccaggagacagaggttgcattgagctgagatcatgccattgtactccagcctgggtgacagggcaagactccatctcaaaaaaaaaaaaaaaaagcaaacatacagcatagaaagtccccaagtgaatgttccctacaatctaactcctccccccccccaaagtaacccctgttaactgttaaatatttgaggagttaggaatattaaatcaaatatattaaatatttgagctggaccctaaagtaaaatctagagaggcagactgatgggaagaaggcagacagacagaggatccagtctcctgctccaggcagaataccctctctggcttcccaaacaattggtgagccaacttctgcttggacaccttggtgacaagggaccaaaatgccaagtaggaattagtctgcaggaaacacccatcctatgccttacatgctagccagtgtgttggacaccttataggtgttattgaattaattttcattgctttataacaggtgtctttattcttgttttacaaatagggatactaaagttcagaagtttcttgccaatgtcaaatagttagcagcatgtggtagagacttctgccatttacttgctatgtgatcttggcaaattatttaatcttgtggctcaatatcctcctctctaaagttgggtgataatggtacctacttcattaagggagtttttaagattaatgagttcgtacatattaggtcagtagaatagtgtcgtgtacatagtatgcactcagtaagcattagctactatatgtctttctgtctctctgtttatctatctgtccatttatttatgtatttattgagacagagtcttgctctggcacccaggctggagtgcagtggcatgatctctgctcattccgagttcaaggaattctcccaccctagcctcctgagtagctgggactctgacactaaaaaagacactaatttgtttctaaatcatgaagttttactggttatcttatatgtaaaacattttagcctatatattataaactgtagccaatgattgtgacctctatagtatagctcctagtagaaaaagacaaagacaactgtgggccaggtgtggtggttcatgcctgtatcccagggctttgggagaagcatagaatttttagagaagaatttaaaataatgctgtgcctaggcaacatagtgagagcctgtctctacagaaaaaaaaaaaaaaaaaaaattagccaggcatggtggcacacacctgtactcccactgcttgggaggctgaggcagatggatcacttgatcccagaagtttgaggttacagtgaactatgatctcgccactgccctccagcctgggtgacagagtgagaccctgctttaaaaaaaaaaaaaaaaaaaaaagaactccgcctggctaattttttgtttttgtttttttgtgtggttttttgtattttttggtagaagcagggtttcgccatgttgcccaggctggcctctcaaagtgctgggattacaggcgtgagccaccgtgccccaccagctactatttattatactctgttttctctcttgttctgacatcctgtcatctcctcagtttaattctgcatatcatccctcatactttcctcccctgtacagttcctctctctgcctcctatcagttctttaccctgtctccacaatgtctctcactgcagcttccacctgggttcaagtgatcctcccacctcagcctcccaagtagctggaactgtaggtgcgggccaccacacccggctaattttttattcatgaaattttttgtagagatgggatctccctatgttgccccggctggtctccaactctcggacttcagtggtccacccaaagtgctgggattacaggtgtgagccatcgtgccaagccccctttccattctttcttaccttaccctcttgtgtgccctcattacctgtctcctgactgtgcagcttcctgactcacctcattgctgctagtctcattcaggtatatatcagaataaacttggggcacagtttttgtcataccacagctctgtgttaataacaaacaaacttacaagtctttgattccttggtttgaggttcaagattctcctagctctctgaccccacctcactcttcaagccctttctcccactgcttccatgcctcctctctgctttctcttcctccccacacctctctgtttctatctggggaaatgctacctgtgtgtttcaaggtccaaattaaaatggcacttcattttcgtaatccttccctattctaaactggttagaatttttctttacagcttttatggaagttagcacaccagtttgaaattaatcttcaagtcatatttcttatctcctgtgaattacaacctacctcagtgcggatgctgggcttaattcatctttgtatacttcctacagtttcctataggagtgccttacacatagtaggtgctcagtaaatgtttgtggcataagattagggggtgcctgttgaccatctggtgggcttccctttcagccttggtgaagttcgctattcagtggggggaaatgctgtgattttgtcttctaagagtcagacatcttttgttttcagccatgtaggagaagcagagtctacaagtcccggtgcctgcgtctgttaagggctgcagccagtgcctggcgtactcggtctcgtgccttggcccctcagcccctccccataaatgctcagcggaacaggggattaggttctggcagcacagctgggattttggcggccattccacagccgacaatagcacgcagcacaggacagcgcaggcctgtactccagggccagaatctgcctgggcttcttgtttgggtggcggagggggaggagcgggcacagcacggcatcctggccttgccacgcagaaggtatgggctggagagattccctcggggaatggatttagtgggtggccgtgtcccagagcagggcaggcggtgcccatggaaggtggcagggcgctttgtgtgtgagtggcatggttgtacttaaagacacagcctgccctggggccggcaggaaggtgcccccgatcagagggcctgcatgttgcttgttcttcaaagcctctgttcccgggtcttcctccttgccctgcggtccgccaggcaggggctgatctaattatcaggacagcccttgtcctacccttccattgctgtccagagagatggacagattattactgctgccttaaactctgggtggaaaacagagcgaagggggagtgtccggttgatcccagtttgtcaggcaggccactgtaagatgtgttttgtgtgtttatgccacagtttgccttggctcttgctgctgttggagttcagtaattttgcctgcctgcttgtgccttcaccctcaacccgccgcccccattcgtcctgcttttcttgttcgtggaccaagcctccagccttcccctttgcagcccctcctctccagtgcaccccctccctctgggccccacccccactgagagtcccctgcttgctgtcgctcccagatcggggaagcttgctgtgcctttaaagaaagcagactcctggctgtgacgcacttctggctgtcagccaggaagatcgctcctgccaggcagactgagaagaaaaccaacaacttttcttttgtgtgtggggttactttccactggcccccccttcctcctctcctttcaagatttaaatgctaatggcggattaaaacctgtagatacgtttggctttaggagtctggtaaggcccccccgcaccgagactttttctccctcactctttctctgggtttttgttcaaacatggacgagggggtggggtggattctcccccctcacctccctttcctgcgccatccttaaaggggagggagagaagagggagagcaagtaaacatactcagaaacaggcgctgtggagcagagcttgccaacatccgggagttggcgcctttcagagcaaagggttgctttctttcccccttgcgtagatgtcagcatgtttttgttcagagaaggaaagcgtgtttgcctgcacgttgagctgtagagacagctcaggagagggcttcaccatttctgcgtgaggccgtgggtgtgtgcacggtggtgggcagtgaaaaaaggttcattttgtcagctgatagggaccagggtgtgtgaatatagtggtggggggcccaggtcagtgtgtgtgtgtgtgtgtgtgtgtgtgtgtgtgtgtgtgtgtgtgtgtgtatgtgtacgcgccccagtacaatacatggctgcaggcctggttgcaggtctggttcctgattgcagctcttttgccatcatcctgatctggaccctccagagaacggggagaaggggcagacatctgtaagccacttttgaagaaaccagagaagcttggtttcctctgtaatccctcccttgttcctctccagggctttggggttctgtgccaaactctaggctacaaagatggagtggtctgtgtgaagaggaggcttcagcccaagctagtccctttagatggaccaaactggtttgccccgacctcaggaaactctttggacttggaccagacggtctacccaggactccccaggaattgagaaagattgtttttctctgtatggcgtctcttggagccactggtcctcttgccttttatcttctcagaggcaggggatgtaccagcaaagtatttcctatgctgtttttatagcttattagcctagggcaaggtggcttggcccctctgggtaacctgccaggtgagatctcggtgtttgcttgcatgtgcctcctggcctatccgtcccagagttggaggaggaggagccccaagatcagggttttcactctttggatgtgagtgtctctcagatggggagtatctttctaagaaaggggtacagagcatggaattcttaggctacaggcaggcagcgtctcagggtaagtggtggtaaattttgcaagtgagcactggcgcacagatggggcagccatttcctttgtgagctgtgaggctgtaggcctttggaactatcaggtggagaagggggtggggttctgggaaggaccctttgaggtgggagcttgtgtgggctttgggccctgaaattctgggagtgggagttagcactaagagaatgagggttcagcagaagcaagggcccatgagctgagagatcggtatagtttaacaactctctgggaccaaaggtcactttggtgttatcttgaggtaggtctggtgttcccttgatgggcagtaagtggctaagaggcagtctcaaaggagctggcacccaggccaagggcggggtaaggagagcagtgctgctgcagctcagaccctctggcctttggcctatcacttgttctgtacttaaaactgaagctttttcagaacagacttcagagctcagcaacttgaccctctggtcctgcttcttgtgtctgagcaggtggtttacattagcctcagccctggtaggaaatcatggctaggctttaactctttaaggtccagagagggtacaggcagagtggctgcgtgtctctttagtgtcactttccttatcttgatatttattttctggaaacaggggttactgtaaatgtgggaatttgtcctgatgtgggggagctgcattgtgtcagtttgggaaatgtaaaaaggatgcagggccttaagtttataacgcaactgcttctgtgtccttggttacttcttgagaccagggaaaagagagggtgccttaccagctcggtgaggcctctgttttagattctgggggaatttctttctcagagaatcaggtagatgggaactccaaaggtgccctcagagggcctggccttttgtttctttgtttattgagtgagggttgtgggggggacggggggtgcctgatccagctggggtggatctcagcagatccttctgtgaaatggttccaggctacaatcgcaaggatctgtttttccatcagcatcacccagtgtactgggtggggcctgcctcagatttcagggggagggtggggaggatggtactctggctgggagcccttgggttcccagccaaagtctgcttaaagctatagtcccaatgtagaagacttagctgtgctcctggcttcagtcattccttacccagagaagagggaatggctggggctctcctgaagcctctctcaccctgatgttctgtctctaggaaagtacctctttacaggcttagaactgaagagcagacaaggtccttcaggagttcctagtggtgaatattgggttcctcgtatttctgtgcctggggaacacagaaaagaatatttagccttgacactcattttcttgaacagtggaactagttttagacaggctctcctgggaggacctcagggttgtatgttttgcctctgagatgaagaggttggttaaacctcaggacatttttagtagcacagctgtgagtctttcaaagggggcaagatctgcctacagttgcagataaaatttcgaagtgttgggcctcatcaaaaggactgcaagtctataggcagcagtgaggatgggggagcggtgatctcagcctcattccttgtgatttaatagctcagaggccttttttttaaagaaaccccagttgagtgtctggctgttgccgccccaccacagagccaagtgtggtccctcgagctttagtcttgtcagccacagaaaagccttattgcagtgcagtagttggggctatctgcatccatccatgcctggcctcaagggctacataatcttgcccatggatagggtatacttgatgataattatccaagactgaggaacataagccccttagcttttctgccctcctgagagctctcttaaccatttcatttgcccttgccaaagcccaggtgaattggctcaattccaagactgatgctggtatgacatgtggaatcatgttggatgttgcagggtcaggaagcacttaattgtaattagcatttagttatatttagcatttaattattttcttctgttagtgcttcacatatgtttaattttactccctaccctgctataagcccctcaaaggcaaggaccatgtcattgtctcccattttccatgtggcttctagcacaggatgatctttttttttattatttttttttgagacggagtctcgctctgtcacccaaactggagtgcagtggtgcgatctcggctcactgcaagctccgcctcccgggttcacgccattctcctgcctcagcctcccgagtagctgggactacaggcgcccgccaccatgcccagctaatttttttgtatttttagtagagacggggtttcaccatgttagccaggatggtctcgatctcctgaccttgcgatccacccgccttggtctctcaaagtgctgggattacaggcgtgagccactgctcccagcgaggatgatcatatttaggaactaagaaaatacctttcggttggctgataaatagagtatacttggataggaaggaccaagagataatggggagtgaattttcagattttcgtatctctttcccttactagacagtgagcaccttctgggcaagaatggtgtctttctttatccccaacttgcatacatgagactggttccacagagcccacactctggagatgctaatatatggggagacttacaagtgatgtggctcttaccactcttgttcctccttctagagtaattacagactgagcacgtgtggcaggagatgggggcagggctcattgtgcccctggagattagtgaaaattgcaagggttgctaggaggtgttggtgaatatttagttaatctggtctgtggtctcttgggtgggttggcaggcaggtggcagaatctcaatgggaaaggaaattggggatgagaacaccaggacaggtgcgtaattttcattaaatgtcccatgggatctcctccggaattgggctcgacctcatccagagacctaagtttggatattctcaatcccccatttgaactgtgtttgtgagacatttctgtggaggatataaaaatccagaaactagaacagtttccccaaggacttaggtattgttaggtacaatttgggtacctgtagaaagagctagaaatcaacatttctgcttaagaacagtaattatttattgacaacctaccatgtgccaggcaccgtactatttgctttatctttaagcatcacaataacccagagaggtgtatgtggatcccattttgcagataaagaaaaagactgaaagaggttatgttgcttgtctaaggtcctatgaccctggtcacattaaatcagcatccagacccaggtctgtctgaaaaccatgtttgttccatatttaagggcatcatgtcccaaagagtagggttgaaggccagctttggatgttgtattttctgtggaactgaaaaattacatggggtagacattgagttaaatgcacaattctttcctgtcgtctctgatgtaagctctatagtaattgtcatgtgtactcagctttctaaaaattcccatggtgtcttggtggattcagtgaagagtgatttaagtgttgagaattggcaaattgaaccatttcgcctttatttcttgatcatggatatctgatatgattaactgcttttcttcctctcttgggttccaggcgcattggagtgactgtctggcatcaccaagatgacactccacgccacccggggggctgcactcctctcttgggtaagtagtcttcctctcttttgttggctatacttctccaggaagcttgagagagttaggagaggagttttgtaggagccagggctatgtaaagtcttctcatttctagactaaatagttttcctttagacagcatggaaatgcattttcatctgctctgtgtgtatttttctgaataaaagggtaaatgtgggccgggtgcggagcttatgcctgtaatcccagcactttgggaggccgaggcaggtggatcacctgaggtcaggagttcgagaccagcctggccaagctggtgaaacccccccgtctctactaaaaatacaaaaattagctggctgtggtggcgagcacctgtaatcccagtcactcgggaggctgaggccggagaatcacttgaacccgggaggcggaggttgctgtgagccgagatcacaccattgcactccagcctgggcaacagagcaagactcggtctaaaaaattaaaaaaaaaaaagggggagtggtaaatgctgaccttaatgatcaacatatgcagggactttggtcttcaaaggcctttaatctaggacaaggttctcatcactctcttaccacctttctgtctgttgccattgtccatcagcaaatgttgccttgccgattacttcatcaaaattcttttgctagatcattcatacattttctaccagagacagtggcaaatgaaaaaataatagagtgcattggatatttaaagctagagaggctggatgtggtggctcacacctgtaatcccagcactttgggaggctgaggcaggaggatcgcttgagcccaagagttcaagaccagcctgggcaacatggcaaaaacctgtctctacaaaaaattaaaaaatcagctgggcatggtgtcgtgcacctgtagtctcacctacttggcaggctaaggtgggaggatcccttgagccctgaaggttgaggctgcagtgagccatgattgcaccactgcattccagcgtgggcgacagagtgagaccatgtttcaaaaatatatataaaaataataaataaagctaaagaaacagaggagaccatggagtgtggtgataaatatgggtctcagagtcacatgcccagcatagaatcacagcactggtctctctgacccagggcaagttggcctctcagtatcttcagtatctttttttttttgagatggagtcttgctctgtcaccaggctggagtgcagtggcgtgatctcggctcactgcaacctctgcctcctgggttcaagcaattctcctgcttcagcctcccgagtagctgggattacaggtgcacgccaccatgcccagctaatttttttgtatttttagtagagacgggtttcaccatgttggccaggatggtctcgatctcctgacctcgtggtccgccctccttgacctcccaaagtgctgggattacaggtgtgagccaccacgcctggccagtatcattttttttaatggggatgattttaaattaaaatacctcataaagttctaatttctcttggcaccatgaaaaaataaaataaaatatctcatggggtaattacaaggataatgagatacatatagtgtgcacaagtacccacatacatgcagtcatttagcatgttatctcaataaatcatagttcttgacatttaaaatacttcctgggcatgctagttgacacaggatattttagtattcaccctgagtactgattaatcagggccaattggagagccaaccatttttctttttttaaaaaatagacatagagtctcattctgttgcctagactggagtacagtgatgtaatcatagttcattgtaacctcaaactttggggctcaagccatccttctacctcagccccccaagtagctaggaccacaggggtacatgccatgctaattttaaaaaactttttgtagagatggggtcttgctaagttgcccaggctggtctcaaacttctgacctcaattttaatgtgacctcaaaaaaaatacaatgttttatatttttggtagagactgggttttgccatgtttcccaggctggtcttgaattcctgagctccagtgatccacccgccttgacctcccaaagtgttaggattgtaggcatgagccactgcgcctggcctaagactagttttatttatagcagctacttacatccttttctgaaaagtcacaataaatatgcatgaggccaggtgcagtggctcacacctgtaatgccagcactttgggaggctgaggtggaggatcacttgagctcagaagtttgcaaccaccctgggcaacgtggtgaaaccctgtctcttcaaaaaatacaaaaattagctgggtgtggtggtgtgctcctgtggttccagctacttaggaggctgaggtgggaggatcacctgaggctgtggaggttgaagctgcagtgagctgtgatcgtgccactacactccggcctggacaatagagtgaaagcctgtgtcaaaaaaaaaaacaaacaaagaacatgcatgaaaatgttaaagtatagttatatgtgctgggatcagtagtgcacacctgtagtccctgctacttgggaagctgagatgggagaattgcttgagcccgggagtttgaggttgcagttagccatgattgcatctgtaaatagctgctgcactccaacctataacatagcaagagcctgtctcttaaaaatatatataaatatagtatagagaatgttttcaatttaaacaaaagttgtggagctaaagcaaattttatgaaactgtagtagcatgaaataatgcatctgttatgttagtgagaagagtggcatagaacatacacatacacacacatgataattccaactacagtttaaaaaaaattacctagaaaaaacgaaagaaatacatcaaaatgctaaaagtacctgtattaaaatactagaattattgggagctctgttttttgtcttctgaattttcagtaatttataacataaaaataaattagtggtttattttattaatacttaaattatagcttgaaactattctgtaaacagcagttaataatgaataaactgttacagggtattttaagatttgacaaccttaagcaaccttgcaatccttaaaggcaactcttgagttatgtggtgagcctggtcctcactctcatgttttatgccctgactagagatgaaggaacttctctacttcctcaacttttaaatgatttctcacttgagagcaaaaataactcacaggaagaaaaaatatttttatatccatgaaaggaactgtggctggattattacttaattggtatatgtgatgaatccagattccttaggagactttacatcagctaattggtatgattttttagtcttgttagtgaacaagcatccatagtccttgaatgttttacctagattgcaggtattgataggagatggtttagccttggcagtctcttcattttctgcaggtaaaatggaatcttggcctgaagttttcagaatcttcctagaaaacttacaatgacctgtcctgaccaattagattgagcttttttcaaaagacagtaaaaatatattataaatatattagcaaactctttaagacgtcaataagtcatattttatttcacgttaaaaaaaattttaatctgttttaactgggattcatctaaaagattccgctttttgagatagggtcttgctctgtgacccaggctggaatgcagttgcagcttcatagctcacagcagcctggaactcctgcactcaagcaatcctctgcctcccaccttagcctcctgagtagctaggaccacaggcatgcaccaccatgctgggctatttttcctttctctctctttttttttttttttttaattttttggggaaagggtcttgctatgttgcctaggctgatctcaaactcctggcctcaagcgattctccctcctcgtcctcccaaagcactgggattacaggcatgagccaccacacctagcctaaatgttgtatttatttatttatttatttttttgagacagggtctcaatccgttggccaggctagagtgcagtggtgtgatcatagctcgctgtagccttgacctcccaggctcaagcgatcttcccacgtcagcctcccgagtagcagggactacgtgagcatacaggcgcaagccacctcacccagctaaaaatttttttaaattattattttgtagagccagggtctccttatgttgcccaggctggtcttgaactcctggcctcaagcagtccttccacctcagcctccccaagtgctgggattacaggcatgggccactgcgcctggcctaaaagttgtttttaaatgtgaaagtatttaactcaaataaatactatcatgtctgtagagaaatcattgatttttaaaaatcctcttaattctatagtgcatgcagctaacttaactattaagaaatacaaatgttatgtctacttcattattttaattttattaaccataatagtgctttatgtttattagtttttcttttttctttttttttttgagatgtctctgttgcccaggccacagtgcagggacactatcatagctcattgtaacttctccagctcctgggctcaaatgatccacctacctcagcctcttatgtaggtaggacttacaggcacatgtcaccatgtccagcttgcttgcttgcttatttatttatttagtagagacaaggtattgttatgttgcccagggtggtcctaaactcccagcctcaagcagtccccctacctcagcctcccaaagtgctgggattacaggtgtgagccactgcacctggcctactttatattttttaatgtgttcttgcatccataatcccatttgagctcacactggtcctttgaagtagataaagtagggattccatccatttggcaagggaggaaactagtgcagagagaaataaagtttgtaacaaaggttgctggcaagtttgtggaggagctgggcccaaagtgtgtatgtactggctcccagcccaaatatagagaacacatttgtaagcaatagaatctagttgtctgcacataaccactatgctgaagttctttaaaataccttgtttcttaaagcaggctcagtctctctcccctcttagtgttgaatatgtgaataattaacttagcaaaccctttcttcctatagtaataaaaacgtaaacttcagcccaggctacttctgaactgtagtgcctgtggaattcatgaggttttcctgtagaggttgaccatgtatacttattgaataacctgtgtacctgatgtgtgtgacccctggtgaatattctagtggtaaaaactgatttaaatgtatgcctatctgaagccaaagaatgggaacaggcaactaaattagaattaagaagtttttctttgaaattcccagctcctattctttcatcccccaccgccccctttttttttcttttcttttctttttttttttcctttggagacagggtcttgctctgtcactcaggctagagtacagtgatgcaatcccagctcactgcagcctcgacctccctgggctaaggtgatcctcccacctcagccttctaagtagctgggactacaggtatgtgccaccactcctggctaattttttgtattttttgtaggacagggtttcaccatgttgcccaggttggtcttgaactcctgagctcaagtgatcttcccgcctcagcctcccaaagtgctaggattacaggtgtgagccaccgcgcttggctccctccaccccctttttaaaaaatcatcttgttcccctattgtttttcccttctcccctcagccaaagctttatgtgtggaaagaataaaaatgtattaataagattttatatctttgtgggagtgtatagcatatatgtaatatttaagttttgaatagatatttcaaaactcaagagccacaaagggctataatataaaatgtattaataagattttatatgtttgtgggagtgtatagcatatatgtaatatttaagttttgaatagatatttcaaaactcaagagccacaaaggactataatataaaaatccaagggatacagaaacttataatgtaaacgttcaagaaatacaaagagctataatacattcaagagctacagagagttataatgtaagagcctttcttttcccacctcagactccctgctgtcaagttcctctctttagaagcagtggtagtaccaatttattggtgtatccttccaaaatactcccagtgctggaacatcttaggaaagtttaagcttttatttagttgaagccaaaggaagggctctctgatggttgcatttcaggtggctgtaactggatgagtgagtgcaacggcactccttcctgaaattaaaaacctgagaatcatcagttcttgtattcctatagtctacaactgtaagcactcacattaagcctctgggaaaaggagcaaaccatgttgcttctaacggtctcactaggctgttccctttgatttacaggtgaacagtctacacgtggctgaccctgtggaggctgtgctgcagctccaggactgcagcatcttcatcaagatcattgacagaatgtgagtacgcaccatacccctttctagcctctaaggcaaagctgattgctggggtgggggctgtacttgttctctttacttgatgatggctatgaccagaaatcaggggaaggattgggacatcataagccagggtggggcctaaaggcaagaatacattgacctcatcttccagttgctgtaccactccatgggagaggttttacgcttgtcccatcctgaggcttctgcattcttgcacaggagaacctccaaggctccacgccctcacattcttccaagtgctcactcttgggttccccatctcttgtctcaccagaaggcttctacaaccctcctttcttgactcatccctaccctatgccacaagccctctttgcagccttctgagggaagaaaggggaagctctcacatctgaaggaaagaagaaacacctagaaatctcatctctaacttgttagcacagtacagatatgcctctttctaagccattataaaataagtacacttctggggtttttactgcttcaattaacttgatttctgaggtccatgagcatttaataagcttgttgttaccatgcagcaaggattgtagtttggccttttggtctgtgtctttagcacatttcctttgaacgtcacagttatctcggaaatgaataaagtggggcttcctcccagtatcctacctttctgggaccaagcataggtcagttgtcatcttttttttttttttttttttttttttttaagaaaaagcacattagattgtttgccccaggccaaggatagactgaagtgttgaaggtgtttatgtgccatacgtggcagttaggaactggtatcagggactcatatctctgaagcaagcactttagctacctgttcataggtaacagctcattgatagggaaagaaggtagaattaagcttatcaaaggctagaactgtgtctgattcatcttggggtcctccctacctagcttaggatgctacattgtttaggttttagtgaatgtttgttgagtgaagagatgagttggtgttctctatcagcaaggtctagcggggccaagtggcccaggacagatgggtctgctgctaaagtggtttttatttgaagtgtgtgttgatcgtgggttatcttacaggattttttaatattccatatggctctaaccaggacctgccttagtacctctgaaagaagtcactattcttattttggtccagacagtaccattttctctcccagttacccaggcaggacatttcaacatcatcttgacttctctgtctccttggcgctgatctctaattggtcatcatcctctctgctcacatccagcgtccctccctctgcctcattctggatactaggccctcatggcctagttcttctctaatctgcccttattgcagttcattcctatgcacgagttctcaagaatctttctcaaatcttgttttctttgtgacacttcagtgactcttcatcaaacctcagtgaatattcatttctaataggtagaaatctaaaatcttcagcctggtgtttaagatctttcatcagggggtcatttcctctcaccagttttgtttcctgcttttttctctccccactcgacaccacctcattttttttttaatcttatagaaatccttaaatcctggattttgttaattgcattattatggtacggcttaacttgttccactattccccttgttgcctatatactgataattagatctaagcttgattcactttttttttttgtcaaggatacttcatagttggggttgtgtaccacctgtaagtcagcattttgcaacttctgttgaaaatcattattttgcaaaccctaaggaagtgatagatccaggcacctgacattaatgggtggtaaaaccattagtctggcaatacctaactctctgtttaattttaacctcactaaaagtgaagcagccaggtataatatgccttgtattgtaacacacaatatggggcagcatgcttttttgacttcaaaatagatcaaggaacttttgcttttgaagagagaaatttccttggcctggtgacaagagcagtagatgtgcccaagagtaaggatgtgtgttgtccttgggttagccactgtaggtttataacctggtaggaaattttcataggaagggccaaaaattcaagatgctcatttgcaagttgtcttctagggtgttgcctgaacctaggctgcagtagaagtggggcttggaggtaggcgatattgaaatcccaggttaatgctaatctccatctcagatccaggacaatgcagaccagcttccttttgggaaatggaggttcttagttaatatgttctggctcttacatttctgataccgctactggtgccaacctaaatcagcagcctagttctcagcagaaggcagcagaggatggcaaggttggagggtagatagaagctgtgggagttgggtggctcctgtctgcacactggacaaggggcaccctgagaaaaataattctttaaaaaattaaaaaaaaaataagctgtgggagttgagggtttaattgcttggccacttggccttctctctgggaaaattaactgggatcaacccctctgacaagtttcccttttggttcttctgtgcgtgaatagtctaaagcaaaaaaggctgtcccgtctgtttgatagctgtgaagcttgaataacagagtatagtggaggcattttgccagaaaacttagaggtctgacatttttgtcttgctgacttttatttctgctcttctcagtaaaaagcatccctcagttgtcagtcagcccatatgtattgagcacctactttattcctggctttcagctagtgcagttggaatgggcagttgtaaatggtgcagttgcattcatgagtgctgcaggaagacctggaggacagccgaggcatgactggcaggagttgtggatggcttcctgacagagatgagacttcaacacagtcttaaaggatgggctggatttctctaggactactgttgtccaaagtatgctccatgcagctttacttacaccaggctttgtagggggtgggggaaaagggttttgtggtcaaataggtttaggaaataatgcatgttgtatcttcttctataaaaaatgttcagtttaacccagcattttttaaacatttcacctgagaacctctttttattttaattaatggaatactctgaggtaaatattgctctacactgagccaaggagtcacaacattccagattgtgggtgggtagggaaaatggctcatttgggagtctgtaagagattagcatctcctcaagactttgtaggagtctctgatctcagaccaactatccagacagagtgcttctgggagggattcacttggaagaagcctgtgtaatcacatggggtatggggggaggtacactcatagtcttggcttggatgatgcttatgcttgcaggatgtctctggcattggaaggttctgggcctgccctgccctccagaaagttggctaagaactaggagtgtagattctgagaagcaaggggcccactaatcaggatctcccactgtagcctagagaattcagctttctaacttgaagtggtatttcacctgctgcttctgaaaatggaactgcagttagctaggggatccagcgaagttcccccactaggttgaaggctgagatggcaaaagcctcccagagcaggatcccagggactagtattcttttttttttttggagacagaatctcgctctgttgcccaggctggagtgcagtggcatgatctcagctcactgtaatctctgtcgcttgggttgaagcagttctcctgcctcagcctcctgggctgtgtgagagctccccctgctgtctccctctcctcatggctctcttcacactgcccgctcttccagttaagcaagtacagacaagaaccactaatcaagaatactagtcctagctgggcgcagtggctccagcctgtaatcccagcactttgagaggctgaggtgggtggaggtcaggagtttgagaccagcctggccaacatggcgaaaccccatctctactaaaaatacaaaaattagccgggcgtggtggtccatgcctgtaatcccagctacttgggaggctgaggcaggaggattgcttgaacccaggagtcagaggttatagtgagccgagatcgtgccactgcactccagcctgggcaacagagcgagattctgtctcaaacaaacaaacaaacaaacaacactctagtccctgggatcctcctctgggaggcttttgccatctcagccttcagcctagtgggggaacttcaccctgtcacttcagagccttgtttcctcctgttctttcagttcttggatgtttttccctccccatggtcttctctcactcttaacctaggtgtgttctccaggcttcctgacagtttagagttgagccattccagatggtgtaatatagcttcccgttcatctgtgctgcctccatctcctctcggcccctttccacagagcttttttatgtttgcaaatagggtggcagagtgccatcttttccagaagaaccccatgcctcaagtcccctcttcccacccaccacacagttccatctggataaatggtgtcctggtatctgtcacctgcctccaggatctgatctggatctcttccagatccagcagagatcaagactggaaggaatggggaggtactatgaaatgcagcagcaaggaggcaaagattgctgaatactctggtcctaatacttgctctttttctagccatggcactgaagagggacagcaaatcttgaagcagccggtgtcagagagactggactttgtgtgcagttttctgcagagtaagcacctttcttatccagctatgaagaagctgcttcctcagctcgtgggattggagagtccagaggaactagttcatgggtgtctggaggagaaaaatttcaaggctccccactctttaacacaaagatgaaaacagctggttcagatcccctgggtcttgtgatgccttcatcagttggtgtaagaagagtgtcccttcagtcccagagcccttctcggagatctaggtggagccagaaggttactttttgggacctgtcacttttaactctttgagcaccttaagtttctgtttccccgaacttcaaggagacagaagagagaatgagtctctttcccttgcaagaaaaactgtttttcccagataactttgaattaattgcttaggcgataggtgtaggggcagaggcacattaaggttgatcttgacccccctcactgcttgtgtgacctttctggacataggttccctatctataatatggagataactgctcttcaagtggatgggtggattaaataagaacacatgcaaagcttctagtacagtgcttttcagttcccctccccttgtccagccttagaccacagagtcctcgtctttgacatggggagctagctgccatctccacccctagagaattataggaaaggtgaggctttatttagataaagtaaggtgttagtaatttgagcccagaccctcgggcagtataagagtcacgtatccctagttgtccttttctgactcagctataggtttactctgtgacctcagttggaacaggattctaaagtgacctggcatctctgggctcttcctctgtggtgctgagagttggtgagtgggtgggagagtgcaacatcatgacccagagttgctgtgaattccgaggctgctttcttcttccattatccctgtagcccttggattgacccaggatagaactgacttcagatggaaaattgtaaggcaggggaaagaggccataggagtaaggaggcctacatctcatagccccaccagagatagccattctgctccccagatttcagtgttctgggatctcaggtatggtttccaggaagttcaccctgttttctgcgttgttgtcattgcagaaaatcgaaaacatccctcttccccagaatgcctggtatctgcacagaaggtgctagagggatcagagctggaactggcgaaggtacctatggaataccagactggggaggcagggcagggttggggtgatggtacctgagggaccctgcagggccttctcttaacccaaggggagatgatgggtgctttatttctggggctctagtacgttggaggtagaaccaggcagccacctgtcttgagacagaggctaatttagcccaaggattctaggagcccatgatcttatgacagagattatgaaacaaacaatggtttactagaccattactgtgggcctcggtggagacctggcagaaatcaggtctcattcggctatcaccatatttttattatagctcagtcttaagtcattccctctgctctttctgggtgctggcctatagagggtacctaaagcttcacacccagggttccatgagtccaggaattgagccatgcaggaatcttggcgctcagctttttgtacagtgtacactatccttaattaaaaaaaaaaaaaaaaagtgtttcctggagctgttaaggatggtggcctgggattgctgaattccaggacttttagaagagtcaccggaatagctcagagtccccagaacagcccagaatggggacactgagaagagagacagccccactcagtgactgcctcctgtttggcttctagatgaccatgctgctcttataccactctaccatgagctccaaaagtcccagggactgggaacagtttgaatataaaattcaggtaagcccttgtgcctccatgccacctagcaggcctagcccatgcttcacctcacctgacttgtttttctttgaacagcagatactggactttttaaaaatacagttatagcaattattgccattcatcatagaaagtctgggaaacgttgaaaagcatgcaggaggaaataacagttgccgataaactcattcccagagtttgctaactttttaaaggatgtactttcaagtccttttttatgtgcatatgtttaactgtaatgtgttttaggataatacgtagaaattattctctgttcctatatgtgtttctgtgtgtgtgtgttttttttcccccacagaactttcacttcatttatctcatcctttcctctggtagggtcatctggaagaggccaacatagttatatataaaagcttcctggccgggcgtggtggctcacgcctatagtcccagcactttgggaggccgagacaggaggattgcttgaggccaggagttcaagatcagcctgggtaacatagcgagaccctgtctcaacaaaaaatattttttttaaaaaaaatgagctgggtgtggcagtgtgtgtctgtagttctagctacttggggagctgaggaggaggagttgactccaggagttggaggttatagtgagctatgattgtgccactgtactccagcctgggtgacagagcaagatcttgtttcttaacaacaataacaataaaagcaactttctgattgtgttactttccttaacagtcacttcacttgtggtcaggagttaagtcagtcaggaactctgacttcggtacatcttgaggggaggtgggagggaaggggacaagtggggtgaacatatctctagttgaatgttgttggctgggtcataggacctcagctctgagagggagaatgggatccagcaggctcctagggcatgagggagccggggactggcactgccagggtggagctcctggcagccatcccttcagaggcctaacacctaagtgatgctctttttctccctgtggcccaggctgagttggctgtcattcttaaatttgtgctggaccatgaggacgggctaaaccttaatgaggacctagagaacttcctacagaaaggtaagtaggtacacactcctgagaatcccctcatctctgaaatggggaatactaggatcctgagttgtcaagtatggtgggggtttgtttctgtccccaacacaaggcagagttgatgctcaggaaaagtgtgtgtaatggagtaggtcgatttctgggccatgttgtatcatctcagttcctatggagctcctccttgctgcctggcagcagttatgtaggatatttacaagtgatcatacctacttttgttttttattttttaaacaatcattactctaggcttagaagctgagaatacagtctttttatttttatttttatttttttttgagacagagtctctctctgtcgcccaggctggagtgtagtggtgcgatctcagctcactgcaatctccacttcccgtgttcaagcaattctcctgcttagcctcccgagtagctgggattacaggcgcatgccaccacacctggctaatttttgtattttttgtagagacggggtttcaccatgttgattaggctggtctcgaactcctgacatcaggtgatccacctgcctcggcctcccaaagtgttaggaatacaggcatgagccactgcgcccggcccacagtcttttaaaaaatgtttttcccgtcatgtagtgcatgttctaggtggaaaggcagatacataaaccaggaaataatgataaggaatctaagtacggaatatatcaatggcctcggctggtactacagtagaaagagtgatcgttctgctggtcttctgatgaagaggtcagctggtggatgataggaatgtaagaaggaggtctaggcgagttctagccgttgagtttgatgttccttgtattcaggttcctcatgagaccttcaggtggagatgttagaaatgtgagtccagaattcaggagcaggctctggaccagaagataggtttgcaagtcagcattggatggccactgaagccgtgggcactatgggcagagccaagaggccccatcagatctctgggagcttagagggtgggtagaggagggaggagcagatgaggagacttaagaatgggtgattagaggtaggagagtcctacaaaaggggtcacggaaaccacggaaagagaagggttttgaggaggagggcattttggaggtgcaaggcttcaggggggatgaattccaaatggtggccaatggctctgataggaaaggttgttgggggctgcaaggagatcctgctcagggctccccaagccgtctctgcagtgtggactcgaggaaaaagcttgagcacttggtgcagtttctgagccagaggacaccgtcactccactgtgctctgagtaatgatgctctgtagaaatggaagccctgcacttcattttggttagagacacggaactctggataacccaggcaccaggtttcaggttctgcccagtgccttccttggtagtttacatataagtatccatggatatactcccactaaggcgagttctcaaattgcataaaggtgcaaatcttttcaccttcttactaacctttgttgatttattttgtctatttcttacccccagctcctgtgccttctacctgttctagcacattccctgaagagctctccccacctagccaccaggccaagagggagattcgcttcctagagctacagaaggttgcctcctcttccagtgggaacaagtatgttctgggcctctcctcctgggatagggcctcagcatccatccattcctcacattcctaacttctagagttaagatgttaaccagcctctgggagtgcttagagtatccggtagatctgggatctcctcacctcacccagtattaactgggggaagtggttgggatttgtcatgtgcagaaggcctccctcaaaagctgttccctgtttatggaatacccttcttcctcggagactacaatgaagtctcttctcttagcacatctctgcagagccaaggagaatatatcactttttttttttctgacaaagaaattaaggcagtgagaagaaaagttttcccaagatcatgtcatgaggcttgaggtagcactgcaaacaacccaggtgcacaggcctcccagctgctagtgcgcacttccatagaccccgctcccttactgctgcctgttgctgattgcttcagatcttaggcgcttaccaatgcatatgggccttctccctcctcagctttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaagggtaggtggctggcacactggcagatgtgtgaatagacttgccggaaggatgtcccctggcctcccatgttgtcccctctgctggcccctggagctgagagctcagccctgggcctgtggtcaggctgacctcctggaagctaggttctgtctttgtccccatcttctctttcccttagattggataccatattcctcctcttccctatgccgcctcctcccttccccttgtgcacatagttctgtgcacatagttccgctcatgcacatagttctgattctcctctcctcctccctccactctgggcagatgcacagatagccatgatgcagcagcgcattgaccgcctagccctgctgaatgagaagcaggcggccagcccactggagcccaaggagcttgaggagctgcgtgacaagaatgagaggtacagctctccctgcattccttcccaggccccagcccctcccctcacccagccaggaacccatactctcttctcactgcttccctccctcgcagccttaccatgcggctgcatgaaaccctgaagcagtgccaggacctgaagacagagaagagccagatggatcgcaaaatcaaccagctttcggaggagaatggagacctttcctttaaggtgggtgttaaggtggtgtgtgcatggaggcccctcagggctgaggtggtctggaaggctccccaagagagggttgagaagaatgtcccagcacctgtcttatgcttcagtctctccagagacctgcatattttgcccctttccttatcccataattggcggcttcccgggtactgggctgtgaccctaaatgttgatttgtagttctgaattagaggtgtgatggctgtgattggtttgtagagggttggcaggataattggaggcatccagcccctggggttctgggagcagacagcagtggtggggtcagctctgggtgatggggattctcacttgcccgtctcagctgcgggagtttgccagtcatctgcagcagctacaggatgccctcaatgagctgacggaggagcacagcaaggccactcaggagtggctagagaagcaggcccagctggagaaggagctcagcgcagccctgcaggacaaggtaaccctctgctggggtcacagccacagtcttgaccacatgtgcaaagctgagtccagtttaccactgtgctcttctgggcctttgggtattaagttgctttctcttcaaggttcaatagtgtgctgtaattgaaagattgtgggcttcagtctagtacaccttttttttttaacttatttttttttttccccagtcaatgccctcactttatagtacacctttcaatcctatctctgctgttcacaagatgtggatcttggacaagttaatcagtctgtttttctaagcatcctttccctaaaatgggagtagtaacgagtagctgcctcatcacctattatgagaaaacgtatgtaaagcacttcacacatcgtgtagtgtaaagtaagctctcagtgaaccagttgtgattgttactattggtaagaacccaatttggccacttactaataaccatgtagcccttgatcaaggcacttagcatctgcttcaggttcttgctctgtaagaggaatggtagtagctgcctcccacataagctgggtgtggtgatgcatgcctgtagtcccagctactcgggaggctgagacagaagaagctctcgaatctgggaggtggaggttgcagtaagccaagatctcgccactgcactccagcctaggcgatagagcgagactctgtctcaaaaaaaaaaaaaaaaaaaaaaattagggatgaacccagcatagcctattgtaggtgcttagtgaacagtggtgaagaagtgggtttgggactgggggttgctgcagctgctgccagtggtattgctgcccagaggatggtgggcagctggtggtgatttggataatctaggactcaagacttatctgaggaagggtatacggtaaggaaatttgaagtaaactcagcagccttggggaagtagtaagcaggttacattatgactttattgtgccttagaactaggtctagagaatcaggtccctcatgctcccagttccatggtttctgcttttttctaggccagggcaaaaggagatcttggtaacaagatgatgggccccatgtttgctgatgtttatgagggcttgtgtggtaatctggtgcctgttccccctctctgttcacatgggtctcatttactcccagaaatgccttgaagagaagaacgaaatccttcagggaaaactttcacagctggaagaacacttgtcccagctgcaggataacccaccccaggagaagggcgaggtgctgggtgatgtcttgcaggtaggaatgcacagaaagacctgtgtgctgcgggttggtgtggactcacattcagtacatttgggttcctggtgttcctccatttccagaggagtcttgatgactgaggagtcatgctgatcccagtttgtctctttataccaccagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtaaggtactcagcccaaccaccctcccaaagatcaggagctgagagcgcggggacatcgatcctctgtgtccagggcctctagctcctacactggagtgtcttgcctttcctcattcactgggtggcagaaaaggagaggtggctggtggagttcaagtctgttgcccctgtcatcctaaagaaaatgtcagtggcctcccctcccctgaaggctctgtcactagagagtcaagttgtgatgaccaccagcctgttcagaggcacacctgcactggatgcctcaggagccactggggattagaatcagcctaactggcatttttaaacttactgtcaatctagctccttaggggaaagtatcagagcctcagtgaggtcagcctggcagcagggctggtgcttctttggcctcatctcactctgtctctgttgctcctcccccatgtacaggtggagcagctagaggtatttcagagagagcaaactaagcaggtaatgcctgaggtcctcgctaaatgctggctgcttaaacggtgaccagtcttggtgcatgagcccggctgcagcttgcctccgccagctcctgttgtgaactgtttgtgaagggggcagggtcaagccatggaatccaggcccaggctgcccaggagtgtggtgtgctgggctctctcaggcctcatcccacccatcccaggtcggcctctccacccttctgcaccttctctcatttgcctatcagggacaaggggtagcactggcttcatctttcccaccctgaaccaatgacagacacaatccttgggattcgagaacttcccaagtactgtgtctagttaaggatacccgactaagaggaacagcagaattaccgtgtcggccttgtttaacatggtgtccctttttcccagagtacagctttatggaagccttgaaggtgatatgcgaggcagcccccacaggttagggaggattgtgggcttaggacacttgcccatcactttctggggctctaaccccgagcacagcatagagatgtctgtagcaggaagaccgagggtgaaggagcaggaggggtctataccagatgggggcgggggagtgggggtcacatggtctggctgcctctttctcatgggaatcatctctgtgttgcctgagacatcgaggctatagagctggtgtttctgagacatcgaggctatagagcaccctttctccatcactctcctacccagccaccccagggctgctgaaaaattgggccctcctctaaggagcctgtgatagtgggggacaatcaaagtgaatagcaaacagttagcaatggagcccttgcctctcccctgtgctgcctggtcatgcttgaactcccagaatgcttggagcagccaagggtgcatggggctgttatgttctctcttttcccctactccctgtgctcttcctctttgtaggagtggggtgggctttggagtacatgtgctgcccctgctcttgtcttccagcaatctgttccccaatgctaaccacagcagccatgctgctagcaccagccctaacggcctgtggatgttgggaagaggtctgagcatctgtgggcttgggctttggcagtttctgggagggaggcatgggaattcattgagtatgtctactagaattacagactaggtcctgggaaggttgcggctgcagagtgtggcggcagcaaggtggtggtgaggtgtcggctccccagagtcaattctcctgattttggaggtgacgggggttgggcaggcctctgtctctgcaggctcagggtagacgcaagaacagttggccctggcaacatctatgtgttaggttgcctcattcaggccctgccaagcagcctgggcagcaggctgttccgtaattggaggccagagaaagggcctgagtttattctaggaacactggggatcctggtctgggaaaccccatgatgggtggacatccaggatgaacatccaggggaagtcctcctgagtcttctgtcctcctcttccctccccaggtggaagaactgagtaagaaactggctgactctgaccaagccagcaaggtgcagcagcagaagctgaaggtggggcagctgggggaatgggtctggcctctggacaagggagggaagctattctctaagctctggggccgtggggggtgtcggggcagaagaggggcaccctgcattccaggtagccctcctaggaagcctgtggcttagaagcccctgcatgtgtcttctgggagctctcgagagacaaccagggtggttcccatctctcaactgtcactgtccacttcagcagctactagtcacgtgtggttattgaaatttattaaagtaaatccagttcttcaatcacactagctacactgtgcccctgttcagtagctacatgtggttagtggctgctgtattggacagcgcagatacagaacattccaccattgcataaagttcttttggacaatgtaagtctagatagtctgggcagggaaagaacgagagtgtcaccagtgttgaatattacagtgcagtttaataacattcttaatgctttcaactgtgtcaccttctttggtttaatacttgctttttgcagttctaggcttcacagccttcagtcaggggcaaaggaattgggcaccagtggcattgggactcactaaagccctggtggctcctaggagttgttgggagctcagagcttcatttctcctgctcaccttcataccatggtgccacagcatgtcttgattgcaataaacaaatgtttattctactccttgtggggcctgtcctatgttaggagaggcaaaggggggatgcttctatctacagcaaagcacttgttggccttgcagatggacagagaatcaggccctgctcttaaggagttatggtctggacaggaggcagtgtgggcatcataaataagcccccatgggcttttggagttaggtggaccaaatcttactctgccatttagtcactgttactctggtcaatttgcttaaatctctgaactcagtttcctcctctgaaaagagggtgaagtgacttctcagagtggctttgaggagaaacaagttcccctgtcctaagagagctcacatgccaagtgccttactctaggctctgcacctgggtgttccctgaggattggttcccttcctcctacgggagattgtgcatgcaaagagggtgtgacactttgtgtctggtctcaaagaaggcaaagatagggcaggagctggtcagggaaaggccactacggatgtggactgaagggcgtgtgggcttcaggtttagtagactgtagtcgggcagagagtatttggggtggtgtggttttcttccgcttcctaagaaagtgcaggagtctgaagcacctgtggagccccagtggctggtgcagataagcggacttgggtagagcggccagaccagctttcctgagtggcctttcttctcaggctgtccaggctcagggaggcgagagccagcaggaggcccagcgcctccaggcccagctgaatgaactgcaagcccagttgagccagaaggagcaggcagctgagcactataagctgcaggtaaggagcccagccccagcccatgccaccttcctcctgcccttcaacctctaccccacccacccaccctctctgcccacagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggtaagaatttggctggcagactcacctcactcctattccactggacccctgtgccctctcctcctaggccactgctgccttaggcttttcttcactctccccctggccctctccttctcaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataaagaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccggctattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttagttgctgttcaggaagcttggtgattgggctcgccaagcaggacgacattggattatgcccacgttcatggcttgggggcctgagtggggggcgttcctattcactgaaatgggagatgcaggaggaagaacagagaagtgggcttagattgggacgtgtttgctgtgaagcagccatgggcatctggtggggatgggacatctgggtctgggcattgccactatgaggagctattaggagaagccaggggagtggactgaaaggaaggcccaggtcaagtgctttccttggtacctctgaaaaatcagagagatgggctgcttgacctcatctgcttgtagtaaggatgggaaatggtcactttcaaaaagggctggacaaaatgccttctagcgtgaaggactgtacctcagcaggtttcctttccatagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaaggtcaggctgctgggacaggggctgcagggcagcaattcccacttcctctcaagggcatctttgcactgggcactcagtcaggagcagggagggatgagcagccagtccatgttacagtgggaaagctgagaggtcttaaaaagggcagtgacttggttaagggcacttctgaagaaaaaggcagggctaggattagatccctgcctcctgactaaggctagcattctctccatgcgtagcactgagcctgtgcagggtgaagggagagaacgtggcgaagctgcagcccatcctgtgcctcccagcatgccccatgcagctgagaggcattgttgctgcccagtggactgcctgacaggctgcaggcccttgcctttgtttccacatcttgaaggggaggtttgggaggaggggagaggggcccctggtacagcaggggggacctgtgtgtttagggtgccccctgctaccaagaagttggggaagttctggaacatggtaagggccctggaagtttggactgagggacagcagaggctgtgggatgagcctgactagtcaggagacatggggcctagccccagctctgatacttcctagcagtgtgatttggggctagtcactttatttctttgcacttcatctccaaaatgggccgataaacactctgcattccctacctcaaagcattatgaatagactccatgaaaaaaatgcgtagaagagtcttgacaacatcagcaccaccttgtgagggcttctgtcgacaaggcccatttcttgcagacacacactttaaggacctttgcaaagcagttgggaatacatggatgtgccgtgggatctgagggcttcggaagggaatgggaagcttctgtacagtgccagggactgtacactgcaacagattcactctgtcttccagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggtgaggggactacagggacttactataccccaaaattagactggaaggtggatcgtggcacagggaaaagaggaaagctttttaaaaatccaaggctggcctccttgctaccatccagctccacctgcccctccttcctgcagcctcagggccttccttacctgcccatctaggggctggctgtgttgggggcactcttagccagagttaagggcccgggattcccagcacaattgtgacacttagctgtggggagtcctccatgcccttctcaggcggtgatgggctgctggaaaggccaggctggccagactcttcttggaagctcttgtcctttgggcaccagggagcccctgggaattaattcccggtccttaatttgttcctctgggtgttggccaccaagccttggcaggtgaataagatgtagtagcagtctctgcgtgtgacctcttctgccctctccagggagaaggtggtgagcaagcccctaggatagaaatagtctgtgtgccgtactcctgcacctgcggcactgaatcagactggtgtgctgggcttcaagtttatggggtaggtggcagcaaaggctggcaagatgccagggccaggaggtgacctgccgactccaggctcatttgttcccacttccctgccttccacaggaaggaacagcttctacatgggcacttgccaggatgagcctgagcagctggatgactggaaccgcattgcagagctgcagcagcgcaatcgagtgtgccccccacatctgaagacctgctatcccctggagtccagggtgaggcctggggtcactgtgcagggcctcccatccctgccctcccttggaatcccacctgctgatctagcctgagcactagggccctggatcactgactggccgaggagggggagggtgaccttctcatgtttccaggtggaacagacagctgggagggcactcaggggtgaagtccctgggggtaggcaggagctcagagaggaatctggtcaggactgcactgcttgtggccatttgcccagggcttaggtagaaagcagaacaggaaaggaggccttgtgtctttctacctcgtgaggcaggaagggtcccgaccataagtgtcgggcgagtgtagagttctgggacagccccaggtcctcctccatctccatacagctatggtccactgaccacctcttccacccatgcagccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgaggtaggcgcggtggctcctgggtgttactccagcactgtgctcaggtcaggcccagctcaccaaggactaaagggagccttctctctccttccctcacttccccctctctttccctctctccaagggcctgacccatggatgggaactgttgggaagggaaggatctggcccagagttgggaaggggagcaggttgcacgttgacttacaaggtccactcagctctgagaggacaagacacctggcttcagatgtgactcctcttgctactgtctgcctaactgtcctcttctccatagtctaagaaggccaccagctgtttcccacgccccatgactccccgagaccgacatgaagggcgcaaacagagcactactgaggcccagaagaaagcagctccagcttctactaaacaggtgaggctggggctgaagggggatgaagcgacgccctggcgggaccttgctggtacagcgtggcacagcacgctggcctgggaaggcagcattgggtctcccggtctgacagcccttccttgcaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggctagtatcgcaagttctcatctggccatgtgactgtgtctctttcaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgagtactgagttgacttgatcggtgtgggaaaaagaggaatataggctctttgaagcctaccttgttcctgctgagtcttccataccacctcctttctctcatcccttttcctgaggccacatctttccaggctcttcccactctccattagtggcctctgctcccggggagcattatgggctgttctctcttttctttttcaagcgcctgtgttcccctgaagcaggtgttgtcttcagcttctgtgtggcagtccctctctcccatactccctcgtgggacaggcaaagttcctgggagtggaactgaagcctaaatgaacagatgtcaggatgcctccattgaataatcctttatgaggacccatgtggggatgacacagatacagtgtggatccgaagcagctgctgcccccatcccttccctggaacagtccattagagtgaagggggaaaaaaaaaacatacagcacgaagataggaagtctgcagaatgcggccagagctgaaagaggatgacttcactgaagaggcagcatttcaaccaggcttgagcgttcccctgctggggcggtgaggaagacgggactaaatgagcagagacatgggagtgggagctgtctgggaaaagcaagaatagttgggaggcttccagaaagtcatgtgggaaatgcaggtagggccctggagtgcaaggctaaggcatcaacagtcttggtggtttctgagcagtagagcagtgtgaggagtaggacgttaggaaggctaatggataggtggagagagaatggcaggaggaggaggcattataaggaggctgtgattttctaggtaggtgggaatggagtttgaatttggtgagagaagggacccaaagcagagaaggagggggtgtgttgcgcatccacgcagcctacaggcagtcagggactgttcactccaggtagacaggtaggacccaagctctggtcaaggttgtgctgctgctggccctgtgctgagtcttaaccctgctgctgtggactgctgtggctggagggcagggcttcttgggtggggggcaaggttgccctcagcccagcctagggaagtgaaggcagacaaggatcaggccaaggaaaggagggacatctcatcactttgccccaggctacacctcctctgcccaagacctaagttcctttttgtctggctgaccttgaggaatgctgggcattagttcacaggctgctctggcagagcccaccctttcctccccacatatggaagcagagctcctcctgttcctggaggcctctccttgggctcctcacccagagctgggccaggacgacgtgacgctggacaacctgttcagggtccacgagcacacaggagaagttggtgctgtgcagggcaggggtcagctgctccagcaccaaggccttgcacagctgcgtacctgtgctcccacgttcccggctggagcggaagggaaggaaaggtcatgagaaggccgcagaaggcctccttcccacccacctggctgctgcgaccctcacctggtgctcccctcccacagtcggcctgggaggtgctcaatgaaggaaccattgcccagccagtagaggatgctgaagttggggaagcggctgcaggccacacaggataagctcagcgttccatctagggacacaggcagcagttagctcttcagaagagcaggcccttcccctaccctgctctgctgtgccctctctgccagctccccccagtccccatgcatctggaacctagagaactgctctgcacaccacctaggtgggaacgtccgttacagaagtgcagttgtctccgagaggccctagccctaaacacggggaatgtgaggaatggtccttggttcacgtgatgaatcctcttctgaacctgtctcctcaggatgaccttttctagtgcccagcctcggtgacttgggagcccaggtgacagaggcagtgctggatggctgctg

SEQ ID NO: 13518 - DNA, 82125 bp, Human; identical to SEQ ID NO: 13517
  misc_feature (1)...(82125): n = A,T,C or G

SEQ ID NO: 13519 - DNA, 18534 bp, Human
ttcctcctctgtaactaaagatgctttgagtctaacatctggatagattataccaaccattaacgtttgtttttcttctgtttccatagaaatgcctcttattaaaagtctgttgccttatatttcagacaacaggagactattcacttagattccaaatggcatctaatctcttcctacaatcattattaaactgagcttaagcattttattagttatcactgggtgctatttggcttttaaaataattatttgttatattcaataggggtacagttgttaaagtttatgtcttccaggcttcaactattccaagtcccttcaagtctgtagaacagtcggtgagagatttccatgccccccggggttaagcagggatgacaaccctgttcagcaggaagtagctttagaagataagatctttggccctttctccttaagaataaggaaggtaaaatcttataaggggaaatgaaaaacagtagaaatggggcttggcttcagctcacccacactagagcatttttttcatgcatttccactcatgacaaacccacaccactaccttactgctaatagtccttttatttaaagaattccaatgactggccttaggagataaccaaggttgagagtgtcccaccttggagaggaatgttgaacaattgattcacagccttgttgccgcaaaccagaccattgggtggcccattactcaagacaaccctggcaaacagataatgctgacctgcataaactacccctaatttgttgtgctcttttaggagagtcagtcagggaattctctcattctcttatgctgcctcccttatgctccggcataagctccaatgaagccttgcctggagaaactcttttggcctcaggtcaatttgcattgagagaccaagaacccatggtcataacaaaatgaggtactgccccaggcagtttgttttattgaaggtacctgttgaatcctagagcctaaactttacttctcccaaaccactttcttcatgcattcaaaactggacttgttccactaagtctgcatctggtacagagacttcttgatgtttacttaggcagtggcccataagagtgctcattgaaacaccaatcatcattcattcatacttcaataaataacttgtatggagaaaagaggctgggcatggtggctgacgcctgtgatcccagcgctttgggaggcacacaggaagactgtttgtggccaggagttcaagaccagcttgggcaatatagggagactctatctctacaaaaaaatttaaaaattagccgggtgtgtggtggcacacggctgtagtcccagctactggggaggctgaggtaggaggattgcttgaacccaggagtttgaggctgctgtgagctataatcgtgctactgcattccagcctgggcaacagagcgagacgagagagagagagaagaaatgtgtgtgtgtgagagaagagagaagaaatgtgtgtgtgtgtgagagagaagaaatgtgtgtaagagagagagggaaagggggagggagagagagagaaagagagagagagagagagagagattgattaaccaagtcctggaaggcagccgtggtcagaagtggggttctggagagggtgggaggaaaggaggtgtgcctagatttgagggagatcaaatttggaaggtaggctgcggtcagtacacacatttaccattgaaaacattgatgtcaccattaacatgctctcagagcttgaagactgcgaaaaaggtccggagaactggcatgacttttaagtatgcaccttgggtttgtttctcacttgcagccaggcagagcgtcctcctctagagggagcagggaaaagaaaaaaaaaaaaaaaaaaaaaaaaaaaaaaatcaggcgatcgcattctgtctaattttgagccgcgccttttgccgtccgccatcacgtgccggcccgctgaggccgcgttgataggtgggggcgactgggccaggcgccggggcaggaagggaggcggccgccgtgccattcttaaaggcgcccgagtgtaggcgacaggccgctgacggccggaaggaaaatggtgagttgccgctgggagggcgggggccggagggctgggcgagccggccagccgggttttcccggtttccggagccggcggcggcgggcagcgcccaggagggctcggcggccgcttccgctcccagcagctggccagtgcccatagctagagtacttggcctctgccgccgccaccacgcctcagggcagcatcttccagctgggcccggggtggacccgcccagcgggccatgggactagggtgcggccacgagcaggggggttggggaggccccacgccaggtccttctggttggagggcttcagcttctgagctgtaggttggagggaaaggggtctgccccatcggagggctccctcaattcctgctttccctgccagggccgtggccaggttccaggggttggtgggccccgagcatcttccacctggcggcgttttgggggaggactcgaattccgattgaattctctcggcctcaccttagcttctttctctctgctcctttccctagcttcctacagaggatttctccttatctttgctttcctatggcagttggaaacctttcgacccaaagctttggcactgggccttaaagtaattgtcaataactttagttttgttggttctgggggctgtggcttctgttcttacatgggatggaccccaagcataaaaataaagtggaaaattaaataaatcgccatcaaggatcttttggatccatcccattaggttttaaaatatgggtaaatttcattagaaacaacaaaacactgctctctgtgaccatccactcaattctcagcccactttcatcgaatagatcttgtcatggtcactgaatcgaatggattcttttcagttttcgtcttctctgaccttttagctgcattccagagtgttatactctcttgtttttgaagcattctcttccttcattcttcccctttggcttctgggatacagagctcctcctacttctcctattggtccatctgtttccctttcagactattctcctttccctggacaatgctcgaaggagtcccaggtttcatcctaatccttcattttccattctgtattcttcatcctaaactatggcttcagttaccatctatattcagatgacttgtgaatttacagctcagaagaccttgcttctgagatccaatccagatctgtatgtacttttttttctttgagtcggagtttcactcttgtggcccaggctggagtgcaatggcgggatctcggcccattgcaacctccgcctcccaggttcaagcagttctcctgcctcagcctcccaagtagctgggattacaggcatgtgccaccacgcccggctaattttgtttttttgtttgtttgttttgagatggagtctcgctctgtcgcgttggttggagtgcagtggcgcgatctccgctcactgcaagctccgcctccctggttcacgccgttcgttctcccgcctcagcctcccgagtagctgggactacaggctcccgccaccacacccggctaattttgtttttgtatttttagtacagacggggtttcaccgtgttagccaggatggtctcgatctcctgacctcgtgatccacctgcctcggcctcccaaagtgctgggattacaggcgtgagccaccgcgcccggccctaattttgtatttttagtagagacggggtttcaccatgttagccaggatggtctcgatctcctgacctcaagtgatccacctgccccggcctcccaaagtgttgagattacagacgtgagctaccgcgcctgaccccagatctatatattaatatttcaatatttagttaccattcccctgggaagcttttcctccacttggtctcctcaaagccacctcagtttgtccaaagtagaactcatgccctttctcctcaaacctagtcttctgtctgttatacaagacaatctgttataccagccagaagcctagtatatctggtaacccttttttttgcttactcacaccccacccccacccccaatatccaatctgtcaccacctcctttgtagtggttaagagagtgagttaagataggctgcctgggttgaatcctggctccactagctatgtaattggggaaagatacttaacctctctaaaccttagtttcttgcaaaatgggagtaataatagtatctgtttcgtgagattgttttgaacataaaaggaaatctatgtaaaggatataacagtgtttctctcatagggtctgatacatgttaactattattaggactaaatgggaattttttgctattgagttgtttgagatccttgtatattctgattattaatcctttgttgagtggagaatttgcagatattttctcccattctgtaggttgtctcttcactcgttgttttctttcctctcagaagctttttagcttgatatgatctcatttgtctattttgctttagttgtctgtgcttttgaggtcttactcaaaaaaatctttgcccagaccaatgtcctgaagcaattgcccagtgttttcttctagtggttgtatagtttcagatcttacatttaagtctttaatccattttgatttgatttttgtatatgctgagagttggggtctgtttgtttttgtttttttgtttttgtttttgagatggagtctcgctctgtcgccaggctagagtgcagtggtgcaatctcggctcactgcaacctcagcctcccgggttcaagcgattctcctgcctcagcctcccgagtagctgggattacagacgcttgccaccacgcccagctaatttttgtatttttagtagagacggggtttcaccatgttagccaggctggtctcgaactcctgacctcatgatccgcccgcctcggcctcccaaagtgctgggattacaggcgtgagccactgtgcccggcccggggtctggttttattctgcatatagctatctggttttcccagcaccatttattggagagagtgtcctttccccagtgtatgtttttggcatcattgtccaaaatgagttggctataaatgtgtagatttacttctgggttctctattctgtttcattggcctgtgtgtgtggttttatgccaggatcatgctgttttggtaactattgttttgtagtatattttgaagtactgctttgttctttttgctgagggttgctttggctattcacagtcttttgtggctccttacaaattttaggatcttttctctcttgcttttaagaatgtcattggtattttgatggggattgcattgaatctgtagatcactttgggttagtatggacattttaacaatattatgtcttgtaatccatgagcttggaatctttccatttttgtatgttctcttcaatttctttcatctgtgttttataattttcattgtagagatctgtcacttctttggttaaatttattcctaaattttttatagctattgtaagtgagattgctttcttgatttctttttcagattgtttcctgttgttgtatataaatgctactgatttttgtatgttgattttgtatcctaaactttactgaaatcatttatcagttctaatagttttttttttaatggagtctttagctttttctaaatataagatcatgttgtcataaacaaggataatttgacttctttttttctaacttggatgtcttttatttctttctcttccctaactgctctggctaggactcccagtactatgttgaataaaagtggtacaattgggcatccttgttttactccagaacttagagtaaaggctttcagtttttccccatttagtatgctgtcagctgtgggtttgtcatatatggcctttattgttttgaggtgtgttctttctatacccaatttgttgagggtttttatcatgaaaggatgttgaattttatcaaatgttttttcagcatctcttgaaatgatacgatttttgttattctgttaatgtaatgtatcacatttattgatttgcccatgttgaaccattcttacatccctgggataatcccacttgatcacggtgaatgatctttttaatgtgttgttgcatctggttttctagtattttgttaaggatttttgcatctatgttcatcaagcatattgacctatagtttttttttgttgttgtatacttgtctggttgtggtatcagggtaatgctgttcttgtagaatgagcttggaggtatgttctccccttcaatttttttgaatagtttgagtagaagtggtgttttaaatctttggtagaattcagcagtgaagccctcagatcctgagtttttctttgatgggagactttattactgtttcagtctcattactcattattggtttgttcaggttttctatttcttcatggttgagtcttggtagattgtgtgtgtccaagaatttatccattgcttccaggttttccattttgttatagtgttcataatagtctctaatgattctttgtatttctgtggtatcaatcgcaatgtttctttttgtctctgcttttatttcttttgcacattcttagtagctcctttttatatctctataatcatttaattataatataaaatattattggtctttactcttatggggtttttaacacttttgttgcttatattttttttcccctgtaattgtgaggacaaaaaataatttattaattctaagtataatcagattattttcttgttcttccttcactgtgtaaaaatagtatgcttgactccctttctaacagcagacagtgattcttgactttccccatattcttcccttcctctccagttctgatgacattgcacattattatgtgtgtggtttttgagacattcattagccaaagagaaagttaaaatataccttacatatatgagatgaacaaatttgtaggattaagcaatgtagatccaaaggttggttgattttaaagttcttttaagtgttcatgtatttaatgctttcacttaattgacatttgtgaatgtcagtatgcattataaaggtattaggtttcataactttaacatgtacatatattgaagtcatggcattttatgtgtgttttttttcttttatagagtgagtctttggttgtttgtgatgttgccgaagatttagtggaaaagctgagaaagtttcgttttcgcaaagaaacgaacaacgctgctattataagtaagctaaaagtgattgcctcaaagttacatggtcttaatttgtttttaatcttgtagctacattgaatgaactgaaccgttggaaagcaatgttacttcctctgtttcatttccccaccaccacctttagatcactttaaaaaataagtaacagctaattctaatgtcacagaacagaggtggattgtcccacctcccccatagtccttttatcagctgcctgtacagctctggagaaggcggtcgtcttggtccttgggtaatgaggattcccatctgcagtgacccatccaacccatccttcttgggggactaaaaatagcctggccattcatcctcaaatagaaacctttgcctacacctaaaatgacaaagttcagcattgtgtacatagtgactttgggcattattccagttgtagatttgaactctggtttcaggaagagtacttttaagtggcactggcactatcttctgaaaatggaaaaagtgatttgcatattgctcctcccactgtgagctatatctgacattatgcagatttcccttgtattcataggcagtatttaatatgtaggtagtgatttagaaagatgaggaaaggatgagggggtgaaaatgtaaaactctagagaccatgcttaacagagatgcatctggcagatgtgatttaatcagaggtcatgacaacttgtcatgaattctgatttcattataaataaatactgcaatgtcgacatatggttcttaaaagtgaaaaaaaaataaaagtgaaaatgtgtgttagtgccatttactgcaaaagctgaaactatttgagattacattatatctcacaagatttactatcaaattggtgcaaaaccaaacatggtcaactttgccagactaacaggaaaggatagaggcatagagtatctaaacttattttgatttagctttggattacattagatatatttgaatgtagatatcacttctatttggttattcactttcttagaataatgataccgtgccatgaaatcctgaccttggagaagccaggaattttgaggtttctctattttgatccccgatcaggcactttttcccttgcagttctgaccatgttgcatatagaccaatcagttacagttaccctttcaggctttttcttattatctagaagttggatttgagttacaaagttctttcatatacacaggaaatgtaagaaattaacagcaagttctaaataagcaaattaggtactgggaattatgggtaaaagcttttaaaagctgacagcttgaaaagcaaagctagctaataaaccgtaaactaaaactgtgaattagttatatgcttctgtttcttgatgttttaattttagatgtccgaaaaaaaaggctgagattgtgtgggttgggcagatcagggtcacattagaatcccagcttactcatacttgatttttattttagtgaagattgacaaggataaacgcctggtggtactggatgaggagcttgaggtttgttcaatgaactaaatacaattttatagttaagtaattattatttctcaaaagatgctatattagttacatatgcttctaaaacgaatcttgaacctcctttaaatacatgctcattatgcataaaagcatgtgctaattgtgtagtttgtgatattgctaatttaactaccttgtttaaaagcattagtgaagtccagtgtaataagtggtataagttggggtcatatactgagtaagaagtgagtcaactttgtaacttgcttctaagttgcttgactagtacttaaaacctgaaaccctacaatttaaatatctggtttgtcaaattaagtaactagagtaaaaagaattcaattcttttttctgaaatcagacattgtttctttccgctaagatactggcttatgtcattcagtatttcctgacagctgggacataagcatagaatctgtgcctcccagccccatatttacttaataaatggaatgaaaccaagtgggcagaaggaggctttgattggattgagaatttagtaacctgagtttatgtataatttagtaagataaaattttattttgtagcatgtggtaataaatttataactgttagtagaatgggtgcttggtgtatctcttaaggacttatgggtaagaaaatgtttaaaagttgcttttctctgtggtgccagggcatttcaccagatgaacttaaagatgaactacctgaacgacaacctcgatatccttttcttagtgctttaaaagatttattttctttagtggtcagacctgtttgtgagctcatttgttaaacatctaaaagtatccttctgtgtcatgatgacagccaaattaaaatatgtgtgcatatactagactaagaaaaatgaaaagttggtttattcgtgggatgaataattttctttttaaaactatttcctttattataacgtgtacaataaaaattgagaaaataatctgtattaaacttgtactttaaaaagttaaattttttgagagattatgtgattttataacttatccttggaacccatttaattttgtggaaagataataatgaaggtgtggcctaaaagaataggacagaaacttgcagctcagtagctccccaggtgttggtaaatacctgtctgagagcagtaactttagtttctttaacttgagaaaaaccttcattgtgtatagttataaatatcaacatgatgatggaagagtttcatatcctctgtgctttattttctccagtcctgttggtaagtgaatttctttaaataacacatatttggcttagatccaattaagccattttatactagacaaattttctgctgtttttaaagatgaacattgttgaataacctaaattgaggagggtctgtgtctatgtgtgtccatgtgcctgtgtgcatgcatccctagaaagaatgaagcatcatctcttagaacttattttcttaggataaatttctagacgtgtaattgttgactcaaatcatacatgtattttaaggattttgaaacgtgatgacattctaatatagcagaagtattttctttttatattttaatcatataaaaatgtgaacttcacatataattgcatatatttgtgtttcttttaaatagtagttaacagtgatatgcttataatcttgagaatggtcctagagtaatttacattgggtattaaaatgggttactggtatttaaggaattcattatcaccagaacttctatcaccactgttcaggcctgcaataaaaactgcattcactgagctattctccaaacttcataatttgtataatttacttcccactcaaaatatactgcagtatatttttaacttaatatatcggcagagtgaaacttttatcagagcagatctccctgccctactggtccactaccatcccaaaaccttgtgtattttagtcatccataaaattgatcttgatatttagtgtcaaagttaagatagtgcagaaagtttttaattgtttgcaaggctctaaaagtcaggatctacaaatgtctagaatctttatttttgccaacctgtagacttgttcttgtttatttataacttaactgtctctttctgtaggcagtgtgcaatgtaagactcaaaatacaacccatatatattctgtaaactcaatagcaaaggaaatcctaaatgtgtcattttaaaaaataaaaataatgataacccatacctttctcaaaatctgtgtctcatttctacactaatctctcttttccaggatgtaagcctgaacaacagatgatgtatgctggaagtaagaataagctagtccagacagctgaactaaccaaggtggtatttatatttgactgacttgttgagacaatattttcctttagactataaagcaatagctaaaatagtctaaaggagtattttttatgcaggtgaaggttatttagaccagattagtaagttagccaaagctttttgttaactggaaatagaatgagatagaagcgtttgaaccaaagtgtattttttgaataagttgattggaagaaatcacattcaaaatataggcagtgttagaaagccactgtaactattaaatctattgagagttagtttatctgccataaggtaatttctaatagataagggtcagcattgaagtttctctgaaccctttaccatagtctaaaatgaaccgagttctgtgctggaattcagtattatgcagttaattgtattgtttccaaatataaaattgttaagaatattaataaagttagaacattctgttttatatgagaacttgctttaagatttaacatgtccctattttatggtatttttgaaagttaaaggtaagaggtacttggctctcaaactttatttaacttccacatattagtttgaattgaaaaagtatatgcacttaaggttttgaaataggatattatattgccaaaactgtgttagacagtatttcctttcaagttttattttaagaacagcatcagtattttccccttgggtgcttaataatcaactctggaatgcctttaagtgccctctgctgtttccccttagcccatgtgattgttaccactgctttatagacattactttttcctgatttgtaacacagggacactggagttgctctaacggtttgggtggttaagaaggagctgttaacggcctcaagtctgttctaatcctggggatgccctacagtgctgaagttgagacattacagtttaccagttacttttacagataatctcattgaatccttacaacagccctgtgagatattctgtagataggaaaacagacccagtggatgaatgacttgctcagggttgcataacagtaaatttagacagagctaggatttagctctgtctaggacttaggattcacatctggctccaaatcctatcctttctgctgtaatacattgcttttctatagccgttatgctttctgggcctgattcagattcttgctggagatttgtggctgatctccatctccctctgatatttccatttgacattcagactctggaagaccagcgtatgttcctcagttcctaactagattgattttagttgtgtttacttgggatgtcttctaggagataagatttacagaactgctcttttagactatttgtagatttgtgcttttgggagagttttggtttcatgttgtcttgattgctgtactttggtaactgagtacttagcatttaaaagaagtgaagttctacctaaaaggtatatctcatttacacaggttaagtcatgaacaatatgaaaggaagcagaatttggtatttaatactcaaatatataaccaaaaatagtttggtgtataatactcaaatatattttaaaaaattcaaatatttgactttttttttggagtgtcaaagtatgacccaagttttttttttttttaaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaagacttccagcttttctttttttactcacctctttccccctttggagttactggtatgtacctggctagatttgtgtgagccataaactttatctggacaaactgagaggcaaaataaacaagtcatttggcagcttggtggaaggagaagataatcaagttataaaaatttctaaaacttggtctgatgctaaaatgtagaaaatgtcagtaaacagtagtagggacagacagagctatttcaaacaatgaacgcttgctttcaaagggagaattcgaagttaggagagctgtatacttcgtaagaaatcaaattgaaggtttttttaattgaatatagcttatcactatgtattaaacacccattgacaacccgtcctacctttattaccaactgtactatatggtatatgttcaataggtatctactgaatgaatacaaatcactaataacatagtttttagagtttgccatgtacttgtgattgtgtatgttgtaatagtcacaatttgttatgatggtgaaaggagtagtttatgccttcctgtctttaagaatttcacaaggaaaattggcccaagcatgggaacatttatatcttccttatttatcaaatttggccacttaacctactcaaacagccagctcttaaattttttcaccttcactaaataatacctattgtctttttgtccttttcacttttcagcagcaagaagcatttgtaagcacttagcctctgaacctgggcgcactcttgtaaccacccaatgggttctccttgcctgctgcccagacagagccaatttattaagataggagaactgcaataaagaatttttaggcctggcgcggtggctcacgcctgtaatcctagcactttgggaggctgaggcgggtggatcatgaggtcaggagatcgagaccatcttggctaacacagtgaaaccccgtctctattaaaaatacaaaaaattagccgggcatggtggcaggcacctgtaatccaagctactcgggaggctgaggcaggagaatggcgtgaacccgggaggcagagcttgcagtgagccaagatagtgccactgcactccagcgagactccgtctcaaaaaaaaagaatttttaattcacacagagctggctatatggaagacctgagttttattacccaaatcagtatcccccaaaattctgggattgaagtttttaaggataatttggtgggtagggggttgggaagtgaggagtgctgattggttggatcagagatgaaattgtagggggtcaagtgggtttttcttggtgtcttctgttcctaggtgggatcacagaactggttgagccagattaccagctcatcacaggctcgaccctgtggtgcttcagaacacagggtctgcagaatatctcaagcactgatcttatgttttacaacagtgattttatccccaggaacaatttggggaggttccagaatcatgcagccttggctgcggtgactcctaaactataatttctaatcttgtagctaatttattagtccctacaaaggcagactggtccctaggcaagaagggaggcttgtttcaggaaagggctgttatcatctttctttcaaagttaaactataaactaaattcttcccaaagttagttcggcctatgcccgggaataaaccaggacagcttggaggtcagaagcaagatggagtcgattagatcaggactctcactgtcctaattttctcattgttagaatttttgccaaggcagttttacactcatttgcatgagggtacaccctgagtggatattgtatccttgtatagtgtagttttaactgttggggagccaattaaagatgttactgctgagcactagggagttttcacagataatcctcttatcttctacttgagatctacccctaggctgtgtgaaagctccctgctgaggttgctgccctcttttaattataggaaggaaagaacgcct

SEQ ID NO: 13520 - DNA, 64639 bp, Human
  misc_feature (1)...(64639): n = A,T,C or G
acttagtatctttgttttcatttgttaaatgcaaggtcatcctttgaatgttgtcttcaactatgcttgaaatagcttgagacccagcagataattctgaccaggaggtatcagcagacagtgggcagcacagttagaggaaaaaaatgttgcagggccccactcccaataaaaacctacaataaaaaatttaaaaattttaataaagaggaaaatgacaaagaggttttccaaaggatgttcatattctctatttaaaaaccccactgggccgggtacggtggctcaggcctataatcctgagccctggagttcgagaccagctttggcaacatggtgaaaccttatctctaccaaaaatacaaaaattagccagtctcataacccgctcttaaataaatagattaaaatttaaaaataaataaataaataaataaataaataaataaccccactgatatgaacatttcttccattttggagtaaaggtgcctacaaggctaggcaatgtccatatttctttcctgaatgtttccaacggggctgcgcctagagcagatgtatcataaatactaattacttattataatgaccaagctacattgttagcatagaataattccacaggcttccctattggtttgtttgatcctaagcctattaatacctgcttctatgtcagaaaatctacattaggccaggcatggtggctcacacctgtaatcccagcactttgggaggccgaggcaggtggatcacctgaggtcaggagttcgagaccagcctggccaacatggcaaaaccccacctctcctaaaaatacaaaaatttagccgggcatggtggcaggtgcctgtaatcccagctactcaggaggctgaggcaggagaatcgtttgaacccaggaggcggaggatgaagtgagcctcaaaaaaaaaaaaagaaaaaaaatattattttgatacatgttttaaagctcaccttcggcattatgagataatccctcaagtgaggaaaaaggtccatttattaatctcaaagaaaacagttacagcagatgtcactggttaagagttcagttggtgaatagcatttcacaatttgtaccaacatctggggaaagacgctttgcatggaactgtaaaacaattgagcaccaaatctgcacaactgcgtttctagaaaatgcgatgggttttatagagatgaggtcttgctatgttttccaggctggtctcgaactcttggcctcaagcgatcctcccgcctcggtctccccaagcgccgggagtacaggcgtgagccaccgacggaaatggattttaagtgaaagtcctatcttcgtttgcaaatcaatttttccaggatcaaagttctagcaaccataaatcctatccttctagacatagggacccacataagggccacttgatgtgacacttgccccgacagcggtgccacctggcccctaggtggcaggtgcgtttttaactaaacccaagagtctgaagtcacattattctcttgccttgaaagcttaagagttggttcctaatcggtggcttaactcggtctctctccaggcaaggccacctgtttgctgatctttcacagggcgaggggaccggagcccttcaatgcagcgccctcttggcctgaagagggggcgactgggcgcccagaccgcgtctttctcactgagatcccagctcctggacgactgcctcttttcgggttcggctcattccgcaataagtggaggggtcccgcctgatcctaggggccggcgcccttttccttccctccctgcgcttgcgaacccctccgggcgtctccggagccgcgacccctgctggggaccccgggggcgggaggccgaggggcgcggcgagggccgtgacgcgaggcggggccggccaatgggagcgctccgcggcgcaggctgagccgccgggccataaaaaggaggcgcggccgggctttccagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcaggtcagtgcgcccgcgggctgctagagcgtgcgggcggcgggggcggtgcttgcaggaaacgcgcgccggctccaggaagtttccggagttgcctcacttttggcgcaggaagccgggcgctgtcacctccgaacccgccctagcctgccgccctgccgaggccctgcgtggggcacagtcggggcttcctgggtggcagcgacctctcagccccggaactcgctgcagccgccttccaggggcccttcccgctcccagcgcgcagccctcctagaacgccccgggtgggcgtggacgggagcccggagccctctcgcctgagcgcccagcgcgggattctcggggtacctgcggttccaaacttgcccacgataaggatcacctgggcacttgctgcggcgacggcttcctgggtagttccttattgagatcccattgtcagggtgtgtatctggattgaagcctcggcgcgatccttccccgaaacctcggggacctgcattcccactgatttgccaggggatcggagtcttagagttgtgcttttttttttgtccacctcaagtttactccagttcaggacatttacaaaattcggcacaattttgggcacgggcttccccggagtttgaggtgtgaggttgattgggtgagtttgctgctgaaatctgtttcctccccccacccccaaccccgcaaaaagcagtaaagctactccgggattcggagggctccgtgggttccaggactcagtctcatccccgcaccctcccaccctaaaataaagccgggttgacccggtgctgttagcgtctgaggcgtgtcggcttttcacccagagggtggggatgcaatcagtgtgggtaggatgcaagatggggtgatggagagtggaaaatggggactttgctgcctgttggccagagaagcagtattggtctgtgtttaaaaaaataaagcttctggcttctacagctgggaccaaagacattattttccagtctacaccttccgtgtgtcttggtgacatttatttatttgccctaagaagcattctaccgttcactgttttttgaaagaaaaacagtgcgctggaaaggcaatctccctgccccagttatttctctgaaggagtgtagagcgattccaccaaatagaccctgggaaaaagaaagttattttttgcccagtcttccacaccccaaaggaagggtgggaaatcagaatgtgaaagagacggggccccaaaaggaaatgatgctacactctaaaaccggcagtgacttctagttctgtttccaaattcacttttttttacccctcaattgcaaaagtttggaatctcagaagagatttcaaaatacaaagactgaaaaataaactttcagttttctgtgggatcagctctttggaggtctagggctttaaatttgtgtgtgtgtgtgtgtgtgtgtgtgtgtgtgtgtgagatatttcacaatgtaatgaaatgtcttcttaaggccttactcattttgccccttgcagacacagaaagtggtttacttcacagcatcggccaggctttgggaatcctcccttaaagagaattcataggacagtgttctgtaatctagcatggatctaattacccaaagagagaggaatttctgaccctgagacaggtcacagaattatctaaagtgactcacagatttacttgagaaatggttagctgaaatatctcatgagcgaagattcatttaaagaggattaataactgcaaagaacacatcattccacattagaaaactgttctggttggccgagctcggtgctcacgcctgtaatcccagcactttgggaggccgaggtgggcggatcacctgaggtcaggagttcaagaccagcccggtcaacatggcgaaaccccgtctctactaaagatacaaaaaaattagccgggtgtgatggcgggcgcctgtagtcccagctactcgggaggctgaggcaggagaatcacttgaacccaggaggaggaggttgcagtgagccgagattgcaccactgcactccagcctggacgacagagggagactctgtctccagaaaaaacaaaaaaaacaaaaaaactgttctggtcaagttttactatttaaaaagtccatgggccgggcgcggtggctcacacctgtaatcccagcactttgggaggccgaggcgggcggatcacctgaggtcaggagttcgagaccagcctggccaacatgggaaaacccattctctaccaaaaatacaaaaattagccgggcatggtgtcaggtgcctgtaatcccagctactcaggaagctgaggtaggagaatcatttgaaccctggaggcggaggttgcagtgagccgagatcgcaccattacactccagcctgggcaacaagaactaaactccatttcaaaaaaaaaaaaagtccatggatgtagagacactgcaagattagtagttgtcagggactggcgagaagagggggatgggtagtgattgtttaatgagtatggagcttcctttggagcttccttttggagtcatgaaaatgttctggaactagagagtggtgatagttgcacaatattgtgaatgccactggattgtaacttcaagatggctaaaaatgaccaattttatatatattttaccacaatataaagacaggttttgtggcgtgcctgcagtcccagctactagggaggctgaggcaggaggatagttgttgctcaggagaacagcctgggcaacgtggggagaccctgtttcagaaaagaaaagtccatggagcggaccatttaagattattattattatgtttattttcatgtttttgagacagggtttggctctgctgcctaggctggagtgcagtggcgcaatctcggctcactgcagtctcactctgctggactcaagtgatcccacctcagcctcctgaatagctggaactacaggcttgtgccaccatgccctgctaatttttgtatttttgatagagacgggtttttgccatgttgcccgggctggtcttgaactcctgagctcaagggatctgcctgccttggcttcccagagtgctaggattacaggtgtgagccaccatacccagcccatttaagattattataagccattaattgaatataatcatgcattacattatgatgtttccttcaatgatggaccacatgtatgaaggtggtttataagattacaatggagctgaaaaattcacattgtctggtgatgtcttggtgatcctgacctgtgtaggcctagagtaatgtgtttgtttgtgtcttagttttttcctctcgtctcccccatgtcttagtttttaacaaaatttaaaaattaagaaaattgggccaggcatggtggctcacacctgtaatcccagcactttgggaggccaaggtgggcggattacttgaggttaggagttagaaagagaccagcctggccaacatgttgaaaccccatctctactaaacatgtaaaaattagccagatgtggtggcgcatacctgtagtcacagctacttggaaggctgaggcaggagaatcacttgaacccagaaggtggaggttgcagtgagccgagattgcaccaatgcactgcagcctggttgacagagtgagactccgtctcaacagtaaataaataaataaaaataaaaattaaaattaaaaatagaaaaaggtatagaacaaggatataaaatatttttgcacagctgtacaatgtgtttttgttttaagctgtgttattacaaaagagtcaaagttttaaatacattaagctgaaattattgaagaaaaaatatgtttagtgtagcccaagtgtacagtgtttataaagtttacagtagtgtacagtaatgtcctaggccttcacattcacttaccatgcattcactgactcacccagagcaacttccaatcctgcaagctcctttcatggtaagtgccctacacagacataccatcttaagtcttttctactatatttttactgtaccttttctatgtttagatgtctttctaaaattattattatttgtattttaaatatagaggcagggtctcactgttttgcccaggctggtctcgaactcctgggctcaagtgatcctctcctcttggtctcccaaagtgctgggattacaggcatgagctatcccacctggcctacatatctttaaatacacaaataccattgtgttacagttgcctgcagcattcattacagtaacatgccatacaggtttgtagcctaggaataataggctctaccgtgtagcctaggtgtgtaataggctatctcatctaggtttgtgttagcactctcttccttcagtgtttgcgatatgaaactgcatttctcaggtgtttctcagaatgtatccccattgttaagcaatgcatgaccgtactttttaatgggttaaaagctttacgttggatggtcttggttcatcttccagttttcaagtaaacatttctcttatccccatgacaaggcaactgaggcagagaggttgacacaagtagtagagctggtatttgaatccagagagtctgactgcagaattcttagccacttccttatactgctacagagagaactgaatcagtgtaccctatctgtatatttcaaactgtgaattgggtcaacagcattaaaaaaaaaagtggagtagccgggcgcggtggctcacgcctgtaatcccagcactttgggaggccgaggcgggtggatcacctgaggttgggagttcgagaccaacctgactaacatggagaaaccccttctctactaaaaatacaaaaattagccaggtgtggtggtgcatgcctgtaatcccagctacttgggaggctgaagcaggagaattgcttgaacccaggaggcggaaattgcagtgagccaagattgcaccattgcactccagcctgggcaacaagagcgaaactcagtctcagaaaaaaaaagtgagtagaggttgggcacgggggctcaagtctgtaatcccagcactttgggaggctgaggtgggcaaataacgaggtcaagagatcaagaaccccgtctctactaaaaatacaaaaattagctgggtgtggtggtgcgtgcctgtagtcccagctacttgggaggctgaggcaggagaatcacttgaacccgggaggcggaggttgcagtgagccgagattgtgccactgcactccagcctggcgacagagcaagactccatctcaaaaaaaaaaaaaaaaaacaaaaggtggagtagaatggataagatcagtctatcacatatagtaaggacaagtgttttgagaaacttcttcttttgttttttttttttttgagatgaagtctcactctgtagcccaggctggagtgcagtggcgcgatctgggctcactgcaagctcggtctcccggttcacaccattctcctgcctcagcctcctgagtagctgggattacaggcgcccgctaccacacccggctaattttttttttttgtatttttttagtagagatggggtttcaccgtgttagccaggatggtcttgatctcctgactttgtgatccgcccgcctcggcctcccaaagtgctgggattacaggcgtgagccaccgctcccggccgagaaacttctatgtaggttttataggcataattgtgtgtgtgtgcactggctccagatgtaaaatgcatttcttactgtaggttgtagtcaaaagtttgaaagcctgtatctaggggatctgtttaaggatttaatatttcttttttttttttaaagagatatataattaaagagaagacagagtagtgagaacaaggatgatgctgaacttaaaggaatgaacctgaaatgtggtggggtcttggaccaacctggatggcagggagaaggaaggatactggtgggagataggagtgagtgggaacccacatctttaggtccataaacgcttctgcacaatcccttttatttctttagagagcatgagtcaagtggccactatatattgtttttggataagaacatacttctctgaaggtcacttttctgtgcttgtaaacaggatacaggactttatatcttttatatatctgtattctatatattaactcctggttagtaatgttgacttaagtgttgtaaaatttaaaataagttggtattttacattcttcaaaatccatttttcctcccagtgcctcttgtgtggattgatccaaattcctggcattctggggaatttgttcagttttccctacgttgcagcgtctctccatgactgtctccttgtgcaccttttccctactttccagtgtgtaccttccatgggagcatctgtggtcatctgtgaccagggtggtgtcagggttgtataggtttcctagtactattccctactggactgtagctcatgggctaggagggagggctggaggagacgctatcatctctcccaggaactggctgtcctttgaatctacatcacaagctgatccttggaccagctcagaccagctcgtcttgatctatttctgtgccatttcagtttagctgtatcctagttctcttaaatattcaaggttttatcttggtgagttctcctttctatataaggtacctttcctgtatttccactattcttttattcagaacctacacttagttaaattggagagtctgctattctctgagggccttgatcttcatgcccctgtaactgacccttccaggtatacatgggaacagcctttcagacagcattatctaccaaggattaaatgggtataacttgttccatcagttgttttttatgagtttttgggaatatgcaagagtcttgactctgtcacatttccagttaaagtaggttttagcttgtctgccaagacagtttttataaatcatgttaacagttcaaaattttgggaagcatgcatataatccagcgtgaggagatggcattggagatggctgactgcttccctgtgagggctgaggaagcacagacactggcagtgagtcatatccccacctcagccattttcactggaagattatgtctattcgctaaagataatgggaggcaattagatactttgtttatacaaaaatgcatcttagacacttcatactgaaatgtagcaatcacaaaaggtttttctttttgaatcacaaacctctcggatttattaaattagactgctgtggtgaactaagaattttaacaacttctaagatgtgaagaggaacaaaaacataaactatttactattctctcctatatcatgggtgaaaggtgagtttatatcccaagttttaaagtatattatagaaatgctcttctcatcattaaaaggtactattttagatgtgtagctcactcaaattttgatccattaataatttttgtgcttggtttgttaatgaacacttatataggacttagttgtgttcattgccagaaagagcactgtgaataaagaagaaaaaataacaaggcacttttgacatattatatgattggaattttggacatgtctaagtggaataaaacagttaagaagttactgagaaagggggagaaaagccaatcctaatagtttcttttaaaaatggattatctataaacaatttttctgacatgggaagaaaaatcaatatacataacttcactatagcaagcaaagccttcaggttggtactcgtactagattcccagggctgctatcacacagtaccgcaaactaggtggtttaaatgacagaaataaacagtctcacagttctagagactaaagttccaaaatcaaggggtcagcagaaccatactcactccagaacctgtagtgggggaggctgtccttgcctcttcccagcttctggtggtggccgtcagttgatggtgttccttggtttgagctgcgtcactccagtcgctgcctctgtcagtgtccatgtttttgttttgtcttataagaatgtcagtcatatgaggcagggtccactttactccagtatgcctgtgttagtttagctaattacatctgcaacaaccctacttccaaataaagtcacatgctaaagatacctggggtttaggacttcaacatatcttttttggcgaatggcacaattcaacttgtattagtactaaatactattattaaaaaaattagtaggaattttactacaatttcattgatcatcaagtactacgcacttcactgaacgctgggaatgcaggatgagcaaaaccaggtatagttcctgccttcatggaacttacagcctagcagatagaatcacatgaaatagaaatgtgttgtgagattgagaaatgtgatgataaacaaaaacacagctcagtgagagcacttggcataggaacttgaccaatgccaggagatgggagcatgaatgggtgaagcgatgcttaagccgactgatgttctgagtaacaaatactgctgatggcttactttgtgctaaacagtgagtttttacatgtgttacctcatttgatcctcacagtagcacgatggggtaggcaatattattcccattttatacataaggaaattggggcacagagagaactttcccaagactgtatcttgaaagtggcggagctgagaggatgatatagaaagagaatcattgtaatctctggtaggtgatttaattttaataataatattttactgatttatttgaatgatttctcccttcttcctcacctatccccgcttttgtattttctctgctatttgctttgtccacctctagaaacccttccatgcctgggcattccccacctgactcatttgccagtgatttctatatgaggactgtaatttgagtctagtatttggttgagtagactgcagtgttaaaactcaccaggagagggcaactgtctaatcattggatcccagattatgaatcctggattatgtgaacaattctcagttccaggttatgcaaacaaatatgtttcccatggttataaatttgctagagtctatagtaattagattgggatataatttgtgttgggttatgcaaagagtatctgaaccaagttaaatctgttatactcaaggccaagaggacattcatttactagaattttattctattggagcccattagtagaaatatttatttatttggaggcagagtcttgctctgtcacccaggctggagtgcggtggcatgatctcagctcactgaaacctctgccgcccaggttcaagcaattaccctgcctcggcctcccgagtagctgggattacaggtgcccaccaccatgctcggctaatttttgtatttttagcagagacagggtttcaccatgttagccaggttggtctccaagtcctaacctcaagtgattggcctgtctcaacctcctagagtgctgggattacaggcatgagccaccgcacccggccggaaacatacaatgtttgtccttcatgtctggcttattttactttgcaaaatgtcttcaaggttcatccacattaaaaacatctattttatttttatttttattttttgagatagagtcttgctcttccgcccaggctggagtgaagtggtgtgatcttggctcactgcaacctctgtcccctgggttcaagcaattctcctgcctcagcctcctgagtagctgggattacaggtgcccaccaccatgcctggctaatttttgtatttttagtagagactgggtttcaccgtgttggccaggctgttcttgaactcctgacctcagatgatccgcccgtttctgcctcccaaagtgttgggattacaggcgtgagccaccacatcagtaattcattctgtacaatgttgtatattctcaacacatattatattttaatttccttatttcaagaaaaccttagaattgaagatacagtagttccccttatccttggggatctgttccaagacccccagtgggtgcctgaaactgagggtagtaccaaactggattgccatcattcagaataaatttctgtttgtgtcttctacccacaaatttcatgccttttccatcttaactaagcacttaccatgtgctgtggccatagcttttgcagtctgaagtacaataacaatactagcatgaatttttttttcctccttcacagtttcacagatagaagatttgttcttaatatagttttagcaacctcagcgtaatgattttgttcattaataaactgagaactttaatctttttcacttgaaggaaacacagcttctctttggcataactgaattgccaacgtcactactcttgtggtttagggccattgttaagtaaaataagggttacttgaaaacaaacactgcaaaactgaaggttgatttgatcactgagatggatactaagtgactattaggtaggaagcatagacaatgtggatgctctggacaaaggattgattcatattctgggcagaagggctggagatttcatcgcaatactcagaatagcgtgcattttaaaacttatgaattgttggctggatgcgatggctcatgcctgcagttccagcactttgggtggccgaggcaggtcactgacttgagctcaggagttagagaccagcctgaccaacatggccaaacctcatttctacaaaatgtacaaaaattaagcaggcatagtggcatgtgcctgtaatcccaggtactcgggaggctgaggcacgagaatcacttgaacccgggaggcggaggttgcagtgaactgggattgcaccactgcattccagcctgggtgacagagggagactctgtttaaaaaaaaaaaaaaaaaaaaaaatgccaggcatgatggctcatgcctgtaatcccagcaccttgggaggccaaggagggcgtatcatttgaggtcaggagttcgagaccaggctggccaacatggtgaaacccccatctctactaaaaatacaaaaaaatttgctgggcatggtggtgcacacctgtaatcccagctgctagggaggctgaggcaggagaattgcttgaacttgggagccgaaggttgcagtgagccgaggattgtgccactacactccaacctggatgacagagtgggactctgtctcaaaaagaaaacaaacaaaaaaaccttatgaattgtctatttctggagtttttcatttagtattttcagaccatgtttgaccaagggtaactgaaactgtgaaaagtggaactgtagatggtctctatgagtagtcactgttaaaggggaaacaaagatgattgttggcctgatcttggccttcaaggagtaaaggggttctgtgtagtcagagggaagctgggtgcttctggtggagagacaggaaagtccagatgttatggagaaagtagcttttgagttgaacctagaaggaaattcattttgagtttttttgggttgtttgttttttgcagaacgtgtccatgctggtttagagattatggtctaagtgtttttcaataaaaggcatacactaacattcatagttacctgtaccagagttaaaattaaatggagttttcaaggcaattagatttattttaaacttttaaaagatcaatattaatggcattagggccagctcctttatctgatgtctttaaagttcattctggccatagtcaacccttgtaatgaattttaacctgacacatgttgctacttcatctagtctttgtaacctggttatttatttattttttgagatggagttttgctcttgttgcccaggctggagtgcaatggcgcgatctcgtctcaccgcaacctccacctcccaggttcaagcgattctcctgcctcagccttcccaagtagctgggattataggcatgcgccaccaagcctggctaattttgtgtttttaatagagatggggtttctccgtgtgggtcaggctggtctcgaactcctgacctcaggtgatccgcccacctcggcctcccaaagtgctgggattacaggcgtaagccaccgctcccggcctggttatttgttttatctgcaattattctttctcgtgaatccccttggctaatcatgctcacaaagttctgacacatataccacctgaatatttctagaatctgagtcatctttcacttaaattacaataacctcttaactggccttcttgcctcctagcttgtcctgctctgatccattcatgccaaagtgatttttctaaaattgaataagttttttccttgcaaaaaacacttgattgattttctgttgtctttcctcaccattgctgtgaggttttgttctgttgtagcctcttgctacattttttggcatttttttcttatcttccatcgcatttcctcatatagggcaatttagtattttagtttagtgcatagtttagtgcacagttaatctgagaaaccactctgtctcatttccttgctggagctggagacccaggtgaagatcctgaggtttgttcttttgcaatgtttggcctttattatctgccctcctcctgtaatttattttactgtcctttttgtttttggttggcaaccatggggaggtggctgctgcctcttgcttatcaacaactgttgcttatggagacttctgtgaacaagcagccaggtttaggtgaggaaattggccgtgactgaattctgggtgaatttttcgaggtccagttggtccaaatgtttgtgatgtgcagtcctaagaggccatggctcttcctgtgaagtgtgatgtgttttatgtatcacacattagtttttatttgtcctaagcaggaatcagaactcagttcaatagaggccattggcaaacatcccaaacaaggaatctctcactaaaatagcttaaaatataattttacctgtgtggtctaggcatttgtggtacagtgttcgttagcagtgaggaagggctatgcgtgcctggagatcagatgagaggccttaactcagtgaggtcgctgactagttgactttaaggcatagctgctgtagatcatacccctctaattgaccccaccatttatcgtttatcacatgggcagccctggaggtatgcctctctgatggcctatcaaaaagaatctgcccttcagcttcaaggaacagtttgctgacagcctccagctgttagtgctgtcaggctttgcctccacggaggccatacttatcccatgctgcgtgtcctttcattttggtgtcatctctttctccccttctacccctcctccaccacagtaaacagctttttgagggctggggctgtttacaagtgaagtagtttataaaaagtagatgcacatctttcagcttcatatttagcatgttggaaattctgttcactgatctaattctgaaatctccttggtatttcttaaactagttgtataggctgggtgcagtggctcatgcctgtaatcccagcactttgggaggctgaggtgggcagatcaccaggtcaggagatcgagaccatcttggctaacacgctgaaaccctgtctctactaaaaatacaaaaaaaaaaaaaaaaattagccgggcgtggttgtgggcgcctgtagtcccagctactcgggaggctgaggcaggtgaatggtgtgaacccgggaggcagagcttgcagtgagcggagatcatgccactgcactccagcctgggcgacagagtgagactccatctcaaaaaaaaaaaaaactagtatgtcaacaaagctttgtgctgctgtaatgggaagaacagctagcctgggctagtaatatgctaactggtttatgaacttaggtaggtgagtcacttgactattctgggtctgttctgaagggagaggcagtaggactaggagttaaattgtcatgccgaggtctctgagcatgggtgggcctgtcagaattgtcatcgctcactctgttgacttccagcagctgacaggcaaggccctaggaagctcttcagcctcctttccttgctagaggtgctgttttccctggaaatgttcaagccctgcaaatcgtttctatagtaacaggtctctgtcttttttcttatgatgcagatttttgaaaaggtttcttatctaaatgttcttgggatctatggtcttcctacctgtagctcctttgattagacagagcctttatttaaagacttttccccccaagaatgttgttgttgcttctaccaaaataataaccagttgttagttttactagtgcttgaagttttagtttattaataaagcttcatataaactagaaaaggagtggttgggtagaatagtaataccgaaaaaactaatattcactgttagtctcatgtatttgtaaactttaattttttattatgtaaaaccttcaaacataaaagtagtcaaaattatataatagacacctatatacttaccacctagattgaaaactaacattctgccatattggcgtagtttattcgtttactgatagtaaatcagagacatgtatttagaggtgaaatgtcaccctaaaaagcgtttttcttaatgatttacaccacccttagtaaaattagctattcattccttcatatcatctaatacctaatatatattcacatttcctcaggtgtctcaaatgtcttttactaatgattttttccaacaaggatccactcaaggtccatacatttgcatttgattattacgttttaatctggaatagcgcctaccgcccccaacccctgccactgctttatcagagaggtcagttgtcctgtaagatactctacctttatgatttgtatgatttttgtttgtttgttttcatttaacttctatatttctcatattcctggtaactgcaagtcaggtctaaagacctcactaaattcctggaaaacatttttagcaggaatgctctgtacttcatgcactgtcacaactgggagacactaagtatttggatcttgaagatttaaagacttctaattggtttttaaaagccctgtttcactggttttctaggataagcttctctagagaagttcctttttaaaaaatgttttattagtttgaagatttaatgggattttcctttcccctgaaattcttccagtttgatttcaaaaagaaaaggtcaacatagcattacatttctgaattttccctcaaataagccaaataaatagttggtgaaacagtattttgtgactgatgcgcaccactttggttctggcagtctctgggcattaggccactctttctgctctgctctcctggctgacagtttataatggattttacttttcttttaaaaaatcagatttgctgtcttttgctgtcatcagctctgggccttgtcaccacatggcagacttcaacctacaataacccctgatgcgtgtttcctgaaggggacctctccccttcagtccacacttctagtaggttgagttcagcccaagattaaggctctggtctggagtcagaagatgggtcaaaatctagctctcccaccggctggttggctcttcttcagcagtcagctagtgtttccaaatgacagtatctgtgtcctcatctgtaaagtcgggacaataactggtgttttttttgttttgttttgttttttgagacagtttcactctgtcacccaggctagagtgcagtggcgcgatctcggctcactgcaagctccgcttcccgggttcacgccattctcctgcctcagccccccgagcagctgggactacaggcacccaccaccgcgcccggctaattttttgtatttttagtagagacggggtttcactgtgttagccaggatggtctcaatctcctgacctcgtgatccaccggcctcggcctcccaaagtgcggggattacaggcatgagccaccgcgcccggcctataactggttttgactaatgcgagttgtggtagggcttgaaagaaatcacaaactaaatgtaaaatttaatttgaaaaatgctgtccaagcaggaactcacatccaggaacaaaatgaatggagaccagaaatccagatatgtatgcccaagaaaagcagaattttatccaggacttctcccaggttgtcaggatgctgactgaggatgagatggggcacccagagacaggagagtctattacctggctcaaagaggtcctggagtacactgccactggagacaagtaccactagggtttgatgatgctggtagcattccaggagctggcagagcccaggaaacaggatgctgatagtctccagcaggtcctgtctgggctgttgtgtgaactgctgtaagcttgcccgtttttttttgttgttgttgttgtttgttttttgagatggagcctagctctgccgcccaggatggagtgcagtggcacaatctcagctcattgcaacttccacctcctgggttcaagtaattcttgtgcctcagccccctgagtagccaggactacaggcgcattccaccgcacccagctaagttttgtatttttggtggagacggggtttcgccatgttggccaggctggcctcgaactcctgacctcaggtaatccccctgccttggcctcccaaagtgctgggattacaggtgtgagccactgcaccttgtgctgcaagctttcttcctggtggcagatgacatcagggattcatccctcaccttgctgggggcagatctgcttgtatcagaagccaggtgtaggtttggatgccatcaatgatgctatgcttctagaagcatctatctatcacctgttgaagctctgttgctgagagcaaccccattacctgaacctgaaaaagcacttcctgtggagttcctattagacagagatcaggcagaccctggaccccatcacagccccccagagcaatgtggatcttgactggttcactgaaaagaggtacaaatcactgtcaagtataagacagctttctacttcttctaccatcctgaagctgcagccatgtctatggcaggcgtcagtgtggggaaggaatgggccaatgacaggaagatcctgctggagttaggagttctttcagattcaggatgattaccttgacctctttggggaccctactgtcaccactggcagagtttgtactgacatccaggacaacagatgacaacaaatgcagctgactggtggttcagtgtctgcaatgggccacaccggaacagcaccagatcatgcagaagaattacagggaggaggcactatatgaggagctggatctgctgaccatgttcttggtatgtggaagatggttacagccaccttatgggtctcattgagcagtgtgttgcaccactgcccccagccaccttcctggggctagcgtacaaaatctccaagcaactgcaaggcagggagaggaggctctcaataaattactgtgtaatctttttttttgttgttgttgttgttgttgttgttgttttgagacagagtttcactcttgttgcccaggctggagtgcaatggtgtggtcttggctcactgcaacctctgtcttctgggttcaagcgattctcctgcctcagcctcccaagtagctgggatttcaggcacccgccactacgcccggctaatttttgtatttttagtagagatggggtttcaccatgttggccaggctggtctcgaactcctgacctcaaatgatacgcctgccttggcctcccaaagtgctgggattataggcgtgagccactgcgcccggcctactgtgtaatcttacaaaaaaagaaaaaaagaaaacaatgctctaaaagagaagggaattttgtttctgttccatgcatagacctacacaggcttttttccttttgctgtttcccacttccatatcttattttatatggtacttttcttcctttccctttctaggaaaccctccctccacctttcctcctactcgacctttaggcctgggtaaaattttaatcttcaatacaatcatattgttttgtctcagcccacaagttttcatttatgtgaactatcagttttacaatttaacctctagtcattctccaaatatttttacacctaggcctcttatttctgcagatctcaagttgcttgaggtcatggtttgatagatttgttttcagctcagaactatgaaaactttattgtattaccctagacattgatttctaatgagttggttgtaggatgcaactggtttcttaagtgggggatatttttctagaatgtgggtacaactttctgatgtgaggtcctcacaaatttttaaactttgctccagcaaaaagaaccacgtagaggttctctacctgggtccttcctgcctcaccttctttaggtggagttggctccagtttcctccttgtctctgcctccaccccacccctgccccaggcctcatagtgttccacaggaatgacgtggtgactgtagtgagggttacagtgaagaattgcccactgtttggccttgctgaacagcaaatttgggccagcagtgggtctgttttctctcttttctttttatttatttatttttttgagacagaatcttgctctgtctcccaggctggagtgcagtggcgtgatctcggctcactgcaagctccacctcctgggttcactccattctcctgcctcagcctcccgagtagctgggactacaggcgcctgccaccacgcccagctaattttttgtatttttagtagagacggactttgtccgtcttagccaggatggtcacgatttcctgacctcgtgatccacctgcctcggcctcccaaagtgctgggattacaggcgtgagccaccgcaccgggcttttttttttttttttttttttttttgagtcggagtctcactctgtcgcccaggctagagcgcagcggcgcaatctctgctcattgcaaactccgcttctcgggttcaagcaattcatctgcctcagcctaccgaatagctgggattacaggcacgcgccaccgtgcccggctaatttttggacttttagtagagatggggtttcaccatgttggccaggctggtctcgaattcctgacctcgtgatccacctgcctcatcctcccaaagtgctgagattacaggcgtgaaccaccgcgcccggccagcagtgggtctgttttcaaccctcatgtaccctcagctctcaagcctgtgtgctcccaccccagccagtcaccagaatcacatagattttaaaacgacttatcctgggtccatccctacacatagtaaatgagatttttgctgggtagcttgggacgctatattttccaaaactccctgttgattggctgtatttgggaacccctgttgcgaaggaagatcccttatctcttcatctgtcactaatgatggtggcttgcgcactctgatggtacttacttggatgggattacagatggttccatcacacccatctgtatgaaatctcgtggtataagtgaatgtaggatgataagggacgagcctattagaggcttttgaagcaaatggatagtttaatcagattggtgtgttttttttttctgtagaactgctgtgaactagaccttgttatcaccatctgtttcgtaaattccattttcggtttaacagctggattgtgaaagatatacaaaattatccagttaaaaaactaaatttggcaagtgtgtgtgtgtttttaaaaatgactccttgaatacactgttttgattccttagacagtttctaaggctctaattttggtctaccagaaatattcagagtagtaaactgagaccagaaaggcgagttctttggcttggataactttgagagttaatagtatacatgattggcagccttcagttttatccagcaataaatctaaacagtttaaaataagtactttccccttacctcagtacagagaggccctggccactgccatgcacatctcagaagctgagcagtggggcagaaggataacttgtaatttggcatcaatgtccaacacccttgagctctggactcttttattcattccttctactttaccattctacatcttgaaccactgtgcgtgcggttcccctaagaggcagtaaagtaattgcatcagggtggagggattttatgtgctttcactttctcatttgattatttctacatcttaccgataaacttccatgaatattactgttgtaatgaggagcaaaatgttagtaaagataactttatacgtgaaaacttgaactcttaccaagaaacgtagtgtttgtgacaaggctggctgagaggatgagaatagctcatcagtactgggttggctgaaggaaacatgcatgtcagtactattttgagggcagctgagaacatctatttcaatagctttggctatattttaatagctaagagcaacatatgaatttgtctctgccaaagatggagtgaaaatttccaaaataaccaaacttttactttttttgcaatacattaggtctttcctgctgacaaacctacagtttatgaaataagtttgtggagcatatcaaagctgtgcggcagctctgtgcactccagcagatggtgtgactggttgtctgtagtcgtcttagtttccgccattgtgtcagtctgtggaatgtttgggttcatgcttattttggccaagttttccaaattctgtcttggtaagtacaaaaagctgtgagtgtcggaagctctaacaagaggtgtactcatgatgaaagtgaaagcagagagagcgatttttttttcctctttgaatttgttttaacatgctcttacttgtaggacaaatttttcaaacaggtggtagaaagcaaaacatcttaatgccatcttcagggcagaagactttgagttgcaggatgtgatttagggaggattttgaaagagtttgcagcactgcgtgaagctggctgggtcttcctgtgtactcctccttgccctcctcctatagcccctccatgcaaaggtaacctgtttttttaatgtttgtttctttttaaaatttttttatttttatagaaaaaacaaatgccagcatgtgtatgaagaccttaatttaaaaaaatatttttattggcctggcgcggtggttcacacctgtaatcccagcactttgagaggctgaggagggcggatcacctgaggctgggagttcaagaccagcctgaccaacatggagaaaccctgtctctactaaaaatacaaaaattagccaggcatggtggcacatacctgtaatcccagctactcgggaggctgaggcaggagaatcgcttgaagctgggaggtggaggttgcggtaagccgagattgcagcattacactccatatattatggagtatatatatatggagtatatatatatatggagtatatatatatatatatggagtatatatatatatatggagtatatatatatatggagtatatatatatatatggagtatatatatatggagtatatatatatatatgagtatatatatatggagtatatatatatatggagtatatatatnnnnnnnnnnnnnnnnnnnntatatgggagtatatatatatatatggagtgtatatatatatatggagtatatatttatatggagtatatatatatggagtatatatatattttatatattatgtattatataatatatattatattatatataaaatatatattttataatatattattaatgaaatttctcacatatacaagactgtatgaacaagtttaatcaaaatacattgggttttgacaaatcttagtattttgctataattgcttttaaaaaatacagatagtttaaacttcctagttatcacttcctgatccagttatcatctcactacagaggtaaccactatactgaatttggtccctaactttctttttttttttgagatggagtcttgctctgttgcccagactggagtgcagtggcatgatcttggctcactgcaacctccgcctccgggttcaagcagttcttctgtctcagactcctgagtagctgggattgctttcatgtcttttttttttttttttttttttttgagacagagccttactctgtcacccaggctggagtgctgtggtgcaatgttggctcacggcaacctccgcctcccagaatcaaacgattctcctgcctcagcctcctgagtacctgggattacaggcatgtgccaccacacccagctaatttttgtatttttagtagagatggggtttcaccatgttagccaggctggtcttgtactcctgccctcatcggcctccgaacgtgctgggattacaggcgtgagccactgcgaccggcctcatgtctatttttatactttcattttctgtatatgtttacaaacaacatgtaacattgtttttacttaatttaaatggctcatactctacatatccttctgctacacgctttttacactgaatatcctttcaaggatttataaatgcagcccaaatttactgactttcattgctgggtcatattttattgtgagtttacccaaactgtgtaattgttcttctgattcactcttctctatttttgctattaccaacaagatggcagtgattttttttttttttttttttttttttttgagacagggacttgctctgttgcccaggctggagtgcagtggtgtgatctgaagtcactgcaaccttcgcctcccaggttcaagtgattctcgtgcctcagcctcccaagtagctgggactacgggtgcatggcaccacatccggctaatttttgtatttttagaagagatgggttttcactatgttggccaggctggttttgaactcctgacctcaattgatccacctgccttggcctcccaaagtgctgggattacaggcgtgaaccactgtgcccagctgaaaattcttatgttcccttggctgcatgaatttctttggagtcccttcatttaaaaatgtattttaaggaagtgaattggtccagcgtggtggctcacacctgtaattcgagcactttgggaggctgaggtaggaggagcttgagcccaggagttcaagatcagcctgggcaacataatgagactctgtctctacaaaaaaataaaaaattaactggatatggtggcatacctctagtcccagctactggggaggccaaggtgggaggattgcttgagtctgggagatggaggctacaatgagtggtgattgcactgctgcactccagcctgggtgacaggacgagaccttgtctcaaaaagaaaaaaaagtgaatcatagagtaaagacagacatattaattgaataaacacagaagatctatgtttaactccagctttgtgcatggtgttacagggaagtgtgtagaagctccaaagccttcagatataatgcttaactcagaaacttatagcccagtgtgtctgtgggacgtgggcacaaataaccatggtactacgaggcatgatgagataagcgctgtatgctggtggaggtagctctgatattagatggaactatgagggtctggaccattctccaccaaatcaggataggcttatctttgttagcaccttgagttgatttaattccagccaaaagcagaggtgtgatgccctaggcacttctctctgtctcttctcttaattttaaaaccagtaggcagactccattagctctttcctatcctttaggatggatgctcactcagatgttccaagtcatcttccactgtcttttaactctgtccttccagggagatgcgtcaggtgtccggcttcctcagagagctggagttgttggtgctgatcaccagatactccagacggcactaattcctatactatgggttcagagggaactccattggacagaaatttccttttgaggaaatctttccctggagtttcttcttacctttttccctcactttctccacagcagaaacaggtctgtttgtccttaaatatttacctatatatttgagtaggagcattttgaagagatgaagtttctgtgtagcagcacaaaacatgaaatagttcaaaccaggggcactctggttctcagaccgggagcttcaggatcttctgggaacttgttagaaatgcaaattctcaggtctgctcagatcacctgaaacagaagccctaggggtggggcctagagatttgtgtcttaacaggcccacagcgggagtctgggaacccctgtttcgaagtatgcttaaataagcacttgggggccaggcatggtggctcatgcctgtaatcacagcactttgggaggccaagacaggcagatcccttgagctcaggaatttgagaccagcctgggcaacatgacgaaaccccatctctacaaaaaaatacaaaaattagccaggcatggtggcttgcgcctgtaatcccagctactcaggaggctgaggtgggaggatcacctgagcctaggaggtggaggttgcagtgagctgagattgtgccgctgcattccagcctgggcaacagagggagaccctgtctcgagagaaaaaaaaaagcacttgggcttgtattgtgggcctgtcttactatactttcagaaaagggtctggcagactaaatacttgagggatgttacccagcagtgttatttgttgacattgcttaattatgaatgacatgagaaaggtatacctgaaaactgacattgtgtggtgttgttgtagacaaacctttaacttgtggaggctgctttcattttgtttgtggttgtgaccaaccgtaggaaacagaatgccataaatccctgtttccagggttaccttcttgctgctgataacaggcaggaaattaaaacaatatgtgatagtgttctgttcttattacctacagatggtagcttttagatatgttggagcaaaacataagtaaatatagcagggaaactttattactgaagaaaaatgatttggctaggtcaaggttatagtctggttcattttaataaaatggggcataggcaacatatcagtgttccattatcacatgaagcatttagctgtatgaggatcactagattttttttctctttgatttaattttgagtatgtaaaacatttacatgattccaaggtcaaaactgtgtaacaaattatattcaaagatgcttccctttcatccatatcccttctgtctcttctcttactgctttgcaggtaatcatttttactagcttctgaatttatccttccagtgtttctttttgcagataagcatatacattcatatgtatatgtcatatgttcatagctcctccttccactttcattacacaaaaggctacatactatactacaattttaaaaattattattattattatgatttttagagacagggacttgttctgtcacccaggctggaatgcagtggtgtaatcatagctcactgcagcctcaaactcctatcctgggttcaagggatcctcctgcttcagccgcctgaatagctaggactataggcacatatcaccatgcagtactttataattttttttttattattatactttaagttttagggtacatgtgcacaatgtgcaggtttgttacatatgtatacatgtgccatgttggtgtgctgcacccattaactcgtcatttaacattaggtatatctcctaatgctatccctcccctctccccgcaccccacaacaggccccggtgtgtgatgttccccttcctgtgtccaagtgttctcattgttcaattcccacctatgagtgagaacatgcggtgctttttgtccttgcaatagtttgctgagaatgatggcttccagcttcatccatgtctctacaaaggacatgaactcatcattttttatggctgcatagtattctgtggtgtatatgtgccacattttcttaatccaatctatcattgttggacatttgggttgcttccaagtctttgctattgtgaatagtgccacggtaaacatacgtgtgcatgtgtctttatagtagcatgttttataatcctttgggtatatacccaataatgggatggctgggtcaaatggtatttctagttctagatccctgaggaatcgccacactgacttccacaatggttgaactagtttacagtcccactaacagtgtaaaagtgttcctgtttctccacattctctccagcacctgttgtttcttgactttttaatgatcgccattctaactggtgtaagatggtatctcattgtggttttgatttgcatttctctgatggccagtgatgatgagcattttttcatgtgtcttttggctgcataaaggtcttcttttgagaagtgtctgttcatatccttgagaagtgtctgttcatatccttcacccactttttgatggggttgtttgtttttttcttgtaaatttgtttgagttcattgtagattctggatattagccctttgtcagatgagtagattgcaaaaattttctcccattctgtaggttgcctgttcaccctgatggtagtttcctttgctgtgcagaagctctttagtttaattagatcccttttgtcaattttggcttttgttgccatcacttttggtgttttagacatgaagtccttgcccatgcctatgtcctgaatggtattgcctaggttttcttctagggtttttatggttttaggtctaacgtttaagtgtttaatccatcttgaattaatttttgtataaggtgtaaggaagggatccagtttcagctttctacatatggctggccagcttttccagcaccatttattaaacagggattcctttccccatttcttgtttttgtcaggtttgtcaaagatcggatggttgtagatatgcggcattacttctgagggctgtgttctgttccattggtctatatctctgttttggtaccagtaccatgctgttttggttactgtagccttgtagtatagtttgaagtcaggtagcgtgatgcctccagctttgttcttttggcttaggattgacttggcaatgcggtctcttttttggttccatatgaactttaaagcagttttttccaattctgtgaagaaagtcattggtagcttgatggggatggcattgaatctatggccattttcgcgatattgattcttcccacccatgagcatggaatgttcttccatttgtttgtatcctcttttattttatggagcagtggtttgtagttctccttgaagaggtcctttatgtcccttgtaagttggattcctaggtattttattctctttgaagcaattgtgaatgggagttcactcatgatttggctctgtttgtctgttattggtgtatagaaatgctcgtgatttttgcacattgattttgtatcctgagactttgctgaagttgcttatcagcttaaggagattttgagctgagacaatggggttttctagatatacaatcatgtcatctgcaaacagggaccatttgacttcctcttttcctaattgaataccctttatttctttctcctgcctgattgccctggccagaacttccagcactatgttgaataggagtggtgagagagcacatccctgtcttgtgccagttttcaaagggaatgcttccagtttttgcccattcagtatgacattggctgtgggtttgtcatagatagctcttattattttgagatatgtcccatcaatacctaatttattgagagtttttagcatgaagcgttgttgaattttgtcacaggacttttctgtaactattgagataatcatgtggtttttgtcattgattctgtttatatgctggattacatttattgatttgcatatgttgaaccagccttgcatcccagggatgaagcccacttgatctggtggacaagctttttgatgtgctgctggattcggttagccagcatttttttgagggttttgcatggatgttcatcagggatattggtctaaaattctctttttttgttgtgtctctgccagactttggtatcaggatgatgctggcctcataaaatgagttagggaggattccctctttttctattgattggaatagtttcagaaggaatggtaccagctcctccttatatgtctggtagaattcggctgtgaatccatctggtcctggatttttttggttggtaggctattaattattgcctcaatttcagagcctgttattggtctattcagagattgaacttcttcctcgtttagtcttgggagggtgtgtgtgtccaggaatttatccatgtcttctagattttctagtttatttgcatagaggtgtttatagtattctctgatggtagtttgtatttctgtgggatcagtggtgatatcccctttatcattttttattgcatctatttgattcttctctcttttcttctttattagtcttgctagcggtctatcaattttattgatcttttcaaaaaaccagctcctggattcattgattttttgaaggcttttttgtgtctctatctccttcagttctgctctgatcttagttatttcttgccttctgctagcttttgaatatgtttgctcttgcttctctagttcttttaattgtgatgttagggtgtcaattttagatctttcctgctttctcttgtgggcatttagtgctataaatttccctctacacactgctttaaatgtgtcccagagagtctggtatgttgtgtctttgttctcattagtttcaaagaacatctttatgtctaccttcatttcgttatgtacccagtagtcattcaggagcaggttgctcagttttcatgtagttgagcagttttgagtgaatttattaatcctgagttctagtttgattgcactgtggtctgagagacagtttgttataatttctgttcttttacatttgctgaggagtgttttacttccgtcaattttggaataagtgtgatgtggtgctgagaagaatgtatattctgttgatttggggtggagagttctgtagatgtctgttaggtctgcttggtgcagagctaagttcaattcctggatatccttgttaactttctgtctctttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgaattgatccctttaccattatgtaatggccttctttgtctcttttgatctttgttggtttaaagtctgttttatcagagactaggattgcaacccctgccttttgttgttttccatttgcttggtagatcttcctccatccctttattttgagcctatgtgtgtctctgcacgtgagatgggtttcctgaatacagcacactgatgggtcttgactttttatccaatttgccattctgtgtcttttaattggagcatttagcccatttacatttaaggttaatattgttatgtgtgaatttgatcctgtcattatgatgttagctggttattttgctcgttagttgatgcagttttttcctagcctcaatggtctttacaatttggcatgttttttcagtggctggtaccggttgttcctttccatgtttagtgcttctttcaggagctcttgtagggcaggcgtggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatcagctgttagtccgatgggcttccctttgtgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggatgatatcctgcagagtgttttccaacttggttccattctccctgtcactttcaggtacaccaatcagatatagatttggtcctttcacatagtcccatatttcttggaggctttgttcatttctttttattcttttttctctaaacttctcttcttgcttcatttcattcatttgatcttccatcactgataccctttcttccagttgatcgaatcagctactgaggcttgtgcattcatcacgtagttctcgtgccatggttttcagctccatcaggtcctttaaggacttctctgcattggttattctagttagccattcgtctaatttttttaaaggtttttaacttctttgccatgggttcgaaattcctcctttagcttggagtagtttgttcgtctgaagcctttttctctcaattcgtcaaagtcattctccgtctggctttgttccgttgctggtgaggagctgcgttcctttggaggaggagatgcactctgatgtttagagtttccagtttttctgctctgttttttccctgtctttgtggttttatctacctttggtctttgatgatggtgatgtacagatgggattttggtgtggatgtcttttttgtttgttagttttccttctaacagtcaggaccctcagctgccggtctgttggagtttgctggaggtccactccagaccctgtttgcctgggtattagcagcggaggctgcagaacagtggatattggtgaacagcaaatgttgctgcctgatcgttcctctggaagttttgtctcagaggagtacccggctgtgtgaggtgtcagtctgcccctccttgggggtgcctcccagttaggctactcgggggtcagggacccactttaggaggcagtctgtccattctcagatctcaggctgcatgctgggagaaccactgctgtcttccaagctgtcagacagggacttttaagtctgcagaagtttctgctgccttttgttcggctatgccgtgcccccagaggtggagtctacggaggcaggcagggctccttgagctgcggtgggctccacccagttcaagcttcccagccgctttgtttacctactcaagcctcggcaatggcgggtgcccctcccccagcctcgctgccgccttgcagtttgatctcagactgctgtgctagcaatgagcgaggatctgtgggagtaggaccctccgagccaagcgcaggatattatctcctggtgtgccgtttgctaagatcgttggaaaagtgcagtattagggtgggagtgacctgattttccaggtgccatctgtcaccgctttctttgactaggaaagggaattccctgaccccttgtgcttcccgggtgaggtgacgcctcgccctgctttggctcactgggtgcgctgcaccccctgtcctgcacccactgtccgacactccccagtgagatgaacccgatacctcagttagaaatgcagaaatcacccgtcttatgcgttgctcacactgggagctgtagactggagctgtccctattcggccatcttggctccacccccaccctttttttttttttttttttttttttggtaaaaacagagtctggctaggttgggcagtctggtcttgaactcttggcctctagcaatgttctcaccttcgcctcccaaagtgctagaattacagatgtgagccaccgcacccagcctaaaaattatgtttgaagttagctttattaaggtgtcacttatcttatgtaaaatttacctactttacatgtacaatgtgaattttaacaaacgtatgcagttatatagccacccatacagtgaagataggaactatttccatcacccaaaaaagtttctttctttccttttgcagtgaagttctctctcctacctctctggccctggtaaaccacctgtctgccttctatcactatagttttgccttttctagaacataggtagtctcttctgtgtatggatgtcttctttcacattgtagtgtactttggagactcaaaccatgttattacatgtatcagtaattcattccatcttcttgctgagtgtactccattgtttatatgttccagttgagggacattgtccttttgctttttagaaaactttttattgggccaggcacggtggctcacgcctgtaatcccagcactttgggaggctgaggcaggtgggtcacctgaggtcgggagttccagaccagtctgaccaacatggagaaacccgatccctactaaaaatacaaaattagctgggcgtggtggtatgtgtctataatcccagctactcaggaggctgaggcaggagaattacttgaacctgggaggcagaggttgcagtgagctgagattgtgccattgcactccagcctgggcaacaagggcaaaacttcgtttcaaaaagaaagtttttattttgaaacaattttagactgacttacagaataattataaagatagtagagagagttttcatataccctttccccagtttctcctgatgtttaacatctcacatggccatggtacaattatcaacatttaagaaattaatactggctgggcatggtggctcacgcctgtaatctcagcactttggggggccaaggctggcagatcacgaggtcaggagttcgagaccagcctggccaacatagtgaaaccccgtctctactaaaaatacaaaaaaattagctgagtttggtggcacgtgcctgtagtcccagctactcgggaggctgaggcaggagaatcgcttgaacccgggaggcgaaggttgcagtgagccgagaccacgccattgcactccagcctgggtgacagagtgagacttcatctcaaaaaagaaattaatattggagccaggtggtggtgcatgcctgtagtcccagctacttgggagaccaaggtgggaggatggcttgagccgtggagtttaagactagcttgagcaatatatcaagatcccatctctaaaataataataataataataaggccaggtacggtggctcacgcccataatcccagcactttgggaggctgaggcgggtggatcacgaggtcaggagatcgagaccatcctggctggcatggtgaaaccccatctctactaaaaatacaaaaaattagctggggtggtggcagacgcctgtagtcccagctacttaggaggctgaggcaggagaatggtgtgaacctgggaggcagagcttgcagtgagccgagatcatgccactgcactccagcctgggcgacagagcaagactctgtctcaaaaaaagaaaaaataataaaaatatactttattttaaaaagtaatattggtacaatactattatttaaactacagactttattcagattttcattgtcatttctctagtctcctacaatctgacaattccttagtctttctgtgtctttcatgactttgatgccttaatttttttttttaatttttaaacacttaaaaaatagagacaggatcttgccctgtcactctatttggagtggagtggtgcaatcatagctcattgtagcattgaactgctgggcttaagtgatcctcctgccttagcctcctgaatagctatgactataggagtgtgctgccgtgcctggctaatttttttcttattttttgtggagatgggatattgcagtgttacctaggctggtctcagaatgctgggctcaagtgatcctcccaccttgccctaccaaagtgctgggattacaggtgtgagccactgtgcctggcctgatgctttctaagagtacttgtttagatattttgtgtccctagatttgtctgatgattaggctgcagttatggatttttgggaagaataccgcagaggtgatgtgcccttctcatggtgtcctatcaggagctacctgatgtcagtatgtcctgttactggcaaagttaaccttaatcatttggttaaggtagcctctgccaggtttctccaccaagttactatttttccttttctgtactctgttaaggcaaattattgctttttaaattttgatgtacctcaatatgcatgggagatacatagctttgcagctccctcaatcttaattgtaataataatagtaataacaataactagcacttgctccgcctgcatagttctaaacacatgtgcccatttaatcctcatgacaccctgtgaagcaggcactttatgctcattttatagccgagaagactgaggtacagagtaccttgcccaaggcctaataactagtaagtgatggagccagatctttttttttttttttttttttttttgagacggagtcttgttctctcttgcccaggctagagtacagtgacatgatctcggctcactgcagcctccacatcccgggttcaagcaattctcctgtctcagccccccgagtagctgggactacaggcatgcaccaccacgcctggcttatttttgtattttcagtagagacagggtttgaccatgttggccaggctggtctcaaacacctgacctcaggtgatccacctacctctgcctcccagagtgctgggattacaggcatgagccactgcacccagcctggagccagctcttcacttcgcctgagttgaagggctgactttaacatgggccatatggttgtcgtcagagcttaggatggggacgctctcattctttgccagagaaaacaaatgcttcctatatttaatgcttctctcttgttttttctttaagacatttttttggtttgtttttccttccaggaatatatcttgtgtgactaaagattttagtaagctatatgtggcaatcataccatattaaaatcttggggagaaatccaagaaacttttggaaacattaaggatctatttttggtcttcttttcagaaataagactgaaggtagggcagaatattcagcatagaaaagtgctgtggtagaagaaatactcagtgagtgacactgcgcctttttctcctgggatgttatcagccacttctaccaggggtgtctctgtttgtctgtatgtgtctaaccctgccatgttcgcctttcttgaccacactaatgacttttctatgacacagtcaaatgtatctctgaatagcctgacttggggtaataactgtggtttacgtgatgacttggtctctgtgagccccctattctagtagcagtggagccactgaaggtcaggcagtgtgggtggacatttgtccatcttcctgtgactcactcagccgcctgcctttctgaggggaaagagctgcaggtgcaaagctctaatacatcccttcccttctctgtctaattctattatgtatattgcatatcccccaaatccttgaaattactcagctacgtgtcttattatatctagtctgccaagctgtctaggtatcagtacagtttttttctatgtctatatttattttccgaaaatgaaatcctactgtatttctttgtagcttcttttctcatttgacaatatagctgaagaagtttccatgtcatatggcatttatctacaatgttgtttgggtacctgcctattatcaatagcttggctatattatgattggtggggaatgtggcttgtttccctctatccctcttcagcatccaggacaggatgttcttgcagtcaccgaatgttaggaagctcagagtgctctcaggcatcatctgattaatcttttcttttgcacatagcatagttgaggataagtcagtgcaatttttaaaaataaagctttttttttttttaatgtctattgtatgtctggctggaagtgccagggtccacagcttaaacaagacactgcttatcttccaaagccttcccagagaggcatatacacacaaactgtaggatttatttccttaggaaggcaactgtttagaataagtctgatgctagcctacaatatatagaacactttacaaatgtagaaaattacttggggaattgataatagaggtcaggtttacaggtgtctggatctggcctcagaagtcagagggctaaggattagtctttttctcagatatggttttctacatattgattatagacaaaatataaagtagaagaaaatgtaaggaagaaagtgaaagtggcccatttctactgccagaaatagccactgttttattttggtataatttttcctttcctccctccgttctccttcctcttccatactgcaaatatgttcataatcctgcatttttcatgtaacactgtatcaaggatttttaaatgttacttacagaaaaggactttgctactttgataaggaaaaatatctagttttaatttgtattcccttaatattttagggaggattaacgttcgtttatgttgactgtctattcatgtttatccataattctacctttctataaaattggacatgttactaaagcaagcctctgatttcagatgtcctaaacgatgctatatttgatgaagatcatgatgagatggtgattgtgaaggacatagacatgttttccatgtgtgagcatcacttggttccatttgttggaaaggtaaggttctctttgttgtttcccagcaatttaaaacatagtgaaagtttttcaattagaataattatatttaaaatttttagctgccaattgctgatatctcaggtatttacaattatacatatatggttattctttattaacctgactaataacttgaaacttaaaaaacaaaaccaaagtagcagaaggctctcaggataagcctttcatgttaaataccaggttcataggttaaaataatgaggtttaagtagcatctctctctctcttttttttttttgtagctactacaggctctgaaaacctttaacctttatttatttattattagcatcccaatctagagatgccctttattttaacttgaataatgtttgatccaagatagatatgtatgtatggcatgtcatgagcaacaataattgcagaatttcttgtgacagaggttatggtatttgtggatttgtttccattcctttctatattaggaaaagtgaatctaatgcattagattcctcagcacctctgtgaatttcttttgtcagaaatgtttagtcctagtcttatgaaactttagatctaatctagtttacaggaaatccagaggctgaatggaacaaatccagaaggtggggcactctgctgaacagctggcctattctcttttcaatagagaatattatgggtgggagcactattttaggacaaaagggacttaagaggtataaccaaatgcagtgtaaatacaaatgtgtgactctccattggattcctgtttaaacaaaccaaaagtaaaacatttgagacaattggaggaatttaaatctgagttagttattagatgttgtctaggaatgactacttaacatacctttgagaacatgtggtatagaacaaagagttgtcccatttccctacccccatcataattttatttaattttgactctttattaataatctttaaacagaagacttacaagaagcagtgttatgaatacttatatacccatcaactaaagttaaagtgttaacatttgcttcatttttgtctttgttaaagtattgtatcttttcacttttttatggaaataatatatagatagaaaatgcataaaacttaagggtgttccttaccacttcagagatcaagaactagaataggctggcacggtggttcatgcctgtaatcccagcactttggaaggctgaggtaggtggattgcttgaacccaggagttcaagaccagcctgggcaacatggtgagaccccatctctaccaagataaaaataaaaattacctgggcatggtggtgcatgcctgtactgccagctactcgggaggctgagatgggaggatggcttgagtccaagaggcaggggttgcagtgagccgagattgcgccactatatcctagcctgggcaacagagccagactgccagaccctgtcaaacaaacaaacaaacaaacaacaacgaaacccccacaactacaatatgtgtagcatcctggaagctcacctcatttcttttctcttcttaatccctaatccatcctttgtatcagtttatcaacttataaccctatggattcgttttcttgtttttcaactatatgtaagtggaaagattctacgatatgtactctttgtgtctggcctctcttgttctacatagtcggattcattgatgtcattgcctgtcattgtagtttattttcattgttatatcttattccattgtacaaatataccacaatttatctattctgctcttggtggacctttgtattgttgcctcttttttttttttttttttttttgctattacaaacaatactgctgtcaatacttttttggagtacatgtgcatgcttttttttttttttttttttttttttgagacggagtctcgctctgtcgcccaggctagattgcagtggtgtgatctcggctcactgcaagctccacctcccgggttcacgccattctctcacctcagcctcctgagtagctgggactacaggcgcctgccaccatgctggctaattttgttgttgtatttttagtagagaaggggtttcacggtgttagccaggatggtcttgatctcctgacctcgtgatccgcccgccttggcctcccaaagtgctgggattacaggcgtgagccaccgcacctggccctaaaatattttcttacttatccacagcagcactatcacaaaattaacaataattcttaaatagtgtctaataacgaattcatatttaaatttctccaattgtctcaaatgtttactcttggtttgtttaaacaggaatccaagggagagtcacacatttgtatttacattgcatttggttatacctgttaagtcccttttgttctaaaatagtgctcccacccataacattctctactgaaaagaaaataggccagctgttcagcagagtgccccaccttccagatttgtttccttcagcctctggatttcctataaactagattagatctaaagtttcataagactagggctaaacatttctgataaaagtagttcgtaagggctgggcacggtggcttacgtcagtaatctcaacactttgggaggccaaggcaggtggtggatgtatcgctttgagctcaggagtttgagaccaacctaggcaacatggtaaaaccctgtctctaccaaaaaaaaaaaaaccaaccaaaaaaaaaaaaaacgaaaaccaatcaaccaaacagacaaacaaaaaaacaggcaaaaattagctagcatggtggcatgcacctgtggtctcagctactcgggagggtgaggttggagaatcgcttgaacccaggaggtcgaggctgcagtgagccgagatcacaccactgcactccagcctggcaagagagtgaatccgtgtccaaaaaaaaaaaaaaaaaaaaaaagagtagtgcttcataagggtgctgaagacttcatattatatcacatcagggccgagtgaggtggctcatgcctgtaatcccagcgacttgggaagtcaaggtgggaggatagcttcaggtcaatagttcaagaccagcaagtgagactgtctctaccacaaaataaatttttttttaaaattaattgggcatggtgggtgcatacctgtagtcctagctactttttgggagtctgaggcaggaagattgcttgagctcaggagtttcaggttacagtgaactatgatcatgccactgtaccccaacctgggtgacagaacaagaccttgtctctaaaaagaaaagaagagaaagcaatcagaaaacccagatacatcacatcagaagccatatcgtatctggaaatcctgcaattgataatgaaggaatctttgaaagggaatctattggtgagcaaattaggcacagaaagcctgtgacttgttcaagaggatagagagagttagtggcttggctgcagccagatccaaggcactgattctgtactcagcctgtcaccattttatcctgttactttctgctattacttcctcagtgtttgtgtttttgctacctttgttttaaaaatatattatttagtgattttttttttttttttgagacagtttcgctcttgttgcctaggctggagtgcagtggtgcgatctcggctcactgcaacctccgcctcccaggttcaagcaattcttctgcttcagcctctcgaatagctgggattacaggcacccgccaccacgcctggctaatttttgtatttttagtagagatggggtctcaccatgttggccaggctggtcttgaactcctgacctcaggcaatccacccaaaatgttggaattacaggtgtgagccaccactcctggcctatctagtgattttgtgaaatggacatttaaattacctaggatcttaagaccaaaaatagtataaacaatgaacaaattccgtgtctgcatggaaatgtaaaaatttcagacagcatagaagaccttggttcatgggaaagttttaactctctaatttttctttgaaatcctcaatgttcaggtgctattttactttttcctcctgccaaccaggaaggcaatgaggtggacttctcaaattcctaaagcatagtgccaatggatgggggaaaaaatcactaagtactactagatcaattatgtaaatagtaagtgaacaatgaaaacagtgttagcaaaccatgatgccgttgagtctctaattttatattcggttaattaattgcctacaagtgaccatttactctattaatcttttcagagaactaatgtttttcgtatgtagtatttggccccaaaagagtaacttttatatttgatattaattggtgccatttaagataacagaaatggcctggctgtatattgggtcctttaaaacttagttcttagggtgcaggttcttgccaagccatggtggtagcagtgccctttttctccagttaggaagatggggccgggcgtggtggctcacgcctgtaatcccaactctttgggaggccgaggcgggcagatcacaaggtcaggagatcgaaaccatcctggctaacacggtgaaacaccatctctactaaaaatacaaaaattagctgggtgtggtggcaggcgcctgtagtcccggctactcaggaggctaaggcaggggaattgcttgaaccttggaggcggagcttgcagtgagccaagattgggccactgtactccagcctgggcgacagagtgagactccatctcaaaaaaaaaaaaaaaaaaaaggaagatggtgcactctctagcagcttagaaaccaggaagccaagcacaaaagggtgtggagaccttctgtgctgcagggctttgcggtgggatcttaaggctgtgaggtgggatcttaaggctgctgtgatgtgtggaatggcaatacttatgcttacagtttttgccatttaaaggaggctttcctgtatacattttagtgttgctatgagatcatttgcctttccttgagaatgtttctcctccataaagaagaaactttcagatttgtgtcaagagttcaacttcacaggtaagtgtcagggccatgcaattgactcttgaacaacatgaatttgaactgcatgggtccacttagacatggctctttttcaagcaaacactgatcaaaaattctacagtatttgcaggatacaaaacctgtatagatggaggggcaacttttcatatatgcaggttctgcagggccgactgcgggacttgagtatgcaggatttgggtatacacaggggtcctggaagcaatctcccgcatttaccaacggacaactgtacaagtttgttatttgattaatagactcatacttatatattttgcttttactgcatttatgtaattttaaaaatacatatataaatgtttcattttctaagtcttaacagttccagatgttttcaaggtaatacattgtcgtgataaattacataaaagtgtactatattctttctatatttccttattttgtcacaaagaaggcactgtattttcactcagctaatgatttccgtctcttctctgaaggtccatattggttatcttcctaacaagcaagtccttggcctcagcaaacttgcgaggtaagtgtgactgtgcagtgaacaagaatacaggtttataggacctgccctcatctgctgagaatctatctcatcaggctttctctctttacctgtatggatctaacttggaagtcatattgcaacttaaagacttggagggtctgaaacacagatgccccttccttctcgtcccctactgcctgcttcctcttccacttcccaccctttcttccatagatacatacatcctggaagtctcagcccacctctttctctgcagagccttctctgactggagaggtcctgagcttaccttcagtccagccccatcctttaaggggggtttagctaacagtgaggggttggggaagaagctgggcaggggtctagctgcagtgctctgctgtcgaacttgttgtcaggcctgaggactcttctatccttgtcaaggggagtgctcaccttctttgctttcatacaacactgctttcagacttgtaatgaaacttccctgtgggatccccagcctcaaccctgccttgctctgcactggatgcctccaggcatatctcaggggtcctgcaggccagtccgttcatgtctaggttctttgtttctgcaaacacaagactgcctgccttggctttgcacagctttattctgatacagtgttcacgctcctcgctctcatttctctttcctgctacaatcttcttttctgttgtttatcctgtgggttcatgccttaaaaaattcccttactgccttttttatttgggttttaggagaggtgatgtacatacacgttcatctgtgtttaactggaagtcaacatgggggtttgtgttcagatatctctggtaggccccagccaccaatattttattgcccttaaatatccttgttgtttcttcgtataaagttagtgaattttgagtgatggaggaaatactgggaggtgtgtgtgtgtgtggagagagagagaaagttaagaacaagatgaaggggtcgggtaaagtgttcctactctttttttttttcaaaaataatcaagctaagtttgaataacttgaggttatagtgaccatatcataattgaaataaatgagtctcggccgggtgccgtctttcacacttgtaatcccagcactttgggaggctgaggcgggcggatcacttgaggtcaggagtttgagaccagcctcaccaacatggtgaaaccccatctctactaaaaatacaaagattagctgggcgtggtggcgcacacctgtaatcccagctaatcaggaggctgaggcaggagaattacttgaacccgggaggcagagcttgcagtgagccgagattgtgccattgcactccagcctgggcgatggagtaagaccctatctcaaaaaaataaaaataaaagaagaggaataaatgagtctctgtgaccagttgactgtgctgtggctctgatgtgttcctgtttctttatgcaggccctgggatttaacacagttgtgaaatggtggtcctgatatttctcaattctgtgttggaatctgtaaaaaaaaaactactccagcaatctgacaactgccctctaaagttgttcctgttactttgttttcacttccactttctcattcatttcctctggggatcaataagaaagtgggtagaagagacaaatttaacttccccagtttctgacctcattcctgctcagctattttgctattagatagggctgcttggcaccatgaaagaatattatatcatagctgtaattgcttcactggaataaggctcttagcacaaatccagaaacattctggctgcttgcgtgtgatccatccctggtggcagtgctgaaaagttgctgagaaaaagtgtgttggtagtgattgggagtaattaatcttactataatttttattaacgactcccttcccagtaacttaccctcaactaatgatgtattaaaccaatttcatgtcaactgtgagtaaaagtatctttactaaaattggttattcttatggttttataatatacagtctaagtaaaatcagcatgcttactgtgcaaacatagctgtaggcccagtcccctgggcctccctgtcagcaagattgctaaccctataccttgcccatatagaaattccagcactgctgatgcctataacagactgtccatatgtgaaaggtgtaatggatagtttcatagtgtaaaaaagcttggcagatcacattaggccttggtcttaatgtaacagccttctctgaaaaaccaactgttgatcatgattaacactttatgggaaatggactcttgagtgattcagtgagatcatacaataaatggcaacctggtggtagaaggaaataatcttagttatttcctttccaagtgaaaggaaaagatctcaaataattaagcttttatgaaacaatacaaaggagttgattattagcatggggatttgtccttagactaataggattaaaatttaagaataaaatggaacatgaagccaaagaaccaagtgtatgttgctttcaaatattttgcaaaaaatttgaataaagagtctattaaatagaaaagaagactaagattttatccaactacttattccttataagaagtaagaatatttagagaatgaagaggaataaaagctgaatgtcttagcaaaacttcactgctcattttaatcttatatatgaagtttgttatatgcttgcctttaaatgaatgacctttcagtgccagtgaagtcaaatatcaagcagtaaagccttaagtaacaagaaaatgccagaagtgagttgatctggctcaactctagtagaattctagaataaacttagtttgaatagaactttcttttgttgctgaaaagccattgaacatgtattcattttcttcccttagaaataactgagcctcggctgggtgaggtggctcatgcctgtaatctcagcactttgggaggccgaggtgggcagatcacttgaggtcaggagttccagaccagcctggccaacatggtgaaaccccatctctactaaaaataccaaaattagcagggcatggtagcatgcgcctgtaatcccagctacttcggaggctgagatggaagaatcgcttgaacctgggaggcggaggttgcagtgagccgagatttcaccactgcactccagtctcgtgacagagcaagactctgtgtcactaaaaataaataaataaataaataattgagtgaatgtacgaaatcttgaatttagagttgtagtatctcaggtagccatggctgacctgttgggtgggcactgtgccagctactgtggaggctaaagaagcaggacatggcagccaccctcaaggagagtgcacagggcaagactgcaagtgccatggaaatgcctgctgtagctccaagttcagaggagccatgatggctgtggcctggcaggtgaatagacctggaggtggagggatgagcagaattctaaatgggggagaagtttctctaggtatagttaatgcatgagcaaagaccagtcagagggtaggagcaaggcctattccagtggatgggaaccagattgactgatggaagtaagagtaagtgaggtgagtattagattacagagggagcagtatttttttttcttttttgactataaaagcaacataccatttaaatacaaatgagtgaataaagtgaaaacttttcttacctattttcattccccagagttagaactagagatttctttcactatccttctggaaaatatttatgcaagcacaaacataagatcatatcttatattctgtactacaacttgctttttaaaattttattttatttggtgtttttttgagatggagtcttgctttgtcggccaggctggagtgcagtggtgcgattttggctcactgcaacctctgcctcctgggttcaagtgattctcctgcctcagcctccccagtagctgggattactgatgtgcaccaccatgcctggctaatttttgtattttcagtaaagacagggtttctccatgttggccaagctggcctcgaactcctggcctcaagtgatcagcctgccttggcctcccaaatgctgggattacaggcatgagtcactgcacccggccagcttttttttttttttttttttttttgagacagggtctttctctgtcgcccaggctggagtgcagtggcactatctgggctcactgcagcctccacctcctgggttcaagcgattctcctgcctcagcctcctgagtagctgggattacaggcgtgtaccaccacgcatagctaatttttgtatttttagtagagatggggtttcaacatgttggcaagactggtcttgaactcctaacctcaggtgatctgctcaccccagcctcccaaagtgctgggattacgggagtgagccaccgcgcctggccctggccagctttttaaaaatttaaaataccttgaagttctttggacatcttttagtccaaaaagtccaagtttcttttcatagctacctaatatttctttgattaatacaattcatttaaccagtatttgctatagataagtacagtttgcagtttgagacttgccaaaaagtaaaaaagtaccctggtgaacaaattttattatctttgtgtgctttgaatctatctgaagtttaaattactagtatggaacttgatgggtaaagggtagccgaatttttgatattatgaaattgctctccaaagagaccatgccagtttatactctaataaatagatacataggtaaggggtggtgtatgtttctccacacttcggccaacacacttttcatcacacttttaaatctttgccaaactgataagtaaaaaatagtatctattttaatttgcatttccttaatagagcgaggttgaatctattcagacacttcctgttcttagctccagtattaatttttccactgagttatttgtctttttattcttggtttgcacaagctctgaatgttaaagcagtcaggtcaggtgctacagacaatgcttcccagctcgtcatttgtcttttgattttgctttatagtattatatttccataaagaagtttaaaacttttctgtagttcacaaacttcttttttttttggtacttgtatggccacattattatatttaaatctttgctccatctggagtgtattttggggtgaggagtgaggcagaacccatccactgctgcgtgtgctcactgcccggcaggtgcagcacccccacttcctgccttcctgccctccctgctgcaggtctttgctgggcctttcttatcttcctcctggagggaatgttaagctcctgcctcctccctgcctctcatctctgaggatccttcagtttgccctcatgagctgctgggatgttctttctaaagtgtggattggatcatgctgctcctttggtggctcaccacagcttttcagttaaagtccaaactccttatttagaataatttagaaaaagccaaagaacagaaatcacaaatctacaagttgaaaatcttgtatcataggttgctggggagtctgatatctaggaatgagacgatatgtaactaaaaatatgctttataaatctttacatcttgatgaatacgttttttaaaaagatggggagagaaaggaatggaccaagagtttgaaagcctgcatacattaataaccattagaaaaggtcaaattaatgatttgggggaaagtgcctggacccagtcagttttataagtgttctttcaagctttcaagtaaccacaaattttgcatgtgtataaataattcaagagcgtagagaaacctgtgaagtgtcaattaatttgatgaagctgcctattcttgataacaaagcctgataagcctagcattaaaaaaaaaaaatgataggcaaatctcactgattaatgtagttgtaagaatcttaaaatgtcaggctagtatagaagtactgttttcaacatgacccagggatgtttagtccaagaatgtaagaatggtttagattaaaactgacaactactgatgctgggtgtggtgaactagattaataatgcccctcttggcacagcgtatcaagatataatgcatatgtacattttacactttcgggaaagcatgaggcaattctagtgagaatccactggaattagcactaaagccacagtctggattctgtcctcccttttcccatcccaaatcaaggacgatacttacctattagcattattctaggaagagcaggaaaaagaaaaaggaactcatagacacattcataaagtttgggatcagaattagtactacctgtgtggccttcaaaaaatcaaatggaataatttagtttcaaacgaccccataaggccaggcatggtggatcatgcctataatctcagcactttgggaggccaaggcaggtgggtcacctgaggtcagcagtttgagaccagcctgaccagcatggtgaaaccccatctctactaaaaatacaaaaattagctgggcatggtggcacacgcctgtagtcccagctactcaggaggctgaggcaggagaattgcttgaacccgggaggtagaggttgcagtgagctgagatcgcaccattgcactccagcctgggcaagagcaaaaactctgtctcaaaaataaataaataaaaataaataaaacatccccatagaggtatccttgcaggcagctagcagaaactagtgcatgttctctgatgcacttttatccaggcttggaaggatacccaaagatgaagttccaaggagtaccatgagtcgagtcagacaaacacgatggaagagggcagatagtagaactatcagagataggatataaaacaagtacagtaagtcctcactttacgttgtcgatgggttcttggagactgcaacttgaagcgaaatgacttcaggcaaagtggcatataacagtcctggaataatgttgtttcattcaatgtcatttcagtatgattgagaaaaaaaaattccttgctgggacccactgtctgtgtggagtttgcatgttttctcccacatctgtgagtttcctccaggtgcttctgtttcctcccacatcccaaagatgcacacgttaggtgatttggcgtatctgatctgagtggtcccagtctgagtgagagtaggtggatgtgtgtgccctgtgatgggatagtgtcctgtccagggtcagttcctgccttgtaccctgaactgctgggaaaagctccagccacttgagaccttgaactggaataattggggaaatcaatatctttccattaatctttcttaaatgtatgtatcactcacatttattttagtgtttaatattagaagtgtttttgtgtttatttggaagtttgttgacgtttttgtgaccagaaatatgctatgggagcttaattcttattatatcaattagcctagggtaaaatttgttttgttctcagtgttttagtaaagtcatagattccgagaacctgtcgaccttgagcaaggacttactatatattaaaaaataggctgggtgcagtggctcacgcctgtaatctcagcactttgggaggccaaggcgggcagatcacctgaggtcagtagttcgagaccagcctggccaacatggtgaaacaccatctctactaaaaatacaaaaattactattgtgagtagtgctgcaataaacatatgtgtgcatgtgtctttatagcagcatgatttataatcctttggttatatacccagtaatgggatggctgggtcaaatggtatttctagttctagatccctgaggaatcgccacaccgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgaggagcattttttcgtgtgtctgttggctgcataaatgtcttcttttgagaagtgtctgttcatatccttcacccactttttgatggggttgtttgatattttcttgtaaatttgttaaagttgctttgtagattcctggatattagccctttgtcagatgggtagatcataaaaattttctcccattgctgtaggttgcctgttcactgtgatggtagtttcttttgctgtgcagaagctctttagtttaattagatcccatttgtcaattttggcttttgttgccattgcttttggtgttttagtcatgaagtccttgcccatgcctatgtcctgaatggtattgtctaggttttcttctagggtttttatggttttaggtctaacatttaagtgtttaatccatctggaattaatttttgtataaggtgtaaggaagggatccagtttcagctttctacatatggctaggcagttttcccagcaccatttatgttttccccatttcttgtttttgtcatgtttgtcaaagatcagatggctgtagatgtgtggtattatttctgagggctctgttctgttccattggtctatatctctgttttggtaccagcaccatgctgttttggttactgtagccttgtagtatagtttgaagtcaggtagcgtgatgcctccagcacatgcacacgtatgtttattgtggcactattcacaatagcaaagacttggaaccaacccaaatgtccatcagtgatagactggattaagaaaatgtggcacttatacaccatggaatactatgcagccataacaaaagatgagttcatgtcctttgtagggacatggatgaagctggaaaccatcattctgagcaaactatcgcaaggacagaaaaccaaaccctgcatgttctcactcataggtgacaattgaacaatgagaacacttggacacagggtaggaaacacacaccggggcctgtcgtggggagcagggagggatagcattaggagatatacctaatgtaaatgatgagttaacgagtgcagcacaccaacgtggcacttacatacatatgtaacaaacctgcacgttgtgcacatgtaccctagaacttaaagtataataataattaaaaaaaaaaacaaattagctggatgtggtggcgggtgccgctaatcccagctacttgggaggctgaggcaggagaaatgcttgaacctgggaggcagaggttgcagtgagctgagattgtgccattgcactccagcctgggtgacaagagggagactctgtctcgggggaaaaaaaaaaaaaaaaaaagaacctacttatatataaaaaaattgacaaaggagatcgggcgtggtggctcacacctttaatcccagcactttgggaggccaaggcaggcggatcatgaggtcaggagttcaagaccggcctggccaacatggtgaaaccctgtctctactaaaaatacaaaaattagctgggtgtggtggcaggcacctgtaatcgcagctacttgggaacctgaggtagagaattgcttgaatgcgggaggtggaggttccaatgagctaagattgtgctgctgcactccagcctgggcaacagagcaagactccgtgccaaaaaacaaacaaaaaaaaattgacaaagggataagaaacttgcagaattagccaggcagattgggaagaggaggaaatataacttttagaaattaaaaaaatgaaactgaagtccagtatactcattaaatagattagacatagattaaatacggtgattgggaagaaaggtctaaagaaattgtgctgaatgcagcgcaaagacaggtagaaaatatgaatgagaatttaagaaacatggaagactgggagggtataatatgcccttaattgaaattcctggagataacagaggcaatgtgctagatgcaacgttagagaagataatggctaaaaaagtttctagaacacatgcaaaatatcggtcttcagaaagcctaataaattccaaataagtcaaattaaatccctacttggattaaaacatagtaaattgcagtatatacttataaaatatagttaatataaaagcagccaaagaaagaaatatcgattatctaaaaggcaacagcagttacactgaattggtttgccaacagcaatactgaagggcaagatagatatcagtgtcaaactagaattcggttcccagcaaatacctctcaacaaattatctttccagaatgacagcaaaataaagatttttttttttaatctagggaagctacatgacatgctgaaaagatgtgttaggtttcatatttactcctcacttgtaaaagaaaactaataaactagggtttagaaataataagctctcagagcacagagagcatgttcaccatataatcacatacatagcaggcactcagtaaaaatctatgggaatgttcctcctgccatgagagcagctgtctgccagaagcaggcaggcactgtgggtggtagtgaaatcctagaggcattcctattgaagtgtggagcaaaacatggttgcccagtgttaccactattgtccaatgtggcacctgaagttctactccagaaaaagaatggtgaatacgagaaggaaaacattactaactttaaaatcaatggcatctcctacatatataacaaactaatcacctgaaaaactatcagaagtaatatatacagaaatttgacctagtaagaaatatgacatacctcctatctaggagcttaaaaaccattcctttctaaggttttgttcaaaataccaatagaatatagctattaatatatttcttcaatatcctagtaactactgctgggataaaggagagctaggatggcttctgccctcagggagctctgggctgagtggtaaacggggtggcggacctgttactgactttgttggctgtaatgggtataaaggagcaagttgttggttctgagacgtgtagttgggggaagagccaggaaatgcctcatagggaggtgaaccataaattgaatctgaattcatgatcaaaaggccatgaatttaaagaaaaggtcctcagtgtgaatagtcatcttcaaatggataagtcacgtggtcatctttatatttcataaatagaatgaaagatgttgaaaggggaaaattctggctgggcacaggggctcacgcctgtaatcctagcattttgggagactgtggtgggcagatcacgaggtcagaagttcgagaccagcctggccaacatggtgaaaccctgtctctactaaaaatacaaaaattagccgagcatggtgacgggtgcctatagtcccagctactcaggaagctgaggcaggagaatcgcttgaacccaggaggcagaggttgcagtgagctgagatcatgccattgcactccagcctggatggcaagaacaagactccatctcaaaaaaaaaaaaaaaaagaggaaaatttatcacttgacagattgtgctataagttaagatcaggaggcttttatttcttgggggttaatcttactaagtgcttacataaacctatcttatgaagaggtgtctgaagaagtctaatcagttccaatctgattctcctaataggtttagttggtatagtagttgaccgtggtgtgctattaattaacaaagtctttttatttttaacttgaattttaagctctgataaaacaatatgattaatcagagcacttgagacatgatctaaaattgatgatttggaactttaaaattttgttactcatctctgtttttcctaagtgaacgtcacagttggagactcattaattctctttctggggacatcaggaagcaccactctgcagtggttggtggtcttctgtattagtaagggttccctagagggacagaactaataggagatatatatatatatataaaggggagtttattaagtattgacttacatgatcgcagggtcccacaataggctgtctgcaagcttgaggagcaaggagagccagtctgagtctcaaaactgaagaacttggagttcgatgtttgagggcaggaagcagccagcattggagaaagatgtaggctgggagtcaaggccactcttgccttttcatatatttctgcctgctttgtattcgctggcagctgatgagattgtgcccacccagattaagtgtgggtctgcctttcccagcccactgactcaaatgttaatctcctttggcaacaccctcacaggcatacccaggaacaatactttgcatccttcaatccaatcaagttgactttagactacatctccctgtggtacttgtatctttctgtcatcttgccataagctttatttcctcttgcagcccacttgcttcaacaatgtcctttttgttttatgaggaaggcttatcaattttacttcaaatgatttgtgattaactaaaacaattctttcttttctaggattgtagaaatctatagtagaagactacaaggtaagctttaaaaatctgtattaacagaaaacatttttcttttttttctttttttaaatttttatttttgagacagagtcttgctctgtcacccaggctggagtgcagtggtgcaatctcggctcactgcagcctcagccttccaagtagctgagattataagagtgcatcaccatgccttggctaatttttgtatttctagtagagacggggtttcaccatattgatcaggctggtctcgaacttccgacctcaggtgatctgcccaccttggcctcccaaagtgctgggattacaggcatgagccactgtgcctggctacagaaaacatttttcctacacaaaaagtattttttgttttattactagtgcgataagtatgacttataaaaatgtaaaacctcttaggactataaaaagtctactgtttcaagcttccagaagaaatcactgttgtatttgcacattccttcacattttcatgcatatacctgcattttcaaatcaatttatttggattatgtttaaacaaaaatgggctcattttatacataatcagccttgcttttttccctgctttttttcatttaacaaatcttaaacatttttgccacatccatgtaactatctcattcattctggtggctgtctagaatcctaccgtatatgccatggcttggcgtaacctataccagctctgatagatactggggggtttcatcagttttcaaatagatgcagtgctgcaatgaatattcctgtatgaattaaaagacaagtcattttattcaggacaggaactatattatttaggttaaattgttggttttcaacattgctctaagcacaattcaataattggactgcagcccctttgttaaccctgttgcaggctatttatttgctgcactactttacctccatggaggtgcttggtaaccagtactgtgttgttctaactgcacaggtatgagataattgctattctaattccttcccgcagtgatgctggagggcttcagggtgttctgagatctctttagccctgtacttcaggtgagggagttgaatccgggcctctctgtggcccagtcagcagacaaagcagtctggtaaaagctggtgtgtcttggctcttaaatctcacagaagtctgatttttaagatttcaaatgttctagagacagaaaaagcttccagctgtttgtgtcagactctcaaactgagctccttatcacatccacagttcaggagcgccttacaaaacaaattgctgtagcaatcacggaagccttgcggcctgctggagtcggggtagtggttgaagcaacgtaagtctgcatctgcctttagtaacgtcataatggtgcactagaagtgatcttgctatttagtgcttctcatattttgtagcaccaggtgatgccacacaactgatatgataactgtagatttccatccctgagcctaaagctcttttaccactttcatttactgttactgatataggaacagaatatgggagaagtattttttgagggtaggatggggcttgtggaggcatagggagttaaaagcacaggtgtagagatttgcataatcaatagccttttttttttttgagatggagcctcactctgtcgcccaggctggagtgcagtggtgcaatctcggctcactgcaacctccacctcccgggttcaagcgattctcctgcctcagcctcccgagtagctgggaccacaggtgtgtgtcaccatgcccggctaatttttgtatatttaatagagatggggtttcatcatgtcggccaggctggtctcgaactcctgacctcatgatccacccgtcacggcctcccaaagtgctaggattacaggcgtgagcccctgcgcccagctcaatcgccattttttaaaaatgctcaagacagggtcttgctctctcacccaggctggagtgcaatggtgtgatcttggctcactgcaacctctgcctcccaggttcaagcgattctcctgcctcagcctcccaaatagctgggattacaggtgcccgccaccacacccagctaattttcgtatttagtagagatgggatttcaccatgttggccaggctggggatctcaaactcctgacctcaagtgatctgcccacctcagcctcccaaaatactgagattactggcgtgagccaccacgccaatagccatttttatgtcttctcttgattttatgtcttctcttgatttcttctttagctctctgttgctccaagccgagtttttctaatattttgtcacacatttaaaaaataaagccaagaattggtacatttctttaagttaggatgagttaagagaattgcagctgttgtgtggacaaagttcatatgtgttctgtgacgtggtgtgaactctgttctatgtctggtatctaatgtcaccaggttgctcagacaggatctctggtcaccattatctgaattctgcctggtgacatcagtatacttgagcatttatctgaacacctaggctagcatagtgctgtcttggtcctgaaggcagagcaagtgagaattctgactttcttttgatctagaagttaagtaactctgtagaccttttatattactttcaccccagaagaaaattccatttttcccctttttggatgctttaaggatcaactactgataaaaataaaagttgcaagacaacttcaagaacaaaaagtttaggttgctgcaaagataattgcagtttttgccattatgttcaatagcaagaaccgcagttacttttgcatgaacctaatagataacatttgtgtaagaagggatatttcgatatacttggtaactgtgagctgagatttaatctttaggcctgcttttaaaaaccaaaccagcagctgtctactcctttaaacaacctgtgttgccttattttgtagacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgttcttgtgaaagttgtttctttttcaaccaccactataaatatttaaataacttgattattttggctgtattctgtttcagcaaagacatcataagggcttctcccagccatcaaagctatttgaatactaatctccattatagtacgaagtaaccccaggttctgacagtttctccttggtatttggttggagtcttaccgtcctcactgtcttgaggtaatgggaggaggaggtctgggataagagtcaggaatctgagtggccctcatgtccctgttgtcttaatgcttagtaggtaacttcagccccctgggaactggcactgtttcctacgtgggagctgttggggaaggaagagtaggctggggcagggagtggaaaagggtttccttccctcttctaggaagagcctgcccagggcaaaacttccagttagtgcaaggggttttgtgctgctcttctgtcccatgcccaacaacctcctttccctcttgctaatggtctcctccccattccgtgctgcccacaggcagaggccgcccctgccctcactggtggccagcatgtccaagtactggggcctgctgctccttgtgggaccctgtggaccgttgggtagcaaatcttatcaaagtaggaatgcttactggcataaaacattcctagaaccaccactcataggtgtcaataaaacgatgagctgctcagctaagcccgagttgctgcttctgagttttgtcaccgaagattgattggccaagttccttttcacttagtggaagagcagttgcagacatgaaaggttttcaagaagcctttctgtcaaaacagagcacctggattcatcatcacaggcatgggtcctcctgctgatggagagaagaagaagtctcaagagatcaaggggaagtgtgagtacctgactcctcaccctcccagaggcccttgccttcttttaatttttgttacagaaaatgaaacatgcacatcagtagagagatgagcacatgaacccctgtgtactaatcacccagcttcaagaagtctcaactcaatggcgccatcttgttttcctctatacccatctgaccagattattgcaaagcaaatcccaggcattatttcatccataaatatttcagattatctaaataaagtggaatcaggtaaagaaatatatgatcaaatacatccattatcacactaaaaattagtgtcaattcaaatatctagattttcccctactgttgtgtagtttttagtagtttatttgaatcaaggtacaaacgagatccacacattgcaacaggttgatttaagtctcttaagaatcttatatgttctctttccactccctcctctgttttccttaaaatttatctggtcacttgttttggagaagccccgtgtttattccaggaactgtctggttgctggaatgtctgtggctgtccaaatgaggtcaaactccagctaaacagggaaaagaagggttctttgccacaacacttctccacgtccctaaacccctactcctgggcagcctagcttggtctggttctgtctggcttttaactggaacatagctctccttggctttgtaacttagagccattccccaggtacagaatagaattcattgcttttttctgagtgtgtcctttttgggcaaggcttccattttaaaacatgctgcctttggcttcagcttggtggattccttggctgccaagattttggttaaggtggaaaggttattacagaagtgaaaacaatgaatctcacagtaattggcatcactttgagggcctacccatggggaattccattgggttggacagtaggagtacttgggtttcttccccccggctcctcgacctcatcaattacattttcatgacatcctgagtatgaatatcaggctctggccgacaaagggtggtgaaggaagacacactgcgtcttgcatttaagcagctccctttattccctccctag

SEQ ID NO: 13521 - DNA, 12293 bp, Human; identical to SEQ ID NO: 12222

SEQ ID NO: 13522 - DNA, 13219 bp, Human
tgaatacagatactagcgtgtctgcagcagagaaaaaaacagcattccccatccagaaatgcaaggtcaagaacagagagcaaattaggtagctaaggactcaggtccttagttggtgtccaggggccacattctttcctttcaccatctctgtagggacaggaatacttcccttctgtcctcagagggtcaggactcagagaaaccacagagcagcagctcaggaaagtggttcatggaaatgctggcaagagagaggggttacaatgccctcccttgggagcaggctgctcccatcagatcgtaacctctctggtatgtgggcagagctaccaggttaaggtcctccctagggtttgcaaaaccctcatgggatcatgagccatacagaaccgacctgtgtgtctccagagtctgtaattaacacaggcattttgaggaaatgcgtggcctcaggccccactcccggctacccccatcccactatgcctagtatagtctagctgccctggtacaattctcccagtatcttgcaggcccctatttcctattcctactctgctcatctggctctcaggaaccttcttggccttccctttcagacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctgcggccaacatgatggctgggctgagcagcctgagcagcggcttcggtgggtattttctgcctaagtgctacgtgatcctctgccgcccagacctcaacagcacagagcacttccaggcctccattcaggactacacgaggcgctgcggctccacctgaccagtgggtcagcaggcacggctggcagccttctctgccctgagggtcgaaggtcgagcaggccgggggtgtccgggaggtctttgggcatcgcggtctggggttgggacgtgtaagcgcctgggagagcctagaccaggctccgggctgccaataaagaagtgaaatgcgtatctggtctcctgtcgtgggagagtgtgaggtgtaacggattcaagtctgaacccagagcctggaaaaggctgaccgcccagattgacgttgctaggcaactccggaggcgggcccagcgccaaaagaacagggcgaggcgtcgtccccgcatcccattggccgttctctgcggggccccgccctcgggggccggagctagaagctctacgcttccgaggcgcacctcctggcctgcacgctttgacgtcacgtccggcgcggagacggtggagtctccgcactgtcggcggggtacgcatagccgggcactaggttcgtgggctgtggaggcgacggagcagggggccagtggggccagctcagggaggacctgcctgggtgaggagggcgcggggtgagggagggaggggctgcgggccgccgtggctgccttccgctcggccgctcgggacctgtgggcgcggcgtgggcttcgctcacctgtccccggctgccgccctccgccgtccgggatcctctcactgtgccgggccagtccgttcgctctcatcccatgtctcctttccccaaacttggatttttctcaccaggcccttcttcacgaccctggccccccatccagcatcccccctggccaatccaatatggcccccggcccccgggaggctgtcagtgtgttccagccctccgcgtgcacccctcaccctgacccaagccctcgtgctgataaatatgattatttgagtagaggccaacttcccgtttctctctcttgactccaggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgaggtactgtgcccagggtgttgggactggggagacaaatagagggaatagacacttttttggtataatagggaccctgggctgggtgtgatggctcactcacgcctgtaatcctagcactttgggaggccaaggggggtggatcactttagcttgggagttcgagaccagcctgggcaacatggcgaggcctcatttgtacaaagactatacaaaaattagccgggtgtggtggcacacacctgtagtcctagctactcaggagggtgaggtgggaggatcacttgagcccaggaagtggaggttgcagtgagctgagatggtgccactaccctccagcctaggcgacagagcaagatcctgtctcaaaaaaaaaaaaaaaatatgtggaccttaagacaatctctgttaatgtgggtttggaacaggctttctccaaaggaagctggtgacctcaggctgacctttctgcaagccccagctgttcacggttgccaccttcctgagaggagtgggcagcatcagggttacaggtgtttccccagggcagtgtttccagctgagcttccagttccccacaaacacagccactttcctctgaatccaagattcagatgctctgccttgggcccctgaaggaacttgtctgatgaagggacttgtcagggttggggcttgggatggaactggagctgggtccctacaactcctgctgattcatttggtgacgccaccccctcctgctgcctattgtgctctagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggtaaacgttctgtttttctattttcttttcctgtctgccattcccacgttgggggaggggtcctgcacttcccacttctgggtgaggtaggggctgggggatccatctcagacccacatagtgtctggccttggtacacctctgataatcaggaagtgagagcctgctttgggttggattcttcttccttgctgtcctgtgagtactctggttggagatgggtttgtgtacatcttgtcaacaggttccacccactgtggaccttgacctccagctggtctctgctaacagaatgagaaacctgtggcccctgtgctagagctggggcccaaccttaggtgtttctgaagcctggcagtgtgggcttgaagcctggcagtgtgggctttgggccacagtgccaagccttggttcagtgctacctgcgtttccagggaagtgttcactctggggtgtcagtggggcattcaagtctatttgtctaaaccttcagcgtccaataaagtaaccaggaactccaggagctattacaatttttatttttacatttaatggagacaaggttttgctctgttgcccaggctggtctcaaactcctgggctcaatcgatccacccaccctggcctcccaaagtgctggaattataggtgtgagccaccatgcccagcccccaggggctattttatgttttttgtttgtttttgtttttgagttggagtcttgctctgtcaccaggctagagtgcagtagcgtgatctcagctcagtgcaacctctgcctcctgggttcaagtgattcctctgcttcagcctcccaaatagctgggattacaggcacatgccaccacacccggctaattttttgtattttagtagagacggggtttcaccatgatggccatgatggtctcaatctcctgaccttgtgatccacccgccttggcctcccaaagtgctgggattacaggtgtgagccaccatgctcagcctatgttgtttttcattttattttatttttttgagacggagtctcactctgttgccaggctggagtgcagtggcatgagatcggctcactgcaacctccgcctcctgggttcaagcgattctcctgtctcagcctcccgagtagctgggattacaggtgcctgccaccacgcctggctaatatttgtatttttagtagagatggggcttcactatcttggccaggctggtcttgaactcctgaccttgtgatccacctgcctcggcctcccaaagtgctgggactacaggcatgagccactgcgcccagcctgttatttttttttttttttttgagacagtctcactgtgtcgcccaggttggagtgcagtggcatgatcttggctcactgcaacttctgtctcccaggtttaagcgattctcctgcctcagcctcctcagtagctgggactacaggtgcgcaccactacgcccagctaattgttttactttttttttttttttttttgagatggagtctcccctctgtcgcccaggctggagtgtggtggctccgtctaagctcactacaacctctgcctcccaggttcaagcgattctcctgcctcagcctcctgagtagctgggattacaggcacgcgccaccacacctggctaatttttttgtgtgtgtttagtagagacagggtttcagcatgttggtcaggctggtttcgaactcctgaccttgtgatccacctgcctcagcctcccaaagtgctgggattacaggcgtgagccaccgtgcccagccatttttttactttttagtagtgatgggtttcaccatattggccaggctgatctcaaactcctgaccttgcgatccacctgccttagcttcccaaagtgctgggattacaggcgagagccaccgtgcccagcccccagggactattttaacttaaaatttaaaattaaataaaaattcagttcctcagatacgttagccaaatctgaagtggtgaggaaccacgtgtctcctggtggctgaatcgggcagtgctgacatagcacatttccatcatcgtggagaatccccttgggcggcactgctttggagtccctgcaaggcctgtggggatggcggcccagtggcatgccttccagtcctgccactcccagccaagacatcactagtctatcatggtgtgttttcttgccatgccaggttgggcggcacactagtaatcacctagaatgggagccagggggaaacccgttcgctgtccctgtgcaccgtgttcagggcagctgctgccagtggaatgctgggataaccccagtgtcgggggtcctggggcagcctgtgtactgctggatgcttgctttcaagtactctgctggggtaagactctggggcagtttccatcccttccttgggcttcagcttgctggactggccctgagaactgggaggggatggcttcatgaagtcattttgatgggggatgaagatagttgctgtagaggaagaggatgagagagctgcttggcctctggaaggtgggaggagctgtcgcaggctgcacaggggctctgaggtcgagttcgtttagttcattgattaagcagtctaccaggtggccagcaaggctttgtgggtgcttgggatgcatttaagggaactaaacaaaggtgcttgtgcagccgacctgcttgccaggcaatgcagataacagataagtccatctgcctgcagtagacggtgaggaagtgctgccgaagaagaaaaagcagaggcgggccaaggggttggggagttgtgagtggggttcgattgcgattttaagtagccagggtctctagagtcttactgagaaggtgagatttaagcaaagactcaaaggaggtgaggaagttgaccaagtgggtgactggggagcatctgggcagagagaagagccagggcgctggggtaggaggatcctgggggcgtgacaggcagcaaggaggcacatgcctgatccaggtggccagacgacaccctgggagagaagcaggcaaggggagggctgcctgcgccttgataggcctcccgggccctttctctgaatggggaagcactggggatacgtgagccaagaggtactgaggtctgacttaaaggtccttctggctcctgaactgaaacctgtgggggaggcagtcacggagcggggagaccagatgggcagctcccctggctacctgggagaagctgttgccagccttggtgggccagtggagtcaggtgaggatctggccatgggtttgaagctctgggaagactgagttgcttctccaatagtcaggacccaagatctgtttctgccttcagacagaatgcggtcagctgggcctccctgtcggcctctgtgctggccagatccatggcagcctcttaggacctgtgtgagcttcttgccactgcactctcccttgcagagtctccatgctgggggaggcttctgggcttgtccctgcaccttaaccagccggtgtcacctgagaacacttgttccccttagaagggacccagagggggccctgggtgagggagagatgggaaaccctctcagcccccccacccctgtggcttctcctggcaggaaacatactggggagaaaccctttgagtgtcccaaatgtgggaagtgttactttcggaaggagaacctcctggagcatgaagcccggaattgcatgaaccgctcggaacaggtacttgggagctggcccaggtacttgtgggcagggcacactggcctctctgtcttcgtgccatccgggaagggccccaggagactgtctgagaggggtactgtaaactcaggaaagctgtggggtccttggatgtcatgaggtccatgccctggtacaggtggggacacaggtcctgagggcggaagggacaggcataggagggactctgtgggaggcatttggggttggctttcctaggcccctggcccacctccaccttggctttggagaaggggagccgctacaggggatggcagctgggaaaggccccctggccacccccagcaaccccactgctggcttctgtgtcagggcccgccgaaacccaggcccactcttcctagaggcctgtcagcagccactagggccagggactgtgggtgaggccactcggaccctgcccccagtctgtctgggcctgagaagggcctggtgtgcggtgggcttgcagcactcagtgatggtcaggccaggcaggttatgtgttgccctctcccaccctagcgtccccaccctccccaggcagactcttcccagcagcaagcggaagcccgggcagaggctgctgtcataggcagaggcccccgctgatgccggccctgcttgcccctcacactgccaggtcttcacgtgctctgtgtgccaggagacattccgccgaaggatggagctgcgggtgcacatggtgtctcacacaggggagatgccctacaaggtcaggcttggcctgtctccagggccagggttgggtggccccaggatccttcctgctgagccctttacgtggggtgctgtcaggcacctccctcacagtagctgtcagggagcctgccttccctgcctttccagtgcccccttatctaggcagggctactgtctgcagcctcacctccaaggtccttattaggcccttgtttctttccatggaggacaggcttggcatcctctgggcagctgagccctgagggccctcctttgcaccatccttcacaccagatcaggggtcctcccagaatcatctcaccggggcctccctctagttcctgccctatagcccaagggtgggtggcagggtttcatgggtgcaggccgccctggaggtgactgtgggcctctttttcagtgttcctcctgctcccagcagttcatgcagaagaaggacttgcagagccacatgatcaaacttcatggagcccccaagccccatgcagtaagtgacagggagggctgggcatgctttgatgctggcatgagcaagagtgagctgtgcccagagtgggcagccggccatgtactttctgttgttcgggggggtgcttgtgggtctcccaggcagcccttccctgctctcaccctggccctggtccctccctctgcctgcctggtctgcctgcagtgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggtgcgtgtcgcccgttctctcttggggcccagtcctgctgccagcccaggcttgcaccggcagggaagacagagtttgctgacttttacacagatgagtgtgcccttggcctccaccctgaatctagtgcctacagcctctctgggatagtgggacctgaggggcaagcagctatgccaggcagagaggctgggggcagatgtttcaggctcagacaagcctctgtgcccccggggcagattctgagcttccttagtttcctgtgactcctgctcatagattgtccttctgctctcggggtggaggtggtgcccctttcctagcactgcccaagccctctttccaccaggcatgctcctagctgtagcagagcaagggggtcacttcccttggtgatggcctctgccccatgtccccaccttaacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaaggtgaggtacgccctgcccctcccctcgcctccccatcctgaggccaaggccacaggctgagctcttgccttgtgcctgcagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaaggtacctgggcggccctgggagagccatttcctgctcatccgagttggagggtctctgaggaggaaacgctcctttcttgcctgtgaacctcttttgtgccccacatggttagagttgagagtggacctgctttgaaggcaggggtgtcctgtgcagtagtgaccctgggtggcactggagagcctggcagggcctgtgcagcacttgtaaaccactggtcccctcccttgctgcctgtcccaacctcctgctgggtttcctcgagggtcccggggctcctgcatgatcccccacggtgttctccctcttgcagccgtggagcaactgcgtgtgcacgtcagacggcacaagggggtgaggaagtttgagtgcaccgagtgtggctacaagtttacccgacaggtaggccagggcctgggccccttcccctaccctaggatcccccaaagttctgagctcaccctccccgccaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgtatttcagcctgacagtctgttcccgtgtcctggagttggggaagtgctgccttcccacccacgccttcaggagagagtagtgccctgcccggtcctatgtgggcctcagctcagctggcagcttcccctcctgtcaggaaacctcagctgagcgaggcttggatggggttcctttgggggccaaacctctggccttggctgctctccacatctgtattctgttcctcattactgcaggattttagagtggggaacgctggccagttagagcaccagtattcctattttagagctgaggtgataccggcttctggagatagaattcattactaagcttctggagttcagtagagtgatcagggcccacggggctggccttgttgggcagaatcaaggattgggcccagttagtgtagctgagcacgcctgggggtctgaggagggtggggcccttccttcaagcagcctggtctgtgtccaggaggctttggtccccacgttctatagctgtggggtactgtgtggcaaggagcaaatgcacgtgggccttagagcagattgctgttgtttaaatttcttcccaactaagttggccctgggtaagttactgacagcttcatttctctactgaaaatacaaaattgctgggtgtggtggtgcatcaggaggctgaggcacgagaatcccttgaacccaggaggcgaaggatgtagggagccgagattgcaccactgcattccaacctaggcaacagaatgagaccttgtctttaaaaaacaacaacaaaaaaaagaggcccactgtggtctcaacactgctctccttcccagccgagacactggcctctccctcaggttcagatggactctgcagataggaaaaacatcttgagccagacggcttgtgtggattcacagcctggtttgggactgtatttgaagggctccacctccccaggtccaagggccatctcatcgcagatgggagtctcatcaccacctgtatgtaccgcaatctcaagaagggctgtgggagccgggcccgggcagaggaccaacaggcaaagaccagctttggagcaggcaggtttcctgggcatcatctgttccacagcatttacttctcaggcctctctctttaaatggagacaaggtcttcccgtattgctcagggtggtcttgaacccctgggctcaagtgatcctccctcttcagcctcccaaagcactgggattgcaggtgtgagccaccacacccagcctctggggcatgtcttttccaacgcttcatcacttgctacaatctgagatgagaaagggcctggaaggctgtttaagaccctcagtgtgaaccctgggctccatgctgcctgttcccctgacatctgtcctcagcccaagagtcccagaagacagtagcaggaggacaaaggcaatgactccaaatggataggaaatacttttattgcaaaaagtactgaaggtaccctaaaaccttaagcaggattctggacatggaagcctacagaatagacaaaaataaatatgtcaacctgcccgaccctctggggtgaactggatgtggacactggagggagggcgtcctttattacatacgcgtctctgaagtcatataaatatagaataccttatagtagatcagcattaaataccagtcactgtgtttatataacttaatttgtgctgtagacaaagttctgtacatgtaacatgtggccatgcccaggcatcccagcatctatcctgaagtcagtgtaaagacatccttaagtggtggagacatgacagcccagaacccacagcagagggaaactggggagaggagggggcctgaccctggatcccccagctggtgtccacaggctagagggacccattgctgcagaggctggtgcctggttttccccatacttggtcttctaaacccaaagacagggtcctgatggtggagacctgggtaggtccggaggacagacacagg

SEQ ID NO: 13523 - DNA, 9038 bp, Human
agcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcgtgagtggcctggactggggtagggcaggtggctcagggcactggcatgggggcccactcatgcctgggagcatcgcatttggggagggtcatggcggagggagcctgaaccctgcccagtgtctgggcgcagggggctgtggtgggcagcagtgaaggggcctgaggagtgccgtggggaagagagggtgaccagagccactctgaatggcgtcagccaaagaaggactctgtcccctccccaccctgtagggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgcggggctgcgcggcggtggcggcggtgagttgagacgcaggaggctaggggcagctttgagccctgtcccaagagcctcggtgaaggaaggggccccgggcgcgtctccactccaagcctcactgggggctgggttggccgccctttccgatctcgttaaaggctcctccagggcgtagcccttccactgagaggaaacccctcccaggagggtctgggggccccaggcagagcattatcagtgtccctcccccaacagaaagcatgggtgggggtgggggcgctgctggattcctgctctggtggaggggaaacttgtgaggggctggtaagcgccccctccgaagcctggtgtgtgcgcggggggaaggaagttagtttcctctccacccatgggcaccccttctgcccggggcctgggaagtgggctgctctgtgggcaaatgctggggcctctgaaatggaggagacgcagcagggagaggccccacgtgggcagctgcgctgagagtcagcagcacctgtcccccaggcgctcctcctggtgctgctgggggcccgggcccagggcggcactcgtagccccaggtgtgactgtgccggtgacttccacaagaagattggtctgttttgttgcagaggctgcccagcgggtaagtggccacaggggtgggagaggcatggggcaggcagggctggagaggtggcgggcaggcccgggaggtaagaggaggctggcaggggaggtaggggtaggctgacagagaagtagggagctggagagaaagagggagggagggcagggtgggaagcaggtcgggggttgctgggcagcccctctgcctgcctgacccctgcctggttccacagggcactacctgaaggccccttgcacggagccctgcggcaactccacctgccttgtgtgtccccaagacaccttcttggcctgggagaaccaccataattctgaatgtgcccgctgccaggcctgtgatgagcagggtgaggggcttctcagtgcttggcagggagttcctaaggacaggcctttctgaaggaagtggctggctcgggcccaaacttggggtgtgagggtcctgcacccacccttgccagaaccctccaccctgatcctccttcagggtgcccttgccccttctctcttcctggtgaccttcccatctctccatgtgccttggcctctggtcggccttaatctctgagcttctctcttttttagggtagccctgtacctgtctgtctttcgcctatttctgtctccattatcttgggataatgcctctgcctctccatgggagcctttggccctgactaactctccactccccatctccctgcacccccaccagcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgtgagtacccccacccagggctctctactcccagacccccttctccctgcctgacccactcctgtcccatggtgacgcatgcctctcctggattgcaggttcccgcagagatactgactgtgggacctgcctgcctggcttctatgaacatggcgatggctgcgtgtcctgccccacgtaattcctagctgtcgtgggatggagggaagggcggctgggagcagagcaggggcctggggtggggcaggtgctgctggttcaggaataggaagaggggatagggaggagggagccttggccctgtgatgggtgggccccacttcaggcaaacttagatggcaaaagagcaatctggatccgccttagccagatacataagggtatttgccttcactttcagccagcattccccccagcgatcctagccagatattacagatgatttgtcacttacacagagagtcacattgatatagctttaaaacttgggctgaaggaggttgaggctgcagtgagctatgatcgtgccactgcacttcagcctgggcaacagagcgagacctattaaataaataaataaatattaaatctattaaatattaaatattaaatctattaaataaataaatacaaagggctgagagtcaggactgtgctgctagttctctaggggatcttgggcaagtgcagagaattcgcgtctctgatgtgtggtgtccctttctcaacatgggatgttagcagctaattcacaggcctttgatcagaggtaagggactttctgtagctattcaagtcttttttttttttttttttttttttttttgagatggagacttgctctgtcacccaggctggagtgcagtggcacgatcttggctcactacaacctctgctgcctgggttcaagtgattctcctgcctcagcctcccaagtagctgggactacaggagcccaccaccacccccggctaattttttgtatttttagtagagacggggtttcaccgtgttagccaagatggtcttgatcacctgacctcgtgatccacccgccttggcctcccaaagtgctgggattacaggcatgagccaccgcgcccggcctccattcaagtctttattgaatatctgctatgttctacacactgttctaggtgctggggatgcaacaggggacaaaataggcaaaatccctgtccttttggggttgacattctagtgactcttcatgtagtctagaagaagctcagtgaatagtgtctgtggttgttaccagggacacaatgacaggaacattcttgggtagagtgagaggcctggggagggaagggtctctaggatggagcagatgctgggcagtcttagggagcccctcctggcatgcaccccctcatccctcaggccacccccgtcccttgcaggagcaccctggggagctgtccagagcgctgtgccgctgtctgtggctggaggcagagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactggtaagtacacacacccacacacgcacccagaagcctggggtcaggatgggtagcccagagtctactcaaccctgatacagaaggggaaactgaggcagggagtgtggggtgcagaggaaccctagaggagctgtaccagcacccaggtccaggaggcttgcctggtggctgaccgcaatctctctgtgtctgtcagcagatgaagctgggatggaggctctgaccccaccaccggtaagaacctcactgtgtgattctgggctgccttctggagctggaagatcaagccttactatgatccctggagcttggcacgcggccagcaccgggtagccctagtggacagaggtgttgggagcagagtcatcagtggatgagaccagcacagtgcctgccctcaaggggtgctcagtcagctggagttcagattcgtacacaggagctaacagttcaatggaaggagagccccatggtgctgggggacaagaggaaggaggcgggggcaggggactcaaggcagaagcaagagttctgctgggctacagtgagagcagggccaactgtgggaggtgtcattgcgggggtgtctgctgactgaaccagggactgtcccctcctggagaggcactgcgggtaaggggccttacttggcaagcagggctgacctggggcccctcttggcttccaggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggtaagggacatcagtggcctgaggccttgaccccattctcctgtctgcggtgggaagttgtggtttcacaacgtgttccctttctgccccctaactgacggagtccgccctatgccctgacccaccggatccagcgggcttcagccctggggtacccgcacgaacgcccctgactctgcctcccgaccgcggcccacgtaccccaattggctctctctggccctgccccaggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaacggcttcttggcgtttctgcggggctggggtgttaagtggactggacttttctcgagggattcgaaggggacgggaatcttgtcaccccgggatctggcacccatggtggagtccagtgtggccttagctcccaagcctgcccctcccgagtccactctggctcaattaccccgagaaggagagagcaagtcgcggccacagcgagtgagtgaaccggagcccagatgagagcgctttaatggggctgcgaggtggcggagacagggtcgggatggggtgcagcagttggagacacagggtcagggcccctcatcctctattcactccaccggggcagtgaaagggtcccggcagcgagtgggtctggctggggacggggcgcagacttgagggaggtggggccagaggtggggtcccgggggccacaagtgcggcccggccagacaggcagttttcatgtttctggtaaacaaatgactgagaggaaacccttggcggggataagaaatgaggcccgggctaggccgcgcgcagatctgggtcagagaggaagggaaaaccccttccccgagctcggggcctgcctccacccaggatgcgccagcgacgccggttccggggtgcgggggagggggctgcatcctggagggggctgagccccgcaggaaaacaaagtcaccacccacggggctggggagagctctgcactctttgatagtcaacgaacatgcaaatatatgtaagtcggcatgcaaataagcagcatttgttgttgtttgcgtcagcagcttgggcactttttctgggcaaccgtggcggcgtgtgcactccagtgttgccaagggctggggatacggggggccagggtgggggtcagggagggtttccagcgcaggaggggagggctgtgcggctcccagcctttccaccagggcctggctggctggggctggggcggagggccccacggagctgcgaggctgcggacaggagtctgcggcctctagtacttagcgatgtcccccttcttcaggatgacctgtcgctgccagggcgccagcttgctctcatcgtagcccagcgtccgcagcttctctgactgttccttctcccgccgcagctcctcctgcttctgtcgctcctcctctttcctgaggcagtggggaggggggcagacccggtgaagtctggggccagatacccaggctggcagaaagggtggggccaggcaccaggcagaggccaggtcacccatgcaaggggtgggttactgagggctggggctcggttgctgaagacagaggggctagattgggggcagaatggggttactggagcacaggggagctgggtgagtgggaggttaaggctggattattgtgggctggggttttactggaaacagaggtgctgggtcactgtgtggcaccatgtgaggaggtggtattgctgggtgcagcagcaagattactgggaccaggacttgagttgtgggggagctgtcaatatgaagtattgaggactggggtggggctgctggggagcagagagaccatataattgagagagggactgagaattagagacaagttattagaacatagagggtagatctgcctgttgacagagtagtcactaagcacatgtggctgctgagcatttgaaatgtggctggtctaaattgtgatggattgcaggtgtaaaatgtgcatgatatttcaaagactaagttttattattatttgagtcagggtctcgctctgttgccagggtggagcgcagtggtgagatcatggctcactgcagcctcgacctcctgggctcacgtaatcctcccacctcagcctcccaagtagctggaaccacagatgtgtgccactacgcccagctattttttttttttttaattgagacagagtctcgctctgtcacccaggctggagtgcagtggcacgatctcggctcactgcaacctccacctcccagtttcaa

SEQ ID NO: 13524 - DNA, 18763 bp, Human
ccctccaagctgagggcctcccctggggtccctctttgctccccatccttgctctccttctgcccccactgccacccctgcagagtttattccagttgttcacttactggcttttctcctccagcgcagctctctgagctacctgaggtgagagaatttactctttaaaaagtaaagaaaaacttgattataaaagtaatctatgggccgggcacggtggctcatgcctataatcccagcagtttgggaggccgaggcgggtggatcacctgaggtcaggagtttgaaaccagcctggccaacatggtaaagccccgtctctactaaaaatacaaaaaaattagctggccgtggtagtaggctcctgtaatcccagctactcaggaggctgaggcaggagaatcacttgaacccggaggcggaggttgcagtgagccgagattgcgccattgtactccagcctgggcaacaagagcaaaactccatctgaaaaaaaaaaagtatcctgtgttcattgtaggcagtatggaaactgcaaaaacagataaagacaataaaaatcaccaagagtgccactacctaaagataggccaggggtggtggctcatacctgtaattccagtgctttgtgaggctgattggaggatcacttgggcccaggagttccagactgccgcactccagcctggccaacacagtgagaccctgtgtctaaaaaagaaaaaaagaaaaaaaaaaggtacatatatagtcggcgttataccattttggctgatagcttgatcattttcccaggctcagatacctgccctttttccccaagtgaagtcaggatcacaccgaaaagctttgcctcctgctatttaaaaacctaatataggcagggcgcggtggctcacgtctgtaatctcagcactttgggaggccgaagcgggcggatcacgaagtcaggagatggatcccggctaacacggtgaaaccccgtctctactaaaaatacaaaaaaataagacgggcgcagtggcgggcgcctgtagtcccagctactcgggaggctgagacaggagaatggcgtgaacccgggaggcggagcttgcagtgagccgagatcgcaccactgcactccagcctgggcgacagagcgagactccgtctcaaaaaaaaaagaaaacctaacatatcctgagcattcccatcaccgtccagccttgttccacaacaggaatttaagcgggcggtggtcccgttgcatggatgcccaggtgccgttgtccaggccggtttccagggagccgcagagggagggcaggaggtcgccgcacttggccccgcgccccagggcgtctggttttcggggacgacgcagggccggcgagggtgcggccgtttcaaaatttttttttttgagatggagtgtcactctgtcacccaggctggagtgcagtgacacaatctcggctcactgcaacctccgtctccccggatcaagcgattctcctgcctcagcctcaccaagtagctggggttaaaggcgtgcgccaccacgcccagctaatttttgtatttttagtatagacggcgtttccccatgttgcccaggttggtctcgaactcctgacctcaaatgattcgccagcctcggcctcccaaagtgctgggattacaggcgtgagccaccgcgctcggctcgtttcaaactttacattgcttcttgggacaggaacctcctgagtttgggactaagtttggacagacgcgggcggcgacttctcccaccacttcccggcccccgcccggcacagagtctggctcagagcccggatgtccccgaggggcggggaggggcgggcgggcggggcgctcccgccaaattccggacagcaacagggcgggccggagttctcgcgagaactggcaggcggcgcgcagctgcgggcagctgcccttcccgggccggcatcggcggcacagtgcgcaggcgcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccaggtgcaggccggcgggggccggcgggggccggcggggcgggcggcggtccgcttggcgcggcgcgtgggcacctttctccccgggcccgcagtggcctcccacgcgcgcgctcttcatccgcgagttcaggtcgcaggaggggaccctctctctccgggctcgggcgccctgcacccgaggagtgggttgttaaattgcagcttgtgcagctcagcaggtgcgcgtggggtggagtgagcgagcccgcgagtgcttttatgtaacttaaggtgcagagacctacctgctgccctgtctcaggtcaaaggccccgcagtgacgtgggtggggctgggcgcacaggcccgggtgccctgacctcataaactaggcttaagcagttttcctacagccctgaatagtaatcacgaataataataataatgacagctaaaatgtaggtagcagttagtcttaagtgttttacgtgggtaatccttactgcagtcctaaaaggtaggtactgttatcccctggctgtagatggggaagcaagctcagagaggttaaataatttgggaggccacacagccagagagcggtgggtgcagaatttgaacccaggtcgcccacttctccctttcaacctcagcaaatcggctctatctgcttgcctgtgggttgcctattccgggaaggtcagcagcccagatctgtactctgaggactgtgaatgactgagcttctcttgggttcctttcagatagccatccgagcttgtttcctggggtttgtgttcggctgcggcacgctgctaagttttagccagtcttcttggagtcactttggctggtaagaattccttcggaaatactggttttcaggcgagggtggacagatcagagggtctgtagcggcatttcctcatccctgtctcatctgtgaccggcagaaggctgttcagggttctctggaaacgaagtctcctggcttccccctagttgctcacatttcagcccttgtgatttcgtgcctgtgggttgattgtgaatcaggcagaaacagatctccctggcacccccaaaggtgctgtcatccgcagctgtggtgacagcattccgtaacttgagcagcccttcccggaaggggtgcaggtcctcggtggcgggcaggggcagggctctggcttgtcttcatgggcctttttcatctctaatttctattaggtcacatctagtgcatccccacagccactgtaggatttttccctacactatgatttcagtcccttgagccttctagtctgacctggatatgaaccagtggcttcaaggtaaaaagttttatctcctcttatcaatattttgagccatctaatccttctttgccggaattatttcagttttgttaaattttgtatccgacatacatcactcctttatgttgttatctccctctttcatgttttattgtgtgtagtgtcatttttaacggacagaagggcccataatgcctctgtgacctatgggtttgttttgcctgtgacattcaaaaacagtcccttgccgggcgcggtggctcacgcctgtaatcccagcactttaggaggccgaggtgggcagatcacgaggtcaggagttcaagaccagcctggccaagccaggagttcgagaccagccttgccaacatagcgaaaccctgtctctactaaaaatacaaaaatgaactgggcgtggtggtgggcacctgtagtctgagctacttgagaggctgaggcaggagaatcgcttgaacctgggaggcggaggttgcagtgagctgagatcacgcagttgcattccagcctgggcgacacagcgagactctgtctcaaacaaaacaaaacaaaacaccagaaacaaaaacagccccttaaaaactccactttttgcaaacctgaggtagtagatgctgcagatgggtacctgtgtccactctcagacaggtgagaacagggcctcatagacttagggacagctcaggagacccagatgtgcacttatggttaacttggttctcttgtcccaacttaactctctttttgtctttaaataggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccaggttcgtgtgccttatgtccccctctggaggggaaaagggtggctcccattcaggctgaggacagtgacattgattcacctttcaggtctaatctcccccaagcgattttccgcagacctctatcctcactaagctatttataaaggatgagctccgctcatgaattctgcctctggatattgactcgaggacgtgctgaccttttgctttaaagtttgcatcacatagtgcaccatctaatttgaagccccaaccttgagtagttgtgattctaattttataatcagatgatatttagacgtttcatgtaagagtttactggccgggcacggtggcgaacgcctgtaatcccagcactttgggaggtcgaggcgggtggatcacaaggtcaggagttcgagaccagcctggccaatatggtgaaaccccgtctctactaaaaatacaaaaaagccaggcgtagtggcacatgcctgtaatcccagctactcgggaggctgaggcaggagaactgcttgaatccgggaggcggaggttgcagtgagccgtgatcgcgccactgcactccagcctgggtgacagagcgagactcccatctcaaaaaaaaaaaaagagtttactaacaaggtcgggtgcagtggctcacgcctttaatcccagcactttgggaggccgaggtgggtggatcacatgaggtcaggagtttgaaaccagcctgaccagcatggtaaaaccccgtctctacgaaaaatacaaaattagccgggcctggtagtgcatgcctgtaattctagctacttgggaggctgaggcaggagaattgcttgaacccaggagatggaggttgcagtgagctgagattgtgccattgcactccagcctgggcaatgagagtgaaactccgtctcaaaaaataaaagcctccgtatgtggaatgcactctgaaattgaatgtctcacagccaatgaaatgaaatacatgtggctcctgggattcagggtggaaaccttggacccttttttgcttctcttagctatacttgtccccagatgaaggactgagcatgtggccgggggtcgtgaaccagagagcccatcagctgtagcaggagagcatctctttaccatgatgctttcattgtgcttattggtgttttaaagtaaattgatgaacagcataacttaggggaatgtgttttcttatgaaattttaatgtgatgacaaatgctgattgcccagcagcacattttctgtttctgtcttcgggaaaataggttaattttaagcagtgcgaaggggagctcaggccagtgttttcactccccgtgtgtcgttgatgtctctctcccacagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtataatattaaatatgacactgcttttcttttttttttttttaagtaacattttaaacgtgatattcacgtagcataaaagtcaccatttcaaaatatacaattagtggttttcagtgtattcatgaggttgttggtctcctttaaataataggtacatgttcttcttggcgcgtttcaagtgataatttaataaaagtcaagagaactaatgtagtccttaatgcttttcactatgtgcccagaacctgggtgcgtaagtccttggtgattcttggtgctgttagctacctgctgtatcccttcatcctgtttctgcctctgtttgtttgttttcttttttctttttttttttttggtagagacagggtcttactgtgttgcctgggcaggtctcaaactcttggccttaagtgatcctcccacctcagcctcgcaaagtgctagcattataggcatgagccattgtgcctctccctttctctgccccttcaacctattaatagatctgaagcaccccagagggggtgaggacagagatggggcttagggaagggagtgccctctgtcactcatgtggcagcttggctagttttcatcagaaataggtattaatggggccgaggccatgtgttagtgagctgtgtgagccatggaggtttgttctgtctcaggctgaagaaaaggccttgtttcgtttcttttcttttctttctttcttttttttttttgagacctagtcttgctctgttgaccaggccagagtgcagtggtgcgatcttggttcactgcaacctctgcctcccaagtagctggaactgtaggcacgaaccaccatgcctgactacttttcgtattttttttgtagagacagggtttctcgagttgcccagagccatcttgaactactgagctcaagcagtctgccttcctgggcctctcaaagtgctgggattacaggcttgagctacagtgcctggccttttttttttttttttcctttttgagatggagtctcactctgttgccctgttgcccaggctggagtgcagtggcatgatctcaggtcactgcaacctctgcctcccaggttcaagcgattctcttgcttcagcctcctgagtagctgggactacaggcgcccgccaccacacccggctaattgtttgtatttttagtagagatgaggtttgactgtgttagccaggatggtcttgatctcctgacctcatgatctgcccgcctcggcctcccaaagtgctgggattataggcatgagccaccgtgcccagctttttttttttttttttttttttaaagacaggatcttgctgtgttgcccagcctggagtgcagtgttctgatcatggctcactgcagccttgacctcctgagctcaagtgatcctcctacctcagcctcccaagtagctggaatacattacaggtgttgccaccacgtccggctaatttttaaattttttgtagaggtggttctcctggacggttgcctgtaatcccagcactttgagaggctgaagtgggtgggtcacttgacatcaggagtttgagacaagcctagccaacatggcaaaaccccatctctattaaaaatacaaaaattagttgggcctggtggcacatgcctatagtctcagctactcgggaggctgagacctgagaaccgcttgaacctgggaggtggaggttgcagtgagctgagattgtgccactgcactccagcctgggtgatggagtgagactctgtctcaaaaaaaaaagagatggttcctcctttgttgcccatgctggtcttgaactcctgggctcaagccatcctcctaccttggccttctaaagtgctgggattaggccaggcatggtggttcttacttataattccagctagtcgagagactgaggcacaatatttgcttgaacctgggaggcagaggttgcagtgagctgagatcacgccactgcactccagccagggtgacacagcaagaatctgtctcaaaaagaaaaaaagaaaaagaagtgtaaggattataggtgtgagccactgcacctgctctatgtgtgtgtgtgtgtgtgtgtgtgtgtgtgtgtgtgtgtattttttttatttatgtatggttttttgttttgttttgaggcagggtctctcacccaggctatagtgcattggcatgatcatggtttactgcagcctctacctcttgggctcaagtgatcctcccaccttagtctcctaagtatctgcccaggctggagtgcggtgtcacaatctcggctcattgcaacctccgcctcccgggtttgagtgattctcctgcctcagccttctaagtagctgaaactacagatgtgtgtcatcacacctggctaatttttgtattttttaattaatttatttttttgagatggagtttcactcttgttgcccaggctggagtgcaatcatgtgatctcagctcactgcaacctctgcctcccgggttcaagcgattctcctgcctcagcctcctgagtagctgggattacaggcatgcgccaccatacccggctaattttgtatttttagtagagacggggtttctccatgttggtcaggctgttctcgaactcccaacctcaggtgatctgcctgccttggcctcccaaagcgttgggattacagacatgagccaccatgcccagcccctggctaatttttgtatttttgtagagacggggtttttccatgttgcctaggctggcctcgaactcctgcggttgagtgatctacccgcctcggcctctcaaagtgctgggattacaggcgtgagccaccacatgtatttctttttctttcttttttttttttgagacagagtctcactttgtcgcccaggctggagtgcagtggtgcgatcttggctcactgcaacctccacctcccgggttcaagtgagtctcctgcctcagcccccgcgagtagctgggattacagttgtgcactacctcgcccagctaattttttgtatttttagtaggtttagtaggggtttcactgtgttggccaggcggttctcaaactcctgacctcagatgatccacccgcttcagcctcccaaagtgctgggattacaggcgtgagccactgcatccaacccgcatatttcttttttaaaattactatttggctaggcacagtggctttgggagaccagagcaggaggattgcttgaggccaggaattagaaaccagcttggctggccgggcatggtggctcatgcctgtaatcccagcactttgggaggctgaggcaggcagatcatgaggtcaggagatcaagaccatcctggctaacacagtgaagcctcatctctactaaaaatacaaacaattagcctggtgtggtggcacgcatctgtagtcccagctacttgggaggctgaggcaggagaatggcgtgaacccgggaggcggagcttgcagtgagccgagatcgcgccaccgtactccagcctgggcgacagagcgagactccatctcaaaaaaaaaaaagaaaaagaaaccagcttggccaacatagtgagaacccttctctccagaggaaaaaactaaaaatatatctggaagttgtagtgtgcacctgtagtcccagctactcaggaggctgaggcaggaggatcgctttgattgctgctgtactccagtctgggcaacagagtgagaccctgtcttaaaaacagaaaacaaaattatttatttgtgtattaaagatgagatctcgctgtgttgcccaagctagtctcaaactcctgggttccagcagaccttctgcttttgtctcctgagtagctgggactataagtgtgcaccaccatgcccagctaactttttgttttttgtagagatggggtcttagtgttgcccaggcagattttgaactcctgggctcaagcagtcctctcactgcagcctctcaaaatgctgggattacaggcatgatccaccatgcccaacccaaagccttatttcttttttttttctttttgagacagagtctcgctctgtcgcccaggctggagtgcagtggcgcaatctcggctcactgcaagctccgcctcctgggttcacgccattctcctgcctcagcctcctgagtagctgggactacaggcgcccgccaccatgcctggctaaattttttgtatttttagtagagacggggtttcactgtgttagccaggatgatctcaatctcctgacctcatgatccacttgcctcagtctcccaaagtgctgggattacaggcgtgagccatcgcgcctggccgccttatttcttgaaactgtttcttgattctttactcttggtcctagaaaaacttggccaaagaatgtgaatagatcttggaaaattcacgaagtgtttgggaaaagtctccaagtctttgggcaaatccagagatctctcaggcatcccatcagcaatgcatggtccttggtgactctggtgacccctaacggtataggtggggcaaatgatcacatagcatttacaatttttgtttctgaaacatgtaaaaccgccacattaacaatcaccttccctgggaacaaattagttatgactgaataatgtaatttgccataaatgcttgcttcctgtatatgtgtgtgcactagaaccaaagggttttccatacctttttgcccatagattttttttacattgtgctccagcacttgtgtgtgtatgaaaggaacatgtctttcctgatataatacttacacttactgtttacaaaatcctgttttctatcttattatttcaatactgttcataatgtactaaatgatttcatggcttagtaacaggctgcagcctgctatagagaactcccactgtagggtatccccagcaagctatgccagatgtgagggtacaggccccggagtcactgactgggccagtcctgattctgacattcactgcttggcctccttctcctctcatgttaaagtgggggcagctagacatagtggcacatgcctgtagttccccctactctggaagctgaggcaggaggatggcttgaggccaagagttcaagtccagcctgggcaatatagtgagaccctgtctttaaaaaataataaaattttaaaaaaaacaaagtggggatagtagcgtgccctcaaaggtttgccatgagagttgaacagggtaatgattgtaaagggcttagcatggcgctgggaacatagtaagtgctcaataagagaaggtgtgagaggtcaggacatgagcctggctctccgggtggctgtattggagcctaaaatatatattcagaaaacatacagaaaatgtatgttggggaagatgcacatccacaggggaccagtgggcaggtgtaggtgagtggttccctgaggagctggggaatgcttttggccttgaaggactgtttggctggagatcagtgggaaggatgttctttgttttttttgagagggagtttcgctctgtcgcccaggctggtatgcagtggcgatctcagctcactgcaacctctgcctcctgggttcaagcaattctcctgcctcagcctcccaagtagctgggattacaggctcccaccactacgcccagctaatttttctatttttggtagagacggggattcgccatgttggccaagcttgtctcaagctcctgacctcaggtgatctgccctccttggcctcccaaagtactgcaattaacagacatgagccaccgtacctggccaggatgttcttaaaggtggaagaaagggccaggagttcgagaccagcttgggcaacattgtgaaaccccatctctacaaaaaatacaaaaattagctgggtgtggtggcatgtgcccttagtcccagctacttgggaggctgaggtgggagaatcacttgagcccaagcagttaaggctgcagtgagccatgatcacgccactgcactccacgtgacagagtgacaatctgtctcgggggaaaaaaaagaggcaaagtgggcacagcgtggggagggcaggagactggggaagtgggcgaagtgctgctcttctggggttggaaacccagactcagggggtggggttcagtctctggagctctctgagcgtggaggtaatctgctggaaggggcatttcggaagctgagttttgtggcactgtatctcgtgctgaagcagaggctgtgggtttaggaggcagaggcccaggcagctgtggtgtaagcgaatgcatttgtggtgggagggtcctgggcaggaaggcagcgtgcatgggacctcatgttggggagctcacacctggaggtggggggcattgctgtcaccccaagctgagggttgaaatccaagaggttgatcttgtgatttacagatctctctcatgtaagaggagcaacaggaaagcacgtgagaaaggcctgcagcactgagtgctcagggctaaggtgacagtactgctcccagagaccctgacggtctcagcagggcatgggcacagaaatcctctgggtattagagacagacgcctaccaaagcacagggcgtcatcccacggtcaccctgatgagcctggtgtctccctctgttaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaaccacagtgtgattgtctgggatgtgaaactctgaggtcactcttgggtaagaagcgtcttaagcctttagcctcaaacgacgtgtgtttggcctcctcaatttctttctgaattcctacctctaaccagttgtaatgataattccttttgccctgcaggccaccacataggtttgtaaggccttggaacaggagcctcagtgcccctgaagtagcaggtgcagggacagtggacgtcaatgtgagtgatgtgttatgtgttgaatgtgctgccatgttagcacgtagacccatttgctgttaatcactgaatcaagctgaatatttgcttaaatgtgactatctgggcatcattttgccacaaaaacttgtaaaattttacgtcacgtgggttactttttaaaaagcatttattaagctcctctaaatgaaaaggatactgtggagaaatggaaaactgctgggaaaaaactactagaaaaaaggttgctgccacccagtgccttgctatcaacggaagtcggactcaggagggctgcaggagtttgggaaagcagcgaagttgtaactgagaccatctgccacataagctggccaggtgctaacccctggctttaggagctctgcccttgctggaaagggagagaagctggagcaaacgttcctcatccttccatgagtcactgctcagattactgtgtggaacttcccagtagcaccaggttaacagtgggactgttattccggaggaactggattcctttgcaatagggcaggtgccactcagtggtggagtcttgttacctaaaaccggcacaccctgacataccacactctgcccagcacagggcctggcacaccgacgctcggtgcgtaggtgtggaactagcgagggatttcttgctggattgtcactccctgatgttttccatgtggactgggagtcatcccaagctactgtgacaaggacgaagacttcatgccatgcaaacacggggaaaatcaaaactgcccaagccaaaggatctgaaattatggcctgtcagagcttctgggttttactcttgacaaatgattaccttttaaagaaataaccggccgggcacagtggcttacccctgtaatcccagcattttgggaggccgaggtgggcggatcacctgaggttgggagttcgaggccagcctgaccaacatggagaaaccccctctctacttaaaatacaaaaaattagccgggtgtgatggtacatgcctgtaatcccagctactctgggggctgaggtaggagaatcgcttgaacctgggaggcggaggttgcggtgagccagagattgcgccattgcactccagcctgggcaacaaagagtgaaattctgtcttaaaaacaacaacaacattggccaggcgcggtgactcacccctgtaatctcagcactttgggaggctgaggcaggtggatcacctgaggtctggcgtttgagaccagcctggccaacatggtgaaaccccatctctactaaaaatacaaaaaattagcggggcgtggtgtcaggcgcctgtaatcccagctactcgggaggctgaggcaggagaatcgcttgaacccaggaggcagaggttgcagtgagccgagattgcaccattacactccagcctgggcaacagagcgaaactccatctcaaaaataaaaaataaaaaaaaccatcatgggaacaaccttctgtccagtgtcccagtcttgtgcctgctctaagagcctgaccctggggaccggtcccatttgctaagtcgggtgttccctccatgtggggacatcgcccccatttttctgtttggatctgtgatgatccatatttttcagtagaggctcttctgagagggcgttcggagcccagctgtttcctttaggctctgatgtcttctctctcttttccgggacacttcctggattattcctaaagggacagcctcatgtaagcccagcccgctcccccatttc
